United States Patent 7,820,447 (COMPOSITIONS AND METHODS FOR CANCER) - sequence listing, part 4

SEQ ID NO: 1385 - DNA, 35658 bp, Mus musculus
  misc_feature (11014)..(11033): "n" at positions 11014 thru 11033 can be any base
  misc_feature (16841)..(17468): "n" at positions 16841 thru 17468 can be any base
  misc_feature (34295)..(34632): "n" at positions 34295 thru 34632 can be any base
  misc_feature (35541)..(35658): "n" at positions 35541 thru 35658 can be any base
aacatggattttggatttcttaggagaacttagaagaatcagacaagatgagcatgcagctgtttcctggtgtcagaaagccgctgtggtctttgcatatttcgtcctctgcattttgccttaattgctaccaaatgcttattacagagtcctgtaatactgagcatgtaaggccagatgagtcaggtcaattaatctgatttgcttaaaactcattagtccgaactaatagttttctttctcttgcagcaaagaaatttgttcctgctaggtaaggtgaattcttgtgtaaagcatgctatttaatacatacattttcccctctgcatgtaggaaagcagtgattcacgtcctttccttgtgtttccacagcagctgccaaagccttcaatcgtttgaaaactaccatgtgccttcttacaacgtctaggttcaaaacaatcaggtatgacttgggcaggtcatgtgaatgagagaaaaatctctcttacacatagtgctcctccttgacaccctcaatcaagcctgccattggcttgagagaatccccatcttgatgataatttatagaaacttgtttctttctctccctctccctcccgccttctccctctccctccctccttctccttctgtctccctccctccttctccttctccccctcccttctctctctctctctctctctctctctctctctctctctctctctctctctctctctctctttcgctctccccccccctctgtaagtgaagcagcagacgttggtcttccttggatcattttacttagggatggtggtggtggtggtggtggtaagtctagacccatttagcaattagatttgtaagcatgaatctaagctagggactgggagagaccaggcctcttcctttattcctctgagataaagaactggggcacagactttataggaacttgcctgagtttccaaagctaccgtgaacaccagcagtagcaggatctggaatctgtgatcctcagtgtccccattgcttctgagagtttgcttgggaggtcaagtccttctaaataaagggttttcttgatgaagagaattgctggtgtagtgtggggcttagagaaggattgaacagaaactagatgtttcaatttgcctcttcggctcccttcccttgagtttcttcattagcatagtccttggtgatgaccaatatagttgaacagtacttagttaaagcccaaggtgcaccagagttcattctttgggttgtatattccgtagggttcaatgggtataactgacctatatctacgattacagtgtcatagagactagtaactgagtggcattgggagttcatgtctggagcacctccgagacagctgctagctgatgggtgtgctttgttgctgcttccagcatgcaggagacttggaagactctcacacttgcttgtatttgcaggaacacaaatgcatcgtgggaaatagaatgataagctgaagacagcaggaaatgaactgtctacagaatcctggttcctcttgcctgcttaaaaactgggatcccgactccatggatcaaaactgagtgacaaggccagccctctactagaatgactcagtttcctctttcctagttagtgacagtatgaagaacatgctgccacagaaggtggaggtgctctcttcaaaagagagtgaatggacgggggagagcgcgagctggaatagcagaatccattctgactcttagtcatgctagaatttgggaacagaaacagcgttttattgctttgtttctttctcttgttccccacacagtgtgtcaacagctaattccagtattgttgtcacaggcgtaaataatatttatcagcagttttgagcaaatgattttctatttctatcttgaaaaacaaaaaaggcagaattgccatattctcaggttatggcctaggagtgtcattacgggtacaaggtgcagttcctggtgaatataacatgttaagactgctaggcagacatattggctttatccccatgggattcagtggctgccgaagtattcttgaacattgtgttctgtgtcctggcactgaagccagcatgagatccatcattcttatgtcagctcaagggtcaaaaggacttaaaaaaaaatcagaatcctgtggcctatcacatggcaaaagttatcctaaatcttttttttaattagaaaatccctaaatctaaaattaatgttatatctgcagcccacttattttcaaaatgagaaattaataatcagtgtgaaatcctgagtatttaacggtagctggttttaagacatggtactatcagaagaatagaaagtgaagagagagtttagatatttgatccccccctgccctgccaaggtttttttttttctggaagagagaccatccttgaagctaaatgttctgatttaataaaagcataaatgataaaaagtacattttaatgtatttaagagcatgtcaaaatgtgaacatgctgtgattcctaaaagagtggttcttttacacgacaaacacgtgattcttataccttgtatctaattctaaatccacgatgaggtgtcaccctgtaatcaatgcagacaatggacttttaaagagtaaaggtgtccagtggttattctagttcatatgttctagaggaggggaaagctggtgaacacagtgattatgttatgttacagagaataaaactcctaagcaatttcatctgcaactggcaatgacatacacttggtctgtaaatgccagctctgttcctgccaaaagtgtcccaagttccaaattaacatattagagaaagaaaatttttgggaggtcctcgctgattggtggcggtggaaaagccaacagggaacaggaagtgtgataggcattaggatgagagaggagtgacagagagagagagagagagagagagagagagagagagagagagactgtgagaaactgcacaatgtaaatggttgtatattttgtatcagaaattactgtgtgaaatataagtgtggtctgtatctaagtcctgattgagtattttaaattatgatttaaaatattttatggtgtaagagtatgtatttatttaaatatgttaaacttattgtattcacatatgagtataatgttttgcaataaacgcgtttctacttatctttgtgtatctgagtcttcttaacattttaatgcatccagattaaaatctgtaccgcataaaaattacatcctaattaattaattgtgtgcacatgtgcttgcgtgcatctgaattgtcactgtgaatgtgtggaaatcgaaggacagctttgaggggtcagctctctctttacacaccacgggcttgcgtggcaagtgccttgacccaaacctccctcttttaaaatggaatatcaggcaaccatatacctaactctgcaacatttctattggcgtaagtgaaaccctgtcagttagcggttccttcacactcttttctctcccctccatggcaatgctaatctacattatgtatatggatttgcctcttcagcacactttatatacataaaagtgcacatgaccttcttcctagctctttttacttagcacactgttttctagggttctccatggtgtagcttgtatcagctcttcatcccacttacggaaaaattatattctctgtgctgattgaccagatattgtatctggaccactcaggccattgtcactgaatgtctttccgccttttgattactgtgaatgacgctgctagggaagccctgagggtgtggttaaggtgcaactcctccactgtcattatctggaggcaggtaacttaggaatcctgctctgcttttagagaaaccttccagctctctcccagtgaggctgctccattttacagtcacacctgccatgagaagggctccagtgtctccacattctagcttatacttacagtggtctcttgatgacatcaacactctagtgggtgtggaattatatacatctaggctcttgtatccattccaaaagataaccaaacattgactatctaaaagaatcaccaagcccaaggaaacaaagtctttgctgcatgacagtctcatttgctgtaattttaaaaagttcatgttcatttagttcattgggttcactgaagtttgaattatcccatcttagttagggtttcattgctgtgaagaaacaccatgatcaaggcaacttcttcctttttttttttttttttttttggtttttcgagacagggtttctctgtgtagccctgactgtcctggaactcactttgtagaccaggctggctcgaactcagaaatccgcctgcctctgcctcccaaatgctgggattaaaggcgtgcaccaccacacccggcaaaggacaacatttaactgggtccagcttacaattttagaggttcagtccattatggaggaagcatggcaatgttcaagcagacatgatgctagagaaggatgctgggagttctacatcttgattcaaaggcatccagaaggaagggtctcttccacactgggtagagcttgagcatacgacctcaaagtctacccccacagtgacacacttcttccaacaagactacacctattccaacaaggccacccctattccaacaaggccactcctcccaatagtgctacctaccgtgggccaagcatatccaaaccaccaaatcccccaagactagattcatataatgaggttcttcgttaccagtatatacattcttgctgctattgcaaaggcctacaatgtaggcctgtgggcagacgtgatctaatttgttatcattctgagctagggcatacgtttaacagtggtctaggatgctgatattcctgattcttacgctgtgaatcctgagctgaattgcatcactaagtctcctggtccttcacttgcatacatacttcctgtttttcagaaagcccagtcattgtttcagcctcctaagttattgacggagctgttacacccatgaacttacatgacaaacaccatgacatgtatgtgccaacacacacacacacacacacacacacacacacacacacacacacaaaaatataaaatagtaataacaataacaacactacaagttagcaggtcatattaattacctttgaaagtctaaaatactacagagataggcatggttatctgaatgagttcaagccagaaagaccagtaaacattccaacaagcaagactacttagactccatagattataaagaagcaagcaagcatgtgaagttgggggatatgttggtgagtttccagggaatgacaagcagtgggagatgggggtggattaagcaccaaggaactatgaaattacttaagaacaaatacattaaaaaatgagactagtaatagttactcctctgtagcattttagactttcttttttattattattattattttgttttgttttaggtttttttttccccccgagacaaggtttctctgtatagctctggttatcctgtagaccaggctggcctcgaactcagaaatctgcctgcctctgcctcccaagtgctgggattaaaggcgtgcgccaccactgctcagcttttttttttttttggtttgtttttgttttttgtttttgtttttcgagacagagtttctctgtagccctggctgtcctggaactcactctgtagaccaggctggccttgaactcagaaatctgcctgcctctgtctcccaaatgctgggattaaaggcgtgcgccaccactgccccattttagactttcaaaggtaattaagatgacctgttaagttctagtgttgttattgttgctactacattatatttgtgtgtgtgtgtctgtgtgtatgttgacacatacatgccattttttgtcattattactaactttcttacagtttaaatactattatgtcagtgacttcctccagattgcttttgaatggctgaattcaaactttatatgctgtcttaccctcttcacactttctactcaaggtatttctaggtcccccaacctctctaagttagagccctgggattttatttaggattttgctttcagaagagccattaacaaggacttccactagggggtgaacgaggaaagaggaaggagaggaactaagttgggtcaagtcttccagaaagctcccgaagttcaagagcaagtgaactagctctgaaataagtttttaatctatggtacgaccagggtcccctaccccatggtcgggagtttataaacaaaacaaggaacacaaaggaaagtggggtgggaagggagaagaatggaagggaagggaggagaaaaaaggggaggggaagggaaggtagaggaggggaagggtagggaagggaagggacgggaaggaggcataggtaaccagaaaggactaagaggatgtggggaagaatccagttgccattgcttcttttttttttttctattttttttttttaatttgggggattataatataattacaatatctctccctttcctttcctccttccaaactggggatatcctgagcagggggcatagcttctggtccactactgtgttcttggggcaaatgattgagcccagattaggaaaggggtggggagagagagatagagagagagagagagagaagagaaagaggaagaattgggggcggaggatgtgaggctgggctggagaaatgaaagaaagcaaaccccactggtgacattggcacattcttcctgagcgcagcacgccctccttgtgcaagaactctgagccccaggtgcaggaggctgaggcctgcagagagacttgcagagagacccagcaagccatggtgagcatcccagcctataagagatctctagatattcaaaattttccttggggttgaagaggcaggtggcaagggggcaagaagctatcatttctgcgtttaagaaatatagaaaccaacaaacaagaacaagaacaacaacaacaacaaaacccctacgcatgctgtctcaagaaaatgactctagactctttcttgctgattttctcccttggtgtttgctttgatggaatgctggaaggggcacagataagattagacctttgcggtgacacagagtgactccctgaggagtgatatacatccaaaactacagttttaagatgtgcagaaagcctatggctttgttgtttgagttattaaaaatatattgcttcttacttgaaaaaagcaatgcttgcctttcctggcttctggctacatcattctttcatatatttgaggtatggctccttcatgacccagcgtgaaaggcaaatgtgagtgtcactggttcattagaccccaagagcattaaaaacaagagcattaaaaaaattaagattctgtttgatttaaagctcagtcgaaaagtaggtacaaagaataccgaaatatcggaaaacataacattaatcatgatcaacaacctgggactgaaacctggaaggaaaatgaaataaagtagtgtaccagtgtgtaatgaagtagatgccataattttcagccatgacacccacccccccccccaaatagtttaccttggatacggttgatagtgggctgatgggctttatctgtgaattgaagaagtgccagggcactgcctcatggtgctataagtttgcagttcagagtttaaatattttgcacttcatttacaggtgtttccatggagatgtgagggtacttactggggctcgaggaacatcctgaagctgtgggtctggacactgctctgttgtggtatgtcctttgtttttggctaagccttaggcagtgattgttcttttcttaaatattcattgaaagtacatagttgcagggaatacaatcaggtagatggctattaattcttttttttgttccttttttgttttatttttttttgtttttgtattttttatttttggctattaattcttttaaggactctcattctttctctgaccttcagaacttttctgagtccccctaataccagcttagcattgacattctctagtgatgtgcccaaatcctgatatctacacaatagtcctctgttaggaaggagtacagttaattgacaaacctctaataaggcacgttatgcttattctacatttcattttctattaatagtttgctgtgcccaaaatgaacttccacagtccagagcgtgggctgcctgagggctggggttttgtttttattttaggggcttttgtgtctttcttttgatgttacatgttttatgcttaagccttagagactcttcatcaataaatttgaaccattgtctgagctaacttatgttagctctccttcttctctcacctggactttcagctcagaacaagtgaacacaccctctctttgtttttataaatttttctttgcttttgagagtttcatacatgcacagtaaagtatgatcataatgatatgccatttcccccttcaacaacaccatataccccccaacacccctcccaacttcctgtctgtctgtctttattccttttgtttttgataacctactaaatccagttagcactgctcataggtgtacgggtgtggaccatcgactggtgcatgaaaaacctagctgtgaccacaccttcaaaaagaatgattctccctcccccagaaactattaactgacaatagcccttcagtaaggggtggggcctgaagatcctctaccccatccacacttgatcctcctctaggttttatgcagctgcagaaaatcacaactgctacgagttcaaaactgcattaaccatgtcatgtccagaagacagtactcccatattccccaacactacttcccaggctttgtgtctcttctgcaatgagccttggtagatgaggggttaatatgagcgttccatttagggctgagtctctaattctcagcatttaacagctatgcatctctccactggctgctatctacttcaaaaagcaatttctctgacccaggtggagagcagctcaggatgattggcttaagtataaatatttggaaggtatttttgatatgtctttagagtactcaccttatgaagtaaaaactcagtgagctgatggctatgaaatcttttatcttactgtaaaatcatagctcacataggtcatgccattcttagaatggccagtgtcatcaaggtcactgtgcacaatcatgtgttttacttggttgcttcaaatcccttatgcctgaaggcccagttgttaattaggcactattacttaaatatctttgtatgtagaacatgataaaaccaattgtgtgtcttttgcatcatctttatgtatgttgttctttctgtactatgagtttagatacacaattggtctatgtattgaggctttcccagggcagcttcttctacaatagaatacattttatgttacaataaagtatttaaaattatgttaatgttctgcctgaccctattttattttacttaaatgagaaattttatatctgtactgtgacatataataacagtaacaaatattagcctttaggaagttatcccaggattaaaaagtatagtgtagattttaaagctgtattaagttattctttaattaattcttagtgacatacatttctaaagtaggttggataaattacacttcaaagaattttgaggaagatctttcattaaaaaaaatctgctaagatatatttatgtatagtagtcattgagtaaaaaacaattctatatcttttcaaagagagagagagtctatattctgatccaaggctgccaacagctaatttgggtgaccctgaactgctcacctgttctcctgcagtctttgtccctcatctctaagtggtgggcagcctgcacctgtgcctggtcctagaacactctatgagtcgtcatatttctgctgctgttttccagacttcctgatacaccatggaactcactgttggacttaccattattctgaaaagcccatgaactgggaaaatgctagaaagttctgcaagcaaaattacacagatttagtcgccatacaaaacaagagagaaattgagtatttagagaatacattgcccaaaagcccttattactactggataggaatcaggaaaattgggaaaatgtggacatgggtgggaaccaacaaaactctcactaaagaagcagagaactggggtgctggggagcccaacaacaagaagtccaaggaggactgtgtggagatctatatcaagagggaacgagactctgggaaatggaacgatgacgcctgtcacaaacgaaaggcagctctctgctacacaggtaggcagtgtctaggctcctacgctgatgtgggaccaccatagttagagtaataagactcattacccagaaactgctattctgggttctaaaacaatcctaactaagccttaagcatagcacctctgggcaatctgcaggtacacaacaactaaataacgttctatccaggttgtaagtgtgttatgtggggaacagggatggacagactgtgcctcaaggacagacaggaagaggatgctgaaagctaggtggtctttgagggcttttctctaacacctcctaatcatatagacaatttctgtgagttaattcattctaaaagcagacaaacgcctacagccaagtggctattgtatcttataaattaaaagtgtagcgtgcgttatgcaaaaatgttttgaatacttaagcaaatttttcttgttcattataatagtgtcaaacaaaaacgttctttgtgcaaagaagggactctggatgtgatcacattaaaatgtctttgtgtaatctgcttaaagcctcttgccagccagggtcttgcaatggccgtggagaatgtgtggaaactatcaacaaccacacgtgcatctgtgacgaaaggtattacgggccccagtgtcagtnnnnnnnnnnnnnnnnnnnnggtattacgggccccagtgtcagtatggtaagcttcatttgtttgtttgtttgttcctgctggtgttcattagacccataatagcttagcattgctgtgcagagtttgtgtcgtgttggctttgcttacggacttctctctgattctgcatgtggacgacacacctggttatcttcaaagcatagttcagaggccatttcttcccacggtatttctttggacccccaatacagacaaacagttatcaagtagcggaaacaagactcaactccatcgaatcctcataactcttctcaaccctgcttctctctccatgaaagtggtccagtgtgagcctttggaggcccctgagttgggtaccatggactgcatccaccccttgggaaacttcagcttccagtccaagtgtgctttcaactgttctgagggaagagagctacttgggactgcagaaacacagtgtggagcatctggaaactggtcatctccagagccaacctgccaaggtgagtgactttagagtggatcttcgttgttgggacaaaataataccagttgggacaaatcaatattagcagttctaagaaatgggaagttccaaacagaaagctaaactttcacaataatatcttcctgtaaagatttcccaagtcagcatgaagtttcaatttacttcacaaggggtttgaaatatcacaaggagaaatgtgttgggatttgtcaaaggtgagcaggttacagtaaaaaatggggtattgtagacccttactgccaaggatgtcatagtcctactgagcttgcaggattaagaactatgaggttggatagaaacaattctatttttccctaggagagtgaggtattgggaaggtactcctgttcttctatagacagatgtgacaaggaacagtaaaagaacgaacatctgatacacagaatatgtcagagttatttaataacaaatcctatacacttattttggttgggtatttctggagaatatggaagcaaatcatagattctgtacttatggaatatatatttaatagaaactatttatgttcagggatcaagtttgaaggaaaatgagatgaacaggaataatcctgtggtgagatcccctaataaaatacaggtcctttatttgcaatgaatggccacttggcatcttactgccagcactggaggcaattatcctagaaacagcacagaggaccactgctaggatggccaagaaagagagggtggagtcatcagagtcctaggaagtcactcagagatgcggtgggagaaccggaaatgagagaatacacatgtgcaaagagaaaggctccagctcagccaactactatggaaaggcgcatcaaatcttcagaatgagactaagtttcaaaatgcgttttgatgtgtctgctgcacacaatggaaaattggaagaagaagacaagtaatggctttaaggaataaagaactgaaacaaaaattaatttcagtattaaccaactggactagatctgaccaattcacttatctctgaaactgtgactcttccccagaatgttacctccaccacaccgttggactgccctttagtttactcccctttaaacatcgtgcttgctttcttgatttccatcatatcctttttctaactgtctattttgtttgttttggtttgggttttggtcttttgttttcaagacagcatttctctatgtggccttggcagtcctagaacttcctctatagaccaggctggcatcaaactcagagattcgaatggggtaggaggcatattccaccaccagctggcttctgattgtttggttgactatagtgacttcttctgggttctttcatttgtacttatccaagctcataaactcttagtctcagtatctgtcttttctattattacgacttggtttgtttctttcttcaaattttctgaattttatggatgtatatatacctatgtgatctttggattaacaaatctgtttttagccatgacctccaaatatgctaagaatgttgtttggatatctacgactcaagtgtctccagtcagtttttttttcttttttgtggctgtaattacattccatggaaatgacatttaatgtcatttgtttaatgtcaatctgtgaaaagaaatggtgtgaaactctgccaccctactccaatacttgtgtaagataacacttgataaatcaattttcaaaattttatttcttttatggggctgaagagatggattagcttaagtgcactggctgctcgtacagcagacctgagttctattcccagtcatcacatggtggctaacagacatctctgactccaccccagatgatacaatgccatcttttggcctcctggggctccaggcacagaaatagtacacaatatacttgcatacaaaacacctatacatgtacaattcaataaaataatttttattaattaaaaaataggcactatcacacttggatataatgcacaatgattatattcatccccagccccattccaatcaaatcctcataactcttctcaaccctgcttctctctccatgaaagtggtccagtgtgagcctttggaggcccctgagttgggtaccatggactgcatccaccccttgggaaacttcagcttccagtccaagtgtgctttcaactgttctgagggaagagagctacttgggactgcagaaacacagtgtggagcatctggaaactggtcatctccagagccaatctgccaaggtgagtgactttagagtggatctttgttgtggcaagcttgtgtttatagtctgagaatacaggggagtcttgcctagaagtctgtttcttctgttgctgtataatttaaccagagttgggttgtagtttgatgcttttcaagtgttttgttttgttttgttttgttttgttttgttttgcttttctcactaaaatgaaatgcaaaacaccaaaccaatccaaaccaaacctagctaaacaaaagcaaaagtctttgaagtcatctggcattttataatctgatttacagcaatacattgaagttatactctgtatctttttttttctcattgttatcacataaagccttgatgaaccctagttgaactttggttcctctccttcaatgacacccattttatgtggtggccaacttagcaccaaccagtttctttcaggggatttacaggtctttcttgattgcttcagttggtaggttcttaaagtcatcttttctttgtttttctccagtgtaagctctcaggagaataacaacttctgcaaaaaacaaagccccactcttgattgttttcatttgcaatagagtgggttttcatcctttcttgactgacagggtttatcacatatagatgatggaaaaaaaaacctggtaactctgaagttctggataggctttttacatttatatttatagttccctagtttaattctctaaagtaaaccaaaatctatcgttgacatcatggaactgaattgtaatgaattgaatcagtgataagcctgcttcagggagtaggggtgtctgtcaaagctgcttaaggaaaaggctgaaagctttgtgatcactgagcatgtcccatgccagagtctgcctcctgagtctaagactgtatggtatgacatttccagaagtcttgcatgttaccatgctggggcagccttttggaatggctaccctataccaccatgggctgccaatgccttgttgtctctatctctgaccagttatccatatcacaagtctgaaagtacggtccaaagtaattcccacaagttagaaatttctagatttgtatggatggtttcattgataaattctggaggctctggtcaaaaccatgtaatgggggctggaaagaagaatcagtgttttaaagtacttgcttctctcaaggacctgggttgcttcacgccatgtggctcattaccatgtgccatttcctttccagataattctgtgcagcacacacatacattactcacccccataaaagttaaaaccatactgaaacaaaaagctttaggattggcaatgagactgggagggagatgggagaggctaaagggggtggtgcaaagatgaccaaagaacaacatgtataccatctctgaaaatgccataatggaatccatcgttatgcacgattaattaatggtaataagaaggtgaaaactgcctttggtcctgactgccctgttgtgttatgtcctccctgaagtgactcagtgcgcacctctagcagcacccaatcagggcacagtggaatgcagtcactccctggccaacttcagttttacttctgcttgtaccttcacctgctcagaaggaaccaacttaattggcaagagaaaaactgtctgcagatcatctggcacctggtctagtcctagtccaatatgtcagcatgagtaattttactcagaaatactgaaggcttaaagccggagctgatcagctagcagaagacagaaaggagataacaaacacttaagtccctttccctcaatacatgtggcctaagaaacaaatggatatgcagttgtgcactataaaatccttgcctgttcttaggctttcctttcatgataattattttctttctcaactctcctattgctttaaagtgtaaacccattgacatatttatgtatgacccatgtcttctattctgtcacaagtttatttccccgttaatcttttaacaatgcgtcctctaagctcactagtgactccctaactcccaacaagtgaaccgttctctagtaccccaagctgatgtctccccaatctgtctgtgcatgggaaggaccgcagcttcctcatgtgtatacaccgtgcatcagagtacatgaaaaaaaaagtgacaaaataattgtttgttaagttagcatatgaactagcagctaccagtgtctgcccaatgtaaaccgtcttcacagaaaatagaagcgataggccctgaagaagctgtcaaagaagatcgctgggtgtttggagtagagtgggggcagggagcaggaaggtggtaacgaggacattacagcaaggctgtatgccaggttcatcaaatacatttcctttccaaccgacttagttttcatttcctcatcttcagcaaaccaacagttgccaatatgtaaaagtagattccttcacctggaggtatcagaagatagattttttttttcaaattagtacttttcaataagagactgtaagccaacccagtttgtatatccaaagggtagaaatggccttttagttggtttgagtggaaatgaagggcaggggtccaactgcattgctatatatcattgcagaccctgggcatataaacaataagatttttgtgtatctcattcaatgtaagtagtagaagcagcttcctttgatcaacaagttacccagctcagatcgctgacttcattttccttacagtttagtaagctttctagttcttctctgtgctcagatatcaacctttaaacaagaccaggaaggaaacaccatgatgactacttcttgtttgagttttgagatacatccccaggacctccatgagtcacagatctgagaactgtggtcccataggcagaaggctagaggccagtccagctgtatacataccgtgggccttcccgtgttattcccctcatctgttacatatgttactgttgggggacatcagaagaccaaaatgatgactatcatgagtttgagtaagagaataattctgtggctcatgccatatgccttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttagcactacaatagcattaggaagagagtctatgattgtctaagattttcgaacatctctttaagagtcataactttccgggtgttgacatgtggttgcccttgggagaaatccttgtggattctctctagaatctattcactgaggtcaccactgtaatctagtataccatatatatgtatgtgtaaacatatacatatttaaacatatgtgtgtttatatttgtatgcatacatatgtagtgtacacacatatacatatatagtgtactaggttacagtggaggatatatacacatcctaatgatatgcatacacacacagacacatatacagagagagagagagagaaatacacatacatatatccaatatccaataaggcagaaacctgaagaaaaaagggaaagggaaaggagagcgtcctcaaaatcttattctctatcatccaggaagtatataaactctgcacgaggacagaacattcttcttttgcccccttcctccctcctgagtatgcctttgccttcaggtcggaccaacgcaccagccacaggcccacagtctgctgcagttttgaggtgtgcactgccacatttgtccacgtttatctagcagatctactcaaaactgtaagattcacataccccggcagctttaaagattcccccgtattaaggtcaggtactatgagtaacctttgtgactcctttgtgctgcttcctgtggtagaagctgacggccacttagatttcccttccaccagactcaccagtgcacgttgtgtcacccagctcacccacactggcaactgaaagaaaatcgtctacccgtctctgacaatcttcccaccatgatttgatctcctgtccaaatttaaaaataggaggtgatagactcattttccaccaatccataagataatagaggatgcgctatgtaggaacagcactaactataacgtgtcagtactgaacagttcaaacttttcctctattgatggaaattccacggaccttggataccgccatcacacaggatactaagtatcgcctacggcaccagaacaaagctgagattgacacttttcttcctcttactgagacttcaaaacctcactccaactgtcttgctgccttgggtggggcaaagaggtcatcacacatgctccctgagtaaggtggccattagctcagtgacttcaaggagtaatgaggacgacaaggactcccaaatttcatctttttcagaggcagttgtaaccacaaaggaatttagtcaaagtcacccgtatttggtgggtgctagctggttaaggctaccttatgagtggggaggagaaaagctgtaggttgtttttaaagtcttaactttggagtcagtcatttctgtagacgatctcaaactgataacaagaaaacggcatgcccctgctgtgggaatctgagtagggcaaacaggaaacagataacgggtacttgggctagtggcagttatgccaccaaagagagtagcggttcccagagatcactaactctggagggaaaactcggtgtaactatgctgtgtccaatggtcttcaatcatgaaacagccactcatctctcaagcttgcaagggaatggctttgtcttccaaacattttagccataaattgactctttacaacatgaatcatgtccctttttttctatagagacactgatctaggtccctgagataaccctataggtgttcaatagatatgttgataagaatcatagtgaaaataataattctatatccatacatattacgtacatgttatagttttattgggttcatcagactggaaaggggacatgtgacaattcagagtatgaaggccaatggggtgacaaagcattcttctctcaggtggatgctatgacctggtgcaagggctgcctatgccctaatggtcttggcttctggattccctttaactcttctcctgggtccacaaacaaggaccctggccatgtgctctggtagaaacacttggtactcctagcttttctcattctccaaggcaatggcattttttttaggccaagctctaaaatctctttaagcaggagctcaaggcagaaatggctctttcctctgaaatagcacccctaaaaagcacttgctttcagggttacaaggcaatgctgttcctcaggcggaagaaatttccacctgacccaacacactggtttagtacagaacatgaacttgaatgcattctctcttagttctcttttcttcagaaagacacttcctcagtaggacaagacactctctcagtaggacaagaaattcccttagtaggacaagaaaatcccacagtaggattctgggtcttgtttacctattgtcattactttcattgttccttgccatatacatatggcaagaaatctcagaaaaggtagtgtgtgtgtgtagacgtatatatacacatatatttatttgtgaagatgtacaaatggactcaaacttgattattctacctaatctgtatatttggtccatatcatctacaagcaaaattttgaaagactagcttttatagaactttaaaatatcaaagacacaattgagtactgtctattatgtgccaagcaatggcctaaacattttaaataccgttttttttaacccaacaatgaatttaccatctatgtgggacaattctagactagcagtttacagccactgaaaaacaccaaagccacccctctctcaaaggattctcctttctcagaaagctttctttctgtttctttttcttctgtttcctacagacctcatttcttcacaccactagttaagcaatatttaaataagaatgtgttttggttcacaaaatgtactttgtatagtcaactaaaattacccaaagagtaagttagaggagagtcccaactgaataagcacaactaagctggagctgaggtttttgtttggacacagaaatgtgggttccagagttctatgcatttggtggaagtggttttcacacctagttccatgtggcctgttcaaaggggaaacagaagtatttatgacatatgaattgtatataagattccatatgatgtatgaaaatatgccgctcaaattggattgcatgatcctcactgattcctactaataagaccagagccaaactctcaggactcacataagagaagctgagagacattgaagtcctttagggaggggctggtaagaggatgagctgtgcctgggacactgggtcagaccagtagggagttcagccaaggctctggctttatgagcatcacagcaggtggagtggagtccccagaagcaggctcatcacactgttctgctacagctctaaacggttactggtaccccagatccacttagcaacagatgggtgtccacttaccaaatgcacaatgtatttccaaagacagttttggaggtgggcataccctttactttaaaaaaaaattgaaattgtttactttttgatgatactttttttttattcttttttctacgtttaggcaagaaatctcaagaaaggtaagtttttcaatgaagaatttccacatctgtttgtttctactttccttagggtgcttcctattatagatagaacacaaaccccgcagtagttatttacctgagcgcctcatacaaatagcatttccagataaggtagttgagtgctagctgccattaaatctttgtgactttgatgctagtggtctgaaacagatggatgtataatatgcctattaagaaaggagatttcatatggtgggaatgtttcctggtagtctctgaattttccttgagggttagaagcatgctgttatgttttttcttgtcttagcttacaggaccaacgtctaacaattgagaaacattcaattcaacaagcatttccaacaactaacatattgtaaaaggaaactgtccaggtgcaggccatcagtcttaacacagaagggtaaatgactactctaatgagtgctggccttcagaaatgagaaagagcagtggagcatggaacctacccaccacttccctaaagaagtatttgccccagttggttctcaacactgcagttcttccagtagagtaataatgtagattgttgagacaagatgcagacacatggaagttcctggcctatctggcagaaatgaagaaagggaggatgaaaaaggtggccagagagacagatggaagaggatgaaaaagagctggggtgacaagagtgggaaccatctcaaatgcagccagagtagccatcagatttccagagggtgcattaagggcatcagtgggaaggctatttagataaagacagaggtcagctggagtaaggatgaggaaccatttaggataatcatctggaagcagaatgtgttctgctctcttgagaatttgccacaaagagtgggagagtggtggggttgaggacatgggctcagtagagtctttttactctgtttctattgctgtaattgtgtagataggacccaagtaagaaaagggtctctctggggactggcctccctatctctgtagcaggaaacccacaggatgtaaatatttcttctgtgttcccaccagctgagtgaaagttcttttggcatatcctacccagagctgtgttctggccgcagaaacacctgctttgattgctactgcacggaagtggttcacttcatttcaaggatgcggtggccagcaagagatgctagtcaaaaataattagcataaaattgtctaatagatttaacagtttgttgacttttttgagtaattgacaattactcaattaacttttgtttattgaacgtttttttttattagaacaacactaagcttaactgagacactcagagcaatgagtccttgactctaacttcagggaaattcttatctaattgtggaatgaagacagaaatatttagaagtacagaacaatctaaggcagaaatggtcatagttgatgaattttgtaccgatgagaagaaaaatcattgcaagaaaggcagaatctgggagagaaccttcaaaaagttcagactaggaaggtaactcaaacatgggcatgagaagatgcgcagactttcctagagtccctggtctactgagcatctgggcaatgaaggcgatcatcctcacaccagcacatggctttagcttacccaccaggtgtactagaacttggaagctgattggctacctggagttaatctcactgattaactaaggtgataccacttcatacatttttaggctcgaaagactgaggacatcaccttaaaactgactttgtagttaggtaaataacttacccacaggccttgtgacagtgatagttacagtaataaatagtagataaaaacaaacttttatcaaatacacattccatgttgcatactgttttaagtgttttgagtcttaaatggttagatgttgtctgcaatcctgtatagatagggagtgttgttatccttaataacagtaaagaaacagaaggggaaacgacagtggcttaagggaagtcactggaaaaagggaaaaagctgaaacttgtaacaccagcatccagagacagtatccctgttactcgtatgattctagatccttgatttacttctatgttaggggttttactaccagagcccctcctcttccagtaaaatgacttattttcacactaaaccatggtgtgatggcactgaggaagggtgtggtggaagaaatagggtgtgtctctagaacaagccaaggggggcatgaacttttttttttttctaacttaagttgattctcacaggtctttgttcttgttcctattagtttttggctgatgaatgactccttgggcatttgtggttttgattcttgctggttattttgactcttctgcaaactggttctgtttatcacctcatttggtttctggtttctaaattctacctgggtaaaagctacacccatgatacacaggatacgatgccaacctcagaggagagggtatgtgcgagattctgctttcagaaacatttttatttctacactggcaagcaagtttgcagctgccacggtggtttaccctgacagttcagaacgagaccagagcctccgaatctggttctccttttgaaaggtgcaaaggcacagaaatatggttctcctccaccctttccaggaatggcacagttgtgacatagaacacagtggcacctatttcatgaatataaattcgtccttatctctctaaaccatactccaccagaatctcaaatctggaaccaataccactctcttcctgagtttttattttctccgatctcacattttatctcctacttccccacctctccactgtaaaatcagcatgcagtaacctccacaggttccacatggaaattagcagtattgcagaactatgaccagatgcgatctgggggccagcactctgaacatcatacttcttagagaatcgggacttcaggctgaatcaacgtttacattaaaatatttatttggagagaggggctggagagctgactcagcagctgagggtgtgtgctgctcttgtaaagaacccaagttcagtccctagcatctgcactgagtggctcacaactgcctgtaactctggctccaggaaatttgccccctagaaactgtaaccaagcaacttcagtcatgcgcacgggcacacacacatgtgcgcatgcgcacacatgcgcacacgcatgatgaaaaatcaaaataaatctttaaaacgttggcttggggatactacttgactgtgaaaaatgttgctgtaatgtctcttccacatttcttttaaaacgcttcacaccttgtccacgatctccaactagaagccttccgtgctctcttcttcacgttagtggctctttacctcctctgctagcacttcagtgtttgtggtttccttgcctctgtcacctagagaatgttcacctgtattactaacaaattcgtttttaccacttttaaaagctccttagtttaattttataatctgttgcttctctttcaggatggatgatccatactgattcatcctttgtgaaaggaaagccatgaagtgctaaagacaaaacattggaaaataacgtcaagtcctcccgtgaagattttacacgcaggcatctcccacattagagatgcagtgtttgctcaacgaatctggaaggatttcttcatgaccaacagctcctcctaatttcccctcgctcattcatcccattaaccctatcccataatgtgtgtctatacagagtagtattttatcatcttttctgtggaggaacaagcaaaagtgttactgtagaatataaagacagctgcttttactctttcctaactcttgtttcctagttcaattcagcacagaagctaatgccaaacacagtgaaaatatgatccatgagtaattggaaactcagactccttgcgcatagtacgtaccctatgtaacatcgacaaaaatctttcatttccacctccaaagaacagtgctctattcaagttgggaaagtcctacttcctctgtagacccactatctgtgagtgacagccactgtagctgttcacattaaccttccccatctccttttcctaggagaataattccacacactgcaccccatgatggccaccaaacatcaaagaagggaaaatctcctgcattgagttttagttttgagttttcccttctctttattagatctctctaggttccttgaagtcagtgttctgatgattattaatagttaatgataacacaacccactctcttggagctgatgttatgaagacaacaggtagaaaaattcctgggctcaggctggagtgacacccttttctttccctaacatcttctactcagatacctaaatttaagattcaggacagctgtccccaactcttaccatgtcttttataacttgctccttaacttgcccaacctgtaggctatctcattttctcgcttcactctgcaaggtttataacatgatgaatttaaatacagcctgttttttgtttttttttaaatgttacttagtctatttgtataccagaatatgtgttgtttttttcctagataaaattgtacccttcttgaggggagagactgtgtcagatctcaggagttcctagtttgttaattgacccttggtagatttgtctgactgcagtcagtgaatgaagctgtgtgaggagatttctgagagcttgtgagaaaacaccaagcaaacaagacgagcgtcttctaatctctgttcctctgtaacagggatgtgttctcggaatggtcttttgtgcccctccgaggtgtaaatggagtgggtttgcttcagattatccatcagttaccaatagtatttagaggatgtttccaagaacaggctctcctcctgactgtctatggcttgaactaatgtgaccctaccctcagcactgtacaagctgaaactcatgtgactttgcctaaacttatgtgaccttgccctcaggactgaatacagctggaactcatgaactttgcttatacgactttgctgaggcaagcagaactctgtgagttcaaggctaacctggtctagatagagagttccaggccagccagggctacatagtgagaccaaacaaacaaatggtgagaaataaatgaatgatagagaaagggaaggggagagatagagagagagagagattgagagattggaattatttcccatttcataagtaatgcagtttttatgcacattttacatcttatgtgagcattttttaatgaggaccatggtttgtttgtttgtttgtttgtttgtttttttaagtcacttctgattctattgcaattgcaaagccctttcatcctgtgtgtctaccagcaggtgtcaatcatgctcacacaccttagggttcatcctttggagaagtatagtgcacaagaacagactcaagagttcactaccctgtctgatgcttattcaggacaacagaaatcacagacacaattagatcctagataaggcgtcaggagaaaccaggttttttaaagtagagacaaagttttgacaccagagccagcagacaaatctcgcaggcttaaacaaaagccaagatggaaagaccatcacagtgctctaaagctcatgaagtgtgtactatgccatggtctttggaaagcaaaatcacagatgggcagaaccacaacagcattctaggaaaaaaaaaacctatatgatggtttaagaggggagagaaaacagaagcaggggaggcaagccattcaaaggcagttctcctggctcagcaacgatgagccaggaaggtccatgtgggcatcccgaagcctttgttctctgactaatgggagggtggagagtgggaggaagagtaccgagctcttagaaaggaaaacataagacaaagattctggttaaatatggcttatgcaaatcttcccttattcaaagatcttgtaggaaagtccctcctctgttatttttcctccacatgaatgtatctcctttattcttaatacaggattgagtcaaggatgtaacccaaatgcctgtaagctcacaaagacaactggagaagaggagcaatgggaaagggctccaggtcggaagtgctctttaaatgagggtggtgatcaattctacccacttacaagaaaacaagccaagtttttgaggtttcataaacacagtttaagtagagacactgatacagactggtcagcctctgtcagggtgcagggaagctttcagcaactcttcctcattgggctatgttggcctgtgaagtcagattcatagagattttgagcgtgtaggtagcgtgttggatgatgcactacttgctgtggagtatgtcataaccttctagatagattggctccccttagaaagcatctagagttgtcatagttttctattatagacatacttattaagctgcagagtggtgcttccatcttaatacttaagtaatttaggaaaacaggaaatcatacatggtcaagctatgctctgtgactttaaagactcctgctcctcctcctcctcctcttcctctccctccttctcctcctcctcctttcataagaagctcttggggctgatggtgtatatgaaccagccacaactcagcaactaaggaataacaccagctgttgagtaatgtttctattagtacttctgtccccaaggagaactgtttggagtgatttttctcttgctgatagcaataataaacaaatgctttgggttttttgttttgttttaagatttttcatcctgataatagttaaagtctggagattagaaaccatggcttcttacaccatgcagtgctttcaagggctagctcatgctgcagaagaccagagcttcactggagagtgacacgtcaaaacacccttgagcagcacaagacctctatctcttgatcttttgtgtgtaatgggaagggggaatacctagaacttatatttctgttttctttcagtactgggaattaaacaagagcccttgtgcatgattgacaagtgcccttccattaagctgtgttcctcaggctagttttaactcctaagaactccgtgacttcagatctccttctcatgcttttgaagtttaccagcaaattaagcaacactgtggcttccctgtgccatgtggtttgagcaagttactgacaccctgtatgccaggcttattatcactaagtggtggacagtttagcccgacttttcgtgttagctgtaaggactaaataggcaaatacatgcaaagaacttaggaagaaactggaaaatagtaagcaccagataaataacagctggtgatgcagtgaatatcatctttagtgtcaaagatctgtgtttgtggcatccaagagcattgtggtcttaggtacatgtataagagcattgtggtcttaggttcatgtcttgggcttctccactatcctatgcaatatcccaagacacaaggccttgtgtgtatcctctcccaggaatagtaaaaagcagagagagatattccatgtggccacactggggataggaacaaagaaaggggtccagtgaccccaagcccatgtttcacactactgacaggaactctattcttaagcagaaaaagaactggagtagaggggcaagaggaattaaatagtctctggtaaagtcttgtaagactatttctctactcctgcacccaacccaccatcacaggtacctgtccatcctgtaaggttttgttctaatgggatttgaggtgaattgtgagtcacaatgaagaatctatgatttttgttcggttgtttgtttttgttttattttgtttgtggcaaaagtaccttctacatgcctaattcagactcaggcttatttttagtgcccagattcttcatttgtaaggtaggattaataatagatgcttttgtggatagtggttcaggcagagtctcttaagtgctcaaagtgtgaaaataaaagactgtgaatgctcagccatagatgggacttctgcatcacacacacacacacacacacacacacacacacacacacacacacacacacacgtacatatatacacacttacacaaatgcatgcaacgcagatatacaagcatgctcaaacatgagtacacacacacacacaagtacacatgtgcacacgtatgcacacaaatgcacaggcatgcacatgcacactcatgcacacacatgtactcacacatgcacaacccccaggctcagagagcattacagaagaaaggtagaaagaatgttaaagccagatatgaggaagaatattgccctctaacataacatggccattgcattcatgaactgacagcagctgtggctaattgcccaagtagcaagccaattccaaattccaacatggagacaagaggagctcctgagacctctctgctagctggggagctattggcaattgatggctactagagaagaaagcatcacttttcgggggttcaggaaaggtggccactggctggttgcccatgccccaggggatgacccctcatccacacacaacttggcagcattgattggacttggtggattactaatacagaagacctgaagctgtaaataagacagctgggaagatgacttggtgggtaaggtgcttgccttatgactctgaggactagggctggcatccctagaaccaacattgaagctggagctcatgatggactgtgggtgctatgacccctgggtaggacccagagagtgcctatttctgctggcataccatgtgacagaaaatagaggatccaagcacactagtgaaaccttagattcggcctggcacagggcagggactgcttccctcaggtgctggcagcctggcactaacccacagtgccagtgggatagttggcttttccagagctcatgttgattccccattggtccaaaggcagtatttaaaacaaaacaaaacaaaacaaaaagcaacaccaataacaaaaaaccataataacaaatgctcgctgcttcacaatacagtagatttgcacctcgatgctgatctctggagtttatttccccggttcgtgactctgcctccctcatcccctcttacatccctgtttccacagtaaacactgcacatacaaggcagaaacaggaaacttctccatccagctggctagctagactagcactagtattaagctatgaattcagcaagagactgcctcagtatctaaagtggggagtcactgatgaagccacccatcttatcttcaatctcagatctctacatgaatatgcacacacatacaaacattcatacatacttgcacatgagcgcatgcacacacacacacacacacacacacacacctgtaaaagtcaaataaacaaatctgttgaatgttcacttctctaagatactcctgaagaaataggaaacccaaacatctcctgtattgaagataggatacattttacaaagcggggtagtggtccacacctttaatctcagtgctgcagaggtagagccagtgcttaatctcagtgctgcagaggtagagccaggcagatctctgagttcgagggcagcctggtctataaagtgagtcccaggtaagccagggctacacagagaaactgaatcagaatgttaaagtgcttcacaacagaacctgctggccttcatttgtacattgctccattctttgtcaaaactagagccaggctttttttattcttttctttttttatttaaaaaacaaactttttgtatcaaatggagttacatatctttcccgcctctctttcctccctttcacccctcccagctgcctgtccttgaagccctgtcatatccttcaactctcaagatgatagattctttttcacagaacattattgttacacatatacagtttaaatctcaggttcatcaaagaacttgtgtgtagcagccaagcttttcccataaagaaaacaacagaaaatagtcttccaagtattctttacacttatagacacgaaaaaggaatattctccaagtattatgatttgagaacatcttgattcacaaaccaggataaatacttatcaacaaataaaaattccagactaacctctcttgtgagactatatgtgaaaaatctcaagcataatattagcaggccaaatatactatccaataaacatatataacatgatacccaatttatttccatgatgtaagagtggaatttctattacaagatccataactacaaataacccatattaacagagtggaggacaaaaccctcatcaataatcaaaaaccctcatcaataatcatcaaatgctctcccaacatgcctccttcccttccctcctcctttgacaggtgtcatggctgcactctgctccaaagaccacccttgctactcctctagcctttcatgcataaacaatacccttccttagttcgtgcgttttgggaaacatattaatcctcactgcttctgtcccacattccattgcatactagagatctggtcagtgcattacccagaagtctctgctcctgagcctgtgttttagacacaatacagcaattacctttccgtgaagtctctgcctgcatgtctgtcttctaatctttgggttcttgtcagctcaactcgtgccaatctccgatctctggatactgagcttgggatttgaacagaaaatctcctaaatccccaaatttagataaccccaaattctataactgtgctttataaaagtcagagttcaatcaagaaacaccctgatccaccaattcaggtcttgcagattacaaaacctttccactcaccactgcccttcattagaataacggtgcatacagcaacagaactggagccaaacccctacagtgaactgcaagatcattctagaccttcactttctccaggcacagttcttcctgaaaacagcagcagcaataacaacaacaacaacaacaacaaaacaacaaccactacaaaaacaaaacaacaaaacaaaacaaaaaaaccaaaaaccaaccaaccaaccaaacaagaaaaactttttaacattcagttagcctgacatccaggaagttcctttgactttggctgtggcgatccattgtcattttgttttttttttttttttgagagagcactagcccagatagttctaaactggctgactcatgaagcaatatcgtggctacagatgacacaagagaatttatttctgctaagatttgaatgttttaaaaagttttgatagaagttggtggtattggtgaaaactttgcctcctggcacagggtgacaattaaggtgtgttagagtttgcttttcttcccagtgttggcactactgctctaaggccctgagagaaaggggcgaggggggaagaacctttggcaacattccctgaggttataggccaccatttccccttcctactgcactgacatgcaattgctggcaaagccctaacaattccctaggttagctctcttgtgtccacatttcccaaacatctcaagacaatgcccgtaagaaaggtctggggaaacttgtaggtttaagtcctgattcatgaaccaggcaacagcagcagaaggaaatgcacgtgacattggtgcaatagggtagacgaatgcaaactgaggataaatgtagctttttgctttgtgctgctggcaaggaccatgccaacagactcacttttctcagcggtaactcattatgttatgctatcctgttcatctgattagctattgattcatctattgttcatcagatagacaagtggctagctgtgctatgaaattccattcttaagtgactaccactgaccaaaaagtactagctgtacctaatctatttctagatgcagggaaagaggaagcatagaatacagtcggttgtcctgtagctatgagcatcctgaaagatgttgaaagaacggttgagtaagcatatgatacaatcacatcactaaccagttttctcaggaagctgtttaaaatagccttcatcctccatcactggatatagccaattttatagattggggtacagccttaggtatggagttcactgtatgtctcgattttcatggtttaagacgagcacattagtgacatcaactagatagcttcatggaattgcttgtcattccttccccaggtaataggtgaagcaggcaggataacactacaataaaggataaactggaaagtatgtaaaagaatcgtcaaaagtggtggaaatccggtggaccttgaaaacacagcatagctccatagagagaaaagtaaggtttcttgcacctttttctaccctgaaattcatttcagagccaggattcctatggcagaagagctggaggctccacatggtctcattgctgtttctgttgacagtacaggagactcctcgaccgctacagtctctgaacgtagtgtggaggggggctgctcaaagtacagttacacagtcaacagagctctccgtagttcacatctaatctgagcaactgaggatcagtgttagcagtaacccttctggtagagtgcagccatcctgaggctagctactgtccatagcatatctccatactaaagactactgtgattcaactacactaacacaagcagcagcctcatttctccaactatcctgtccaggcccagccgcaaggcccctacactggcttccaaacatatgcaatgccctatctccaccaaacaggtaaagccttggcttaatggataactgggtagcagccttggtgtcttgccaggcactggcctacagcacatgtatccttctaccacatcccaacaaccatttaagttccccttccggactgacagcacaccacatagctggccatcccatagtaactgtacaatcaaacccaacctgacagccattgagtggttaccatgcccatattggtgagtctgctacaactgtcctgtcctaaatgtcatcatcacaagcctgggatggtccccaaaccaaccaactagtaatccccatcctccagttatccccatcctctagtaatccccatcctccagttatccccatcctccagttatccccatcctccagttatccccatcctccagttatccccatcctccagttatccccatcctccagttatccccatcctccagttatccccatcctccagttatcctcatcctccagttatccccatgctccagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaacaatagcatgaaggtcctcagctttgagagcaatgtgaacaccctggccaatgaatcctgattagatccaatccaatgaggcttctctgaagtgttacattaaatcagtcaaaggacaacgaaagaattaaaaaacaacatggaaaaaagtcgagtcacctatatggaaagcaataccaagccaacagcagattcctgctcagaaatattgcagccccaaagaccataggataatatattctgagtgttagaagaaaataatgccagtgaagtgtactatacaaagacatccttcagaaatgaagggaaataaagccttcctcaggcaaacaaaacctgagggagatcatcaatactacaaagatttgtaaaaactccttattaagggaggaactggcatcatgaaaacttgcaaacgattaaacctcaccggcagagtgcatacaggaataggaaagagcaagaaatcaaagcttctcactaccgaaaaccaccaaaccacaatgattcacaacaagagaggaagaaaaatacacaaaataacaaaataactaacaataggacaggcatagtcatatagactaataaggactttagtgttaaatggattaaactcctcaattaaaagaaatgttcctcagtcaaacatagatctttttttttttttttccattttttattaggtatttagctcatttacatttccaatgctatcccaaaaagtcccccttacccacccacccccactcccctacccacccactccccccctttggccctggcgttcccctgtaccggggcacacaaagtctgcgtgtccaatgggcctctctttccagtgatggccgactaggccatcttttgatacatatgcagctagagtcaagagctcaggggtactggttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 1386 - DNA, 2199 bp, Mus musculus
gaattctcgagctcgtcgaccacgccctccttgtgcaagaactctgagccccaggtgcaggaggctgaggcctgcagagagacttgcagagagacccagcaagccatggtgtttccatggagatgtgagggtacttactggggctcgaggaacatcctgaagctgtgggtctggacactgctctgttgtgacttcctgatacaccatggaactcactgttggacttaccattattctgaaaagcccatgaactgggaaaatgctagaaagttctgcaagcaaaattacacagatttagtcgccatacaaaacaagagagaaattgagtatttagagaatacattgcccaaaagcccttattactactggataggaatcaggaaaattgggaaaatgtggacatgggtgggaaccaacaaaactctcactaaagaagcagagaactggggtgctggggagcccaacaacaagaagtccaaggaggactgtgtggagatctatatcaagagggaacgagactctgggaaatggaacgatgacgcctgtcacaaacgaaaggcagctctctgctacacagcctcttgccagccagggtcttgcaatggccgtggagaatgtgtggaaactatcaacaatcacacgtgcatctgtgatgcagggtattacgggccccagtgtcagtatgtggtccagtgtgagcctttggaggcccctgagttgggtaccatggactgcatccaccccttgggaaacttcagcttccagtccaagtgtgctttcaactgttctgagggaagagagctacttgggactgcagaaacacagtgtggagcatctggaaactggtcatctccagagccaatctgccaagtggtccagtgtgagcctttggaggcccctgagttgggtaccatggactgcatccaccccttgggaaacttcagcttccagtccaagtgtgctttcaactgttctgagggaagagagctacttgggactgcagaaacacagtgtggagcatctggaaactggtcatctccagagccaatctgccaagagacaaacagaagtttctcaaagatcaaagaaggtgactacaaccccctcttcattcctgtagccgtcatggtcaccgcattctcggggctggcatttctcatttggctggcaaggcggttaaaaaaaggcaagaaatctcaagaaaggatggatgatccatactgattcatcctttgtgaaaggaaagccatgaagtgctaaagacaaaacattggaaaataacgtcaagtcctcccgtgaagattttacacgcaggcatctcccacattagagatgcagtgtttgctcaacgaatctggaaggatttcttcatgaccaacagctcctcctaatttcccctcgctcattcatcccattaaccctatcccataatgtgtgtctatacagagtagtattttatcatcttttctgtggaggaacaagcaaaagtgttactgtagaatataaagacagctgcttttactctttcctaactcttgtttcctagttcaattcagcacagaagctaatgccaaacacagtgaaaatatgatccatgagtaattggaaactcagactccttgcgcatagtacgtaccctatgtaacatcgacaaaaatctttcatttccacctccaaagaacagtgctctattcaagttgggaaagtcctacttcctctgtagacccactatctgtgagtgacagccactgtagctgttcacattaaccttccccatctccttttcctaggagaataattccacacactgcaccccatgatggccaccaaacatcaaagaagggaaaatctcctgcattgagttttagttttgagttttcccttctctttattagatctctgatggttccttgaagtcagtgttctgatgattattaatagttaatgataacacaacccactctcttggagctgatgttatgaagacaacaggtagaaaaattcctgggctcaggctggagtgacacccttttctttccctaacatcttctactcagatacctaaatttaagattcaggacagctgtccccaactcttaccatgtcttttataacttgctccttaacttgcccaacctgtaggctatctcattttctcgcttcactctgcaaggtttataacatgatgaatttaaatac

SEQ ID NO: 1387 - DNA, 1119 bp, Mus musculus
atggtgtttccatggagatgtgagggtacttactggggctcgaggaacatcctgaagctgtgggtctggacactgctctgttgtgacttcctgatacaccatggaactcactgttggacttaccattattctgaaaagcccatgaactgggaaaatgctagaaagttctgcaagcaaaattacacagatttagtcgccatacaaaacaagagagaaattgagtatttagagaatacattgcccaaaagcccttattactactggataggaatcaggaaaattgggaaaatgtggacatgggtgggaaccaacaaaactctcactaaagaagcagagaactggggtgctggggagcccaacaacaagaagtccaaggaggactgtgtggagatctatatcaagagggaacgagactctgggaaatggaacgatgacgcctgtcacaaacgaaaggcagctctctgctacacagcctcttgccagccagggtcttgcaatggccgtggagaatgtgtggaaactatcaacaatcacacgtgcatctgtgatgcagggtattacgggccccagtgtcagtatgtggtccagtgtgagcctttggaggcccctgagttgggtaccatggactgcatccaccccttgggaaacttcagcttccagtccaagtgtgctttcaactgttctgagggaagagagctacttgggactgcagaaacacagtgtggagcatctggaaactggtcatctccagagccaatctgccaagtggtccagtgtgagcctttggaggcccctgagttgggtaccatggactgcatccaccccttgggaaacttcagcttccagtccaagtgtgctttcaactgttctgagggaagagagctacttgggactgcagaaacacagtgtggagcatctggaaactggtcatctccagagccaatctgccaagagacaaacagaagtttctcaaagatcaaagaaggtgactacaaccccctcttcattcctgtagccgtcatggtcaccgcattctcggggctggcatttctcatttggctggcaaggcggttaaaaaaaggcaagaaatctcaagaaaggatggatgatccatactga

SEQ ID NO: 1388 - DNA, 40955 bp, Homo sapiens
atcattgtgagggctaaaggtcaatagaaataaaagggaaaaaattttttaaaaaaggaggtgtaaaaatagcacaagaggaagtaataagagagaaaaaggaaagatactaaaagaaaaaatattgagatgcatagagtaaacagtacagatgctacagaagggaaagatctagttttgtattcactcacctgggagcttaaaacatccacacaagtgctgggcatggtgactcacgcctgtaatcccagcactttgggaggtggaggcgggtggatcacgaggtcaagagatcaagaccatcctggccaacatggcgaaaccccaactctactaaaaatacaaaaattagctgggcatagtggtgcgtgcctatagtcccagctactcaagaggctgaggcagaagaatcgcttgagcctgggaggcggagtttgcagtgagcagagatcacgccactgcactccagcctggcgacagagcgagactctgtctcagaaaaaaaaaaaaaaaaaaaaaaaatccacacaagcgtacatgctaatgtgcacacacatacacagagagatatattcctaaaccctaacccacaggtaatttgccctgaagataatgaaaattaagcttcagggcccattacttagataaacctttaaattacaagggcctgggtcctaggaatgtgtttacatggtaatacatctttgtaagatctataaaagcaagacgcttttacgttccttttctcaaagagagacctcaaattatataaaccttggaccctgaaaaactcctgaatgttcctgaaccaacccaaaatattctgattcagtaggattgggagcgaatgttgcgtgtatatttttttgtttttttaatgttaccaagtgatttggatgcacaaccaggtttggaaattactgaaaaaggactataggctgattagtttaaagtgtccctgatgtctatgtggtatttctggagctttgccaccgttgattgggtcatataccatataacactatgtagtttgggaaaagtggacaatgggtaacattcatttgcacagtgcggtgatggtcacatccccccgtgttgagtaattagctatccatctgtatgtactggctgtagcaatatagttcttttcaacaagaaataaagagaattcagacacaacattcacagttgtaaatatcaagaaaacagaataaattcattaaacaaaaatccaattttggaagcaagatatatctgccaacagtgtaactgtccaatgggttccttttgtttgctgcccagataaaggtgatttatcaagatgggaactgcaatagagaaagaatttaattcatgcagagccagccaaatgggagaccggggttttgttattactgaaatcagcctcccccaaaattctaaggctaagatttttcaaggataatttggcaggcagaggaatggttgctgctgattggttgggatgcaatcatagcggtgtggaaaatggtccttgtgcatgttaagtctgcttctgggtggagccacaggacttgttgatgggtccaggtagagccaccagttgaaatgtaagaatctgaaaagacatctcaaaaggccaatcagattctatgatagtgctgttatctgcaggagtaattggcgatgttgcaaatcttgtgacctccggaataacagttggtaattgtttacatctacaccttagcagaattcaggctcctctcatcctcctaacctttcattggtggtcttttattagttttacaaaggcagtttagttttggagaagggctattatcatttaaactataaactaaatttctgccaaagatagcttggcccaagctcaggaattattaagggcagtctggaaggtaaaggcaagatgggggttgattatttcagatctctttcactgtcataattttctcactattataatttttgtcaaggcagttttaatagtgcagcatagacttgaaataaataaggagaaaccaggtggggcatagtggctcatgcctataatctcagcactttgggaggctgaggcaggtggatcacctgaggttaggagttcgagaccagcttggccaacatggcaaaaccccttctctaataaaaatacaaaatcttagccaggcgtagtggcatgcacctgtagtcccagctactcgggaggctgagacatgagaatcacttgaaccagggagatggaggctgcagtgagccgagatcataccactgcactccagcctgggcaacagagtgagaccctgtctcaaaaaaaaaaaaaaaaaagaaacaaataaacaaacaaacaagtaaggagaaacctgatggttagaaataaggaaatgtttaatggcctggaggttcaatgaggtagaagtaaaaagcattgcaatgagatacttgagcaatacacttgcaagaataggagacagtggttaaagagtgaagtgtttgaacatgtgactttagagacggtacagtcttaggtgttgtcgaggttgaggctgtgcctagggaaggaggtagctcaagtctagtggaggaaaatgtcattggagagctgaggatctgggctgtggtattggttgtgccatggatggtgaagtcccgtaagactatgagaagtgcttacagggaaaggaagatcaggaactaggtgccaaagccaatcttgcatgaggagttgagaggtcactacaatgaggacagtgagatggtttatctcagtgtcacaagcttcaaagaagcagagttattttatttcttctttgtgtgtgtgtgtgtgtgtgttttacaagagggcagatgaataaacatatataagaggcactcattataaaggagaagattgcccctgccttccaaccctgaagtatgtgctgtgtggagaataaatattgtcatcttgagagatctgcaggggaagtgatgtcctagggaggcagtcgggctaatgacaaagcaaggaggtaggagaaaagtttgaacaggaaactggaagattgaggggagtttggtgatggtgaagacaggaatcccagagatggcaaggaagcatttgggatgaaaatcaaggttgggtcaggagagaacagtttaggtgaactgtgtaggagatagatgacagacagtaagaggggcttacatgccaaatgtaaggaaatgtgagccatggtgatttgtcctgataggattgtggaggtaggtgggcagttagttagttctctactgcacattccttttacccatgataaactgatagcaactgcagtgagtgcagccttggttggcagcaatgagcaaataaatcttgcggtcatctgtaatggaggcgtaggctagggaagggttgggtagtggtcctttgaccatcccttggacccagggatgctgctttcaatggcattcactggtacttccctcatgtctcatggcaggcaaacggttcttcagcactgggtcctctctccagggttttgtgatggttttataatgctcaccaactcgatctagttctaccttttgagggccacaaaacagtctaataaccactcttttccttaccacccatcaaatggctgttaatatatctccatgacctttcctattccaaatcttcttttggctgaatgtacattaaatatttttttttattgaggtgaagttcacacaacataaaacaaccatcttaaagtgtacaatccagtgacgtttatcgcattgtataaccaccatctctgatatggtttggatccgtgttctcactcaaatctcatgtcaaattgtaatccccagtgttggaggtggggcctggtgggaggtgatttgatcatgagggtggggtttctcatgaatgatttagtaccatcctcttggtactgtcttcatgatagtgaatgagttctcacaagatctggctgtttaaaagtgactgtcacctccccacatccctctcttgctcctgcttttgctatgtgatatgcctgctcccctttcaccttctgccatgattgtaagcttcctgaggccttaccagaagctgagcagatatcggcaccatgcttcctgtaaagcttgcagaagtgtaagccaattaaacatcttttctttataaattaccaagtctcaggtaattctttataacaatgcaagaatggcctaacaaaatgtctatctagttccaaaatatttttatcagaagaaaactctgtaccctataagcagttagtccccatttcttcctcagcccctgggaacctctaatctactttctgtctctatggatttacctcttctatatgtttcatataaatggaatcagacaacatgtaaccttttgtatctggcttcttttggaacaggaattaaaagaaattaaataatgtgtaagcggaaactcagttgtatgtaacaaaacccaactccccctgagaaagagaaagagctggagccctttaaaaattaactgcctgtttttctgtggctagtgagacttacctctcctcctttcccaggcattgtgaagaccctgtttctctagctgtgcagctgcaaggtcactagacagataaactcaagtcgcaaaacatgtttcttcttgaaaagtaagaaatgatgtaatgcatgtctcaattaattgaataactgtctttatttctcacttctgtagtatgcttccccctgcacagatacccctctctcccaccccacaaaatgcttaaaaggtaacttaactctttgttcagggctcagtcctttggatgttaatctgacttggccagtgcacctaaataataaatatcctcctgaaccccatcggtctctctgatttcttaaaaaatcccgcaatatttccactaccaaaatttgttgacacattggatatgacttgtgaaaaaaaagagaggtgtctcagttaactccaaaagttttggtctgagtaactggaaggatggagttataatccactgagatggaaaggctgtgggaagagccctacagattggaggagaaattcagaagttcagtttgggatatgtaaaatatgagaggcttattgaacaactaaatttgtttggggatggagatgttgagtaggcatttggctacaggagaatggttctggttgtacagaatttagaattcgttcgcatttaaatggtattcaaagtcaagagtgtgaattggaccaccaagttagtgaggttagacacagaagagcaaagcggtgatctctggagtactccaagggtttggaggttggggagatgagggagaatcaacacatgatacagaagaaatagccagtgaagtaggaggaaaaccaggagctccctggtgaagtaagatgaggatggagaataggctgtttgtgttagtgaagtgtaggaccttggtgagagcagtctcagggaattggtgtggctgaaagcctgattggacaagcttcaagacagaattacagcctgagcaacatagtgagatcctgtctctacaaaaataaaaaataaaaaaattagtcgagggttggggcatgtgcctgtagtcttagctacatgggaggctgagggagaaggggcactagaccctaggattccttgagtgcaatgagctatgatcgcaccactgcactctagcctgagtgacagagcagcattcccatctcttagagaaagagagagagagattgagagaattagaggagaggacttagaaaaaagtaagtctagatacttctttcagggtatagtgggagcactggcactttcacaagtctccctggctccacgtttttccccattttaccatgtcttccaagttcctgccataagttcagcttaatgatcaagagcatggatttggaactgattggcctctgttcaaattcccaaccatgtctcttactagttatgtgactaaggcaactttctttttttaaactttttttaaattatactttaatttctgggatacatgagcagaacgtgcaggtttgttacataggtatacatgtgccatggtggtttgctgcattcatcaacctgtcatctacattaggtatttctcctaatgctgttcctcccctagccccacatcccctgacatgccccagtgtgtgatgttcccctccctgtgtccatgtgttctcattgttcaactcccacttatgagtgagaatgggtaatgtttggttttctgttccagtgttagtttgctgagaatgacggtttccagcttcatccatgtccctgcaaaggacatgaactcatccttttttatggctgtatagtattccatgatgtatatgtgccacatcatctttatccagtttatcattggtgggcatttgggttggttccaactctttgctgttgtgaatagtgcctcaataaacataagtgtgcatgtgtctttatcgtagaatgatttataatcctttgggtatatacccagtaatgggattgctgggtcaaatggtttttctagttatagatccttgagaaatcgccacattgtcttccacaatgattgaactaatttacacttccaccaacactgtaaaaagcattcttatttctccacatcctctccagcatctgttgtttcctgactttttaataatcgccattctaactggcatgagatggcatctcattgtggttttgatttgcatttctctaatgaccagtgatgatgagctttttttcatatgtttgttgactgcataaacttcttcttttgagaagcatctgttcatatccttcactcactttttgatggtgttgtttgttttttcttgtaaatttgtttaagtttcttgtagattttggatattagccctttgtcaggtgaatagattgcaaaaattttctcccattctgtaggtttcctgttcactttgatgatagtttttttttttctactgtgcagaagctctttagtttaattagatcccatttgtcaattttggcttttgttgctgttgcttttggtgttttagtcatgaagtctttgcccatacctacgtcctgaatggtattgcctaggttttctcctagaatttttatggttttaggtcttccatttaagtctttaatccatcttgagttaatttttatataaggtgtaaggaagggatccagtttcagttttctgcatatggctagccagttttcccaacatcatttattaaatggggaatcctttcccaattgcttctttttgtcagctttgtcaaagatcagatggttgtagatgtgtggtgttatttctgatgcctctgttctgttccgttggtccatatatctgtttttgtaccagcaccatgctgttttggttactatagccttgtagtatagtttgaagtcaggtagcatgatgcctccagctttgttctttttgcttaggattgtcttggctatacaagctcttttttggttccatatgaaatttaaagtagtttttttctaattctgtgaaaaaagtcagtagtagcttgatggggatagcactgaatctataaattaccttgggcagtatggtcattttcatgatattgattcttcctacccatgagcatggaatgtttttccattcatttgtgtcctctcttatttccttgagcagtggtttgtagttctccttgaataggtccttcacattccttgtaagttggattcctaggtattttattctctttgtagcaatcgtgaatgggagttcactcatgatttggctctctgtttgtctattattgctgtataggaattcttgtgattttttcacattgattttgtaacctgagactttgctgaagttgctgatcagtttaaggagattttgggctgagacaatgggattttctaaatatacaatcatgtcatctgcaaacagacacaatttgacttcctctcttctatttgaatacactttatttctttctcttgcctgattgccctggccagaacttccaatactatgttgaacaggagtggtgagagaggcatacttgtcttgtgccagtttttaaagggaacgctttcagtttttgcccattcagtatgctattggctgtgggtttgtcataaatagctcttattattttgagatacgttccatcaatacctagtttattgagagtttttagcatgaaggggtgttgaattttatccaaggccttttctgcatctattgagataatcacgtggtttttgtgattggttctgtttacgtaatggattctgtttattgatttgtgtatgttgaaccagccttgcattccagggatgaagccaacttgattgtggttgataagctttttgatgtgctgctggattcagtttgccgtattttattgagtattttcgcaatgatgttcatcagggatattggcctgaaattttctttttttgttgtgtctctgccaggttttagtatcaggatgatgctggcctcataaaatgagtgagggaggagttcctctttttctattctctggaatagtttcagaaggaatggtaccagcacctctttgtacctctggtagaatttggctgtgaatccatctggtcctgggctttttttagttggtaggctattaattgctgccttaatttcagaacttgttattagtctattcagggatttgacttcttcctggtttagtcttgggagggtgtatgtgtccaggaatttatccatttcttctagattttctagtttatttgtgtaaagatgtttatagtaatctctgatggtagtttgtatttctacgggatcagtggtaatatcccctttaccattttttattgtgtctattgattcttctttcttattagtctagctagtggtccatctattttgttaatcttttcaaaatgcagctcctggatttattgattttttgaaggctttttcgtgtctctacctcctatggttctgctctgatcttagttatttcttgtctttcgctagtttttgaatttgtttcttaacctctttgagactctttagaatggggataataatcatatctatagcagagagctgttataaagattaaacaatataataaatatggggcgctgagcttcagagtttttgttgttgttattattattttcctaaaaatgcaaatctgatttgcatttgactcattgactcacatcagtgggtcttcctttttattgtccttcatcatatgggtcctaatttcacatgcagtcttataaaaccatctcattttatagtccaagaatattaaaggtacttgtaggctcccaaacctacacggtgaaaagctagagagcatgggctctcttcaggggttaacttcaggaagtgccactaacaaggacgtccactaggtggtgagcaaggaaagacggaggtgaaggaaccgaaacgagtcaagtccactgcttagctctactgaagttttgcaaacatcataaatatgtctgaaatgcagttttgatttgtagtatttgcaatttccaagggccatttaccacaggtagccaagagttagtttagcatttatgaaaaagataggggagggtggtggaaaagaaggaggaggaggagagagagaaggaggaagaggagaacaagaaccaaacaaaaacaagaacaagaacaagtagaagaagaggagcaggaggaaaaagaagaggaagaagaacagcaacaacaatgagtgaaggaggaggagggtaaggaaagatgcataggagaatggaaggaaggatagaaaggagggaaggaagagagaatctagtcacattactttctgatcagcagttcatttttgtctcagtgggaggcaatagaggccagtctaggaaaggggtggggaaagaggaaagagaagtgcaggaggaaggggagggaaaaggggaggaggaggaggatgtgagactgggttagagaaatgaaagaaagcaaggctttctgttgacattcagtgcagtctacctgcagcacagcacactccctttgggcaaggacctgagacccttgtgctaagtcaagaggctcaatgggctgcagaagaactagagaaggaccaagcaaagccatggtgagcctttcagcctaaaagacgtttagatgctcagatagaaactcttggggttgtagaggcaggtggcaaggataggaatcaccccatttcaattctggttttaaataatatagaaactaaacattttctcagaccctcaaaaaaagtgatcctgaaatctttcttctcagatatgctgatttcctcttcttgactttgtctctggggagactcttgaagaaatactattgaaatcagatcttttgcaataaacactgtgtctacctgagaagtgatatgctttggaagatagaatttttttaaaattatactttaagttctagggtacatgtgcacaacatacaggtttgtcacacatgtatacatgtgccatgttggtgtgctgcacccattaactcgtcatttacattaagtatattttaaggtgtgcaggaaatttgtgactttgtcatttcagttgctcaaaaaggtatttctttttattaaaaaaagaaatacttttctttcctggtgtctggctatctaattttttttttttttaggtatttgaggcattgacccattatgatcaagagtgaggctataacattaaatataagcatcaatagttaattaagcagcaacaatactttaaaaaatatacatagtaaatattaaatagttttatctaatagctcagcagaaaagcaggtataaaaattaccaaaccatagaaaaaattcagggcagtaccgattagcaacttgagactaaagcgtaaaaataaaatagaacaaaacaaaactgtgcatcagttctgatgtaaatttgaagtaatttttcatctatgtctgagaaacctgttacctcagacagggttagtagacatatgtgttttattctgattattaagaaagttgtaagcaccacctcaaaggctataaatgtgtggtttaagagtatacatctaaatataattttgtatttcatttgcagatatttccatggaaatgtcagagcacccagagggacttatggaacatcttcaagttgtgggggtggacaatgctctgttgtggtatgttatgatatttatatatcgctaagtctattttacttatattcatttttcttaaatatccactagttatacatagtctaagggaaaattatttcacagagctgttaattctatcccttctgtaaacatctcttttcttcttacctttagttcttccccagaaactcctgaacactatttttaacctataatagcccatgctgtagagttcaaatcccaataaccccacaaaatccctcaattataaaggaataatgttaattaagaaatctctgttaaggtacttacaatctgtaccaaatatttagcacctcattttctattttttattcatagttcagtgtacattaatgtcatttctacaattacaatacgagcttattaagggacgggggtttatcattttttggtccttctcccattgttgtgacaaattttatatctgattcttgaagactctccagcaatagctttgaacttggtttttcatttcctaagtaaactaatgtcttctttctccctagcctggattttcagctctagccaagcaaacatgctaactctcccgttcacacattccttatgccatgtctgcactgtgtcacatagaaacttagtgctcttttcatacaacaggtattttctgagtccctacaatgtgtgaaatttatgctaggcactaaggatacagcagtggacacaacagttttttccctcttagaacttgcattctagtggaatgctcattcaaaactctgttcaaaatgtttattttatgatgctctttaccatcaattatatctgtttctttactgtattaaatagtgattcatgtagatcataccatgcttagaatgccatatattattatgaagtcattgtgtaattatgtgtttaattagatatcttcaaagccctcatatttgatgggtccatatgtttattaaacatcatcagttgagtctctttgtgtatagaacatgatctaatgaatttcataatcctataccatttggctttgtaaattgttctttttaaaaattatacagttagatatataagagttgagtggtatattgggcttttccagaagcagttcttcctatggtaaaataaaatgttttttatgtaaaagaggttacttaaaagtatgtcactgttcttcctgtccttattatgcttctcccataggtacatatgtgttggccttcaagaaatgattccaggattaaaaagtatacgtaaattgtatagttatatgatattacacggtaattagttgtaaatcattaacagctacaaagaaaaagaaatatgaatgtctaaaatatgttggttaaatttcacctgaaataattttgagaaaaaaattaataagaaaataaacctagaaaaccactaaatttgtttcaaatagaaccttagataaaagcatcttatattcaagccagaaggtctaggttctacttcaaatctgcaaacaactattctgtgatcctgagatggtcacatacactcttaggctctgtttcctcatctctaagtgtctagctcagcctggagtagtgctaggttctttttagctgtaacattatgtaagtctgcataggtcacactgatgtcttgcagatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacaggtagggagtgacaagacggctatgctgcctcagactcaggaagggccacggttaagagaatactcagatttaccccatggaaaggtggggggatgagaacagcttctggttcattctaaaatacatctagccctctatataatcttgcatcgtgtcactcctaagaatttttggtgtgtaagatttgtccctgtgcacaaaagctatacccctaaatcaagttacatcaaaatgatagatctacgtaggaagtacagaggaagagctagacaatcagtgcctttgataataaggcaggggaggagaagctgacagctggggccagttggaaacttaggctcacatcacctcagttttcacattgtgaagtagagagtgtggtgctgcgtgcttccttcttggtctaaccttatataattttatataaaaattgcactatctttggtgtatgaatatttctgtaaaatcttctacaattccaaaacagccagcattttccaagtgatgttttaataatgaaccatagttaatttggtctcttataaattggactctaccgttttagcaaatttggactttttaatctttgatttctataaagaaagggattgccaagaaataattgcatgcagaaatgattgaggtcaggtcatcatttaaccttctcactcattaaaaacaagtaatttcaagagtttcaaggtatgccactaagtttcctataagtgttacagaatattagtattggtaatttcattccaaaagcaaataaatgcctatgactatatgcttagtgtattttatacgtaaaaattttagcatatgatttttatgctatgaatttacaaataaacctttcctgattatttaaatcatctcagacaaaaggttatctatgtctaaagaaatgactttgagtactaaaatgtaatcacattaaaatattttttttctgacctccttaaagcttcttgccagccctggtcatgcagtggccatggagaatgtgtagaaatcatcaataattacacctgcaactgtgatgtggggtactatgggccccagtgtcagtttggtaagtctctttcctttctttgcttcttcttaggtaaagtcacaggaatcattatagcttatcatgaagctggttggaacaaaatgatactagccactctgagaaatgggaagttttgatcagaaagctctgctttcacaatattgttacctttccgtaaagatttcataagtcagcatgaagtttcgactcacttctcaacaagtctttttgagtaccacaagaagcacagtgttgggataaaagctgtcagggttaccataaggaattagcatggtagattcccgctctcaagaagctcacgatctaatgagcttgttagattaattagaactctaaggtctggaagaaactatgccatttatcattaggaggctgagttacccagaaagtatcttgctttttccttctagtagttcctttccttcttgcagttctccacacttaacacatgtgctctgtagcacactgactttgctggtggccttctctctcattttgcacatggccaaaaaacatgtcatctttaagacattgttcaaagacagtttcttctaggaagctttcttagttctgatagctccacatatttcttcctcatttctcccacttatgttgaagtcatctgttcacttgtccgtctcctctggtactgaaaacttcttgagatcagtaagtgtcctatttatcattgcatctttgggatccacaaaatgcctgtatatatgaggcacttgcttgtgagcctgaattgaattggacaatttaattttttaaaaaagcaatgtttgtaaacaataaagaattaaaaccaaaatacatttaaatgtcaaccaactgaaatagatctatagatctaactcatttcacttgatccctgggccatgactccttcctaatactttaccctcaccccatttttgaactctattttttaacccttatgttattggtatgcctattttactcatttttaattattggtatgcctatttcactcatttttaacattttacttttctttgtcttggtttctctcatatcactcttttctcattctttctacctgtgatcatttctcctgagatccttcatgagcacttatccaggaccataaactactataatttctcagcttttgtcttttgtatattgctcttctgactctaatctacatgtatcctttggtcaaacttactgacttttgcggactcacaaatctatgtgatctttggactgataagcctatctccagctctgaactcaaatatgctaaggatgtcctttgggatgtttaaaagactataaaaccaattgttcccagtcagcttttctcttcgtatttcttatctcagtatgtggaatcaccatttacatgggcaccctggtatgagactctcttaactcccccaacatttatgcagggtaacattctaccaatttttacaacttagtgtttttctaatttgtcttccacttgtcaactctactaccattgccgtcattatctttcttctagattcttgcaatagtttattagatgagttccacaattttaaattagctcccctcaaatacattattcatactacagggagactgatcaattaaaagcaattaaaacacatcacacatacatgacaatccacccattaatttctacctaccattttgtcctacagggtgaaatctaagctcttcaagccccagagtaatgcttgatatataatagatactctttaaatcaatgaaaaaagataacattttctcttagttcccatgtttctccctaatctcatctcatatagtttccaaatacaaaaattcttctgattccttgagtccattcttccttgaagtctctagagcaaggtagcaataatggcttaaatttgacagatgaggaataagacatgaaagttgtactgtttactaaatggcatggcagggtctaaaatgtgaaaactttgatttccaagtcttaaatttacctattgtaccaccaatcagaacagggaaatagatacagtttctggagagggttgtcaaaatcaaaagagttaaaattctggaactgagctagaatagaagacagaattgaggtcaaaatgcttcctagacttttatattctctccttgcaaagaaggcttattatggagacccactctttctctgaacatcttgctcccaatactctagtagactcaggggctctgatgtgatagttatttcccgactaagctggtcattcccagttacacctatttggctttaaggattctcactacagataatgctgaagataataatatgaagactagctaatgtttacttagaatttctgatgagtcaggctttgttctaaggtccttgacttatgctaattgaattacatttagtttccatatcaatttgataaagataacacaatttcattattcctcttatatagatgaagaaactgaagttggagggttcaagtaaccttgtttaaaggcacatggttatcaagtggcagggctaggattcaaatccaggcgtcagttcctcttaactcttccccatactgtttctttccctattgaagtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaaggtgagtaacttcagactagaggttttgtcatgcaatcctgggcttacagtcagaacattcagtagaagtttgctgagaagtcaaacttaggagcctaatttaacctaactttgtttaacctactgtgatgtttctcaaaggacttattctaactaaatttttttgaaaaacctcccaaacaaaaagtaaaaaccaaatacccctgaagccatctcccagtgtgtaacatgacttatagcaatacagcatggttatactgtgttttttatttttctcattgccattgcataaataatgtcttgttgaacctcagttacattttggttcttctcctctcaataacacctgttttatgtggtgtcctacttaataccaaccagtttccttcccagggtagtggaggtctttcttggttgttttatttggcttattcttaaaatcacttttacttttcctcatgcataaacttttaggagaataacaactgaaaaacaaaaacacaatctcttgatcttttcaagtttgaaataaggtaggtttttttttttttttcatttttaactgccaaccttatctccatatgggagaaaaccaatgtcatctgaacttacgaagttttggttaacttttctacaagtatgctcctgatgcattagtttaagtagtttaattcttagaagtgctatcaaaatcccttattgaaattataaaactgtcaacccacctactggaatttacggaagttggacttgcttcagtgaattgggatgtttttcaaaatgcttgggtagatatcagaacagatgaaacggcagagattctctgagaatatcccataagagcccttgatgcagaggccatatggcatggtacttccagcagaaggggagggtcaccttagctagggcagcagcctggagtagctactcctctccccacagctttcaatgcttccttgccttcatctctcattcaccacccaccatcattctcaagaaaataaagcctggaagcaatatcacaagtaatgtagtcaggcagctttggctaaaaatcctttgctcaagggagggtctctactcagaaatactgttttgtcttttttttttttttctttttcattgaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaagtgagtaagtttgtcctggaaaactgaaatcttaacgatggagctgatggatgagcagatatgaggaaagacatacataaacatttacatgttgttttgctaagaatatgtggcctagaaataaatttgtatgcttaactcactgtaaaatctttggctggtctttcctcctcctttaatgacaatcatttcctttttttgttctcacctcttgccatcttaactcctaaaatctgaactcactgatttactttttacccattcttctattccactacaatctaacatctctgttagcccattgaaatgcctgtaaaaggtcactaatgaccacctacttccccaaataatggatactcctgaatcatcactaagctaatgcctccaaaatctatctgtatatgagaagaatcatgtcttgttcatctttgtataccctccacctgacacagtgcctggcaataggtgctaaagcaaatgcatgttaagctagcatgtgaaagaatagctacctgtgtctgctcctgagactatctgcatggatgacaaaagtctttaaatggtaggatctacagaagctgtcagaaatgctgatctctgtgtgctgcgtgcccagggccagggagtagagtggatgagcagagagaggcagggaggcctttagcagaggactgtgtattaggcctatcagagacatttccctttaaggcctagctagtgttcatttcctcctcatcttcatcaagccaacaggtaccttctgtctggagctcctgggaacttgagccttctctcaatcatatatttgggtgtggggatcaaatcaccttgaaaaggttcatcaaagtaatgggaagaactaaggatagaatcagaccctctgccaatatgtaaaaaagtagattccttcaaatgttagtatcaggagacagatttttttttataccagtattttcaaatagaggctcccaaatgaacttagtttacacttacaagagtatctctaaacatgcccttttacttattcgtgaaggaagtagagggaagtggtaactactgcattggaaagaaattagtgcaggtccttggcatgtaaaaatcaagtgcttatttttgcacaactgctttaaagtaaaagcattaatgatttcctttgactggtgaattatccagttcagatcattggcttttatttttcctgaagttgtattaggcttttagctcttctctgtgtttcagagttccagtcattgaacaagtccatggagctaaatacaacgatgaccattcttgccaacatttttaggtgcattttcaggaactctatgaaccacaaatctgggcattgagattctgtaggcattagactagcaaggctggtccagtctttgcctatgctgtagactcatcaggggccttcccatgccagtttcctcatctgtcaaatggcatcaaatgggctactactgggagatgtaaggaggaaaaaagtcaaatatcatgagatagactaaggaaataatgctggtggtctcatgctatgtgccttactgatttctctttcagaattggacaaaagtttctcaatgattaaggagggtgattataaccccctcttcattccagtggcagtcatggttactgcattctctgggttggcatttatcatttggctggcaaggagattaaaaaaaggtatgtgagtttaacttcacatgaaaagaacacaactttaaagtgaaaaagaaaaaaaaaagaaacccacaggaaattaaatgtgatagattcaacacaagcaggatgccaagctttacattctagagccatcagtccctggagacatgtaaatcagcccaggacacaccttcattaaaacaggttggctgattttcgcttttcatctgataaacttttaaaaatgtctattaccttcaaggcagcttgctaggctgataacaactaagtgagatattctaatggttctttgctcttatgtaattctttaatacttttttttttttgagacagagcctcactctgtcaccaggctagagtgcagtggtgcaatttcagctcactgcaacctccgccttctgggttcaagctattctcccacctcagcctcccaagtagctgggactacaggagcgtgccaccatgcccagctaattttttgtatttttagtagacacggggtttcactgtgttagccagagtggtctcgatctcctgacctcgtgatctgcctgccttggcctcccaaagggcttggattacaggtgtgagccaccacgcctggcctgctcttaattaattctgaaaaaatgacacactatctctgtcctctaagagcctacatgccttggatttcaatgctacaattccactaggaagtgggtctaatgtccactaaggtttcaaggcactgctcccaaatacctgacctcttcaagagtcacctggttcccaacacatgggcattgcattaaccctgggagaaattcccatgtattctcccaagtatctattcaccaaggccacagctctaaccaaatgcaccatatatgctttccaaccatccgtcactggagaggaaaagagaaggaggactgccttgagaagttaacatctgctgcccagattatcactccctttaccttaaggcatgagtgtgtctcagctttaaagtgtgagcaacccactagcctgcagcaggccttgggtgtatggtgccacatttggccaaactcacctggaagaaccattcaaggctgtaacattcatggacattgggcagcttttaagatatacctgttttggccaggtgtggtggctcatgcctgtaatcccagcactttgggaggccgaggcgggcggatcatgagctcagcagttcaagaccagcctggccaacatggtgaaaccctgtctctactaaaaatacaaaaattagccaggcgtggtggcgggcacctgtaatcccagctactcgggaggctgagacagaagaatcacttgaacccgggaggcggaggttgcagtgagctgagaccgcaccattgcactccagcctggtgacagagtgagactctgtctcaaaaaaaaaaaaaaaaaagatatacctgtttcaagttcagggatgatctcgaaacaattgctaaccaactgctctgtgttgcctttctgtgggctcagttgattgtcattttaattttccttccatcaaattagttagtacgtattctgttcactgaatatggtatgtaaaggttgccccctgtccatttacactggcaattacaaaaatattatttatcagtccctaattgcgtgccactctgatcttatctttcatttaaatttgagaatagtgggtgctaggtaagttttctaaccaatccagaaagacaaagtgtgtgaggggggtggggattgttgatatgcaagaacttcattagctatgtataacctgagagcactgagcagttaaaatgtctctgcccttgctattagaaattctgtgctgattgaatctcactatcttatagtattatacagtactaagtactatacagtactaagtataagtatcaagtactgcattaaggcaaaagaagaatgacagttttctccaaccactgattattctttccattgagacttcaaatcttgaccccggttgtcctgtctttcttcctaccttgggcgatgatggcagaactgacggatagagaacagggtgggttattacacactgccccctgggataaggtggctattgtctaaataattttaaggactttggggctgtaagtcaccttaataaggaagctatttatttccgaattctaaaatcttttaataagtgtttgtagaatcaaaagaatagaatcaaactcatttgcatgtagtgaggggttagctggctaaggctgttttataagcaagggtaaaaaaattagaggggttgtttttaaattttttaccttggagtcatttctgtacaagatctcaaaccgataacttgaaaactgctgtgggaatcagtgtggggcaaacaggaaacagataacgggcagttaggctagttacagttatgccaacaaagaaaacagaagccccaaaagatcactggcttggtaggaagcttagggtatctttaagataacattaaatagtcttcatctgtgggccaggcaccttggctgtcacctctaatcccagcacttttggaggctgaggcaggaggattacttgagcccacgagttcaagaccagcctgggcaacatggcgaaaccacatctctacaaaaatacaaaaaattagtcaggcatggtagcatgcacatgtagtcccagctacccaggagactgaggtgggaggatcacttgaacccaggaggtcaaggctgcagtaagccatgacagcaccactgcactccacaacagagtgaggccctgtctcaaaaaaaaaaaaaaaaaaagtcttcatttataaaacaacatcttccattttcaccaacttacaaatgattctgctttccaaagattttagttgtaggttggtcctttaaaacatgaagagtatttttcctatggaggcaatggtagaaataatggctacattcccaggctaaatctaagacaaaatatagttaatggcatttacaaggataaaagtaaaaagtcataaatctctatgtgtgtgtttaggtgtgtgtgtgtgtctatgtgtgtgtgtatatgtatatatatacacagagagagagagagagagagagagaatttataggctttttgggttctaatagttagaaaaagggcacaggtaactatttagagcatggtagccaatgaagtgactagagccttcacccctattcttctgtcctcagatgaatcttctgactctagcactttgtcccctgccctagtagtcttagtatggagactttccctcctttcttttaggaaaggaataaggaacagttccagaaacatgtgtccttgtgcatgggctcatctagacacattttgtgcaccaggcattatcattttctgattagtcactaccattggccctgtttggtaaataaggaaaccagggcaatgatgttttaggccaaatctcaaaaataccatatcagcaggacccagagtcagagattagactccagtccagatacatcttctaaaatcactggtcttcagatttgtgaactggttttttcctcggttggaagaatttcccaccagaaccaacacacagggttagaccagggcatgaaactgaacacatgcccccttagttcctttttcttcaaaatgaaactctctcagtaggaacagattcttactcatctattgctgttaggttcatcatccctaaaaaaaatatttatgtgaagctaaccagaatctgaaattaattcagatttgattccccctgctcaagtgcacttggtcatcagcaggctgaattttagaagaaaagatttcaaatagtagtctttaatactttaaaggattaaaacagtaatgcaacactgtctacgtgctaggacctgaactaaatacttggaaatattttattttatcaacccaatgaggatgatacaattattatgcctctttaacagatgaagaaattgtagtttagaaaagaaagtagctgttcaaatacacactacactacaggtggcaaaatagggctttcacctgggtaggatgattctagaatgccactttacagccactgaaatatattgcctcccaaatgattctttctgctcaaagagttttttttaagttatctacttatttatattctgcttttttcaaaaagaatgtgagaacagtacaaaatgtgttcagtatagcaaattaaaattaattaaaaagtaagaaaaagaagccaatttgggcaacccactcgggtccccttccacgctgtggaagctttgttgtttcgctcttcgcaataataaatgagcttgatgttttattgagtacaaaaaaaaaaaaaagaaagccaaatttaaacttagggtacaaaaatcatttggaaccaaggttgaagttatggcacaaaaatgtatgtcacaaagttttatatacttggtaggagagggtctcagatctagctctgagtttccttacagccagtcaaaggagaaccatgtgatattccttgtgtttgtaagataaaaacacattagttactcagatgaggctgcacaattcctaccaacaagaccaaagtgaaattctcttgtggattctcatagagatgatgctgtgagctgtaatggcacatagttttacagtattagcagctgtccctcaagggaagaatctgcaggtaggatgagatggcagattgggaagggataaacacttgaatggacatattgggtcttgccaccaggcaatttagcaattctgtcttcttgagtagcacggagaatggaatggaacctcaggaggcatctgcatcaacatgtctgttctgtattagtgtctaccactgtttattaagccagttcctcaaatctcctttgacacagatagggtccacctaacaaatacctaatatacttcaaaagacagttttgagagtgggagtcttccttctcccttacttgaaaaactttaaattgtctaatttttgctaatgccttttctctattttctattttcaggcaagaaatccaagagaaggtaagttttattagtggcgaggagtttccacatctgctgattcattctctacttccttaagttacttcctgctctagctagacacattaaccccatagtagtttatttacctggggtcctcatccaaatgaccagataaggtgataaatctactagcttcctttcagagctgtgctttttggtgctagtggagctgaatgaatgaatgaacgaacaagtaatccctattagaaaagggcagtttatgtaaagggagatttttctgattacctcagaattttttctgagggttaaaaacattgtggtgtgttcttcttgttcttaaatatattatttaagaaatattcaattgaacaagcacttattgagaaatgaataaatgcttattcaattgactatttgcattcaattgctctaacaggcattgtccttcagaaatgtgggaaagatagggagcatgaattctacctacagcttccccaaggaggcaagtatttttcagtttggtcttgaagctcaaatttcttctactggagaaatagcacagtgggaggagatgcagacatgtgaaagttgatggcccacctggcagaaatgaagatggaaaaatatttctcagtatctagggtttagtgacttgctctggaattttaggaaggagagtttaagtaaaataaactatgaaaggaggactttggtgacatattcagtacccagctggacaactgagcttcctttaaaatgctagaaatgaagtgagatgatttctgaagggattggatgctggtttgggcaaccatcctaccaatcacaaacttagtatgggccattgcttagaatgcaaaggaaaaagtggggaaaaatgaggcaccagaagccagatcataaactaatgtataagccatgtgatatgggctttatcttgaggtcttttgggatatcactaaaggggtttaaacagtgagtagccttacctctggcatcttataaggtcaccctgcagagcagtatggcaagtgtgggagacaggtgagcctggattcaaagagacttgttttggaggcatttgcagttattagattaaaaccgatggcgcctgtctagggaactagtagtaagaatgggttcatgaaataagaggaggtgatattaactgaatgtgtctgttaattggctaaaagtgagagagaagaatcaaattatcatctttctcacctggaaactggcggatggtagtcctgtttacttctgagaagggaacataaaagaatgagaggttttggaggtaaagatcatgggttcagttttgtactgagctttgggtgtatgcacatcattcactgtggctcattggacctatccaaagcacagaggctatggcaggagaagtggatttgggtccctcacatttcaggaggtaactgccatctcaggagtgggtactatcatccagggagggtgtgagtgctttaagaatggaagaggacctgggagagagtatgggagccagaggaacatcattatctaataagtcacctaagggaaagagaaatgaaaagatgttgccaggcagggagaaggaagaggagaaagagtgtggggtaatgaatgccaaggaaacaaagaaaggggaacggtttcaaacattgccaagagaaccagtaagtatcccctggatgcaacaagggtgtcagtggggagactatttgcagtgcagacatcaagacagaggtcagacggccaagcattgagcattactgaggatgagaaagtagagacagaacaagcagtcatctcttttaaaatgtttggctgtgaaggagaagtggggcaggggtaactggatgaggatgtacgatcagtggaggttctttttattctttttaattactctgtcttctctttactagtgcaaatggagtctagtgaggaaaggcttctttctctgggctggtctccctatgtctgtggcaggaaacccacagatgtgaagatttctttcaaactcgcacctactgagtgaaagtattttctggcacaatctacccagagctgttttctggctaccggaaccacctgttttaattgccactagatggaagcagatcaactagattttttttttttaagatgtccttgaggcacaggaggagagactggctggaagaatattagcaaaaagctaattaccatgctaagcaaattgctatattaagtttaatggttcactgattttttataatcagtcaattaatagttgtttattgaacatttttgtgttggaaactgctaagctttcttgagacagcaagaggagtcagcctggtccctgatttcaggaaaattattacctagctggggagttaagacaggaatatagaaagaaaaaaatcagaaaaatacaaggcagagcatggtaatggccaatgggtgctatatttaagaaggaaaaggtcatttggcttggtggttatagaaaatgttataaagaaggttgcttatgaagaatagataggatttaggtatatggagaaaagcaggaaaggaaggcagtctgtaggaaggaaattgtgtaagcagtggtatggtagtgagactatgaaagcatttttcaggggccactgagcagaactttcttgagcccatggcttattgaggagttgtggagttgaagttggaaaggaaggctggccccaataacataagtcttgaatgcttcaccagatggtctagaaaggcctagcaaagaagaattatttgcccagctctcatttattgaccaaggctgtattaattcataagaatcacagaattctaggtctgaatatgatcttggtggatatcacattcaaactctttttgtagttgaactaattaagtaagttttctataggccttgagcaagtgacagagttagttacaataatcataaacctttatcaaatattaattccatgttgtatactgttatgaatggtttacatgtcttaaatcatgaaatatgcctttaagtctgtgggagaagggtctatgaacatcttcattactgataaagaaacaggcacagagaaataaaatagcctgaggtcacaataaatggcaatgctgagatccatactcatttggatccaggaatcatgctcttaacgcgtatgcttttagaactcaagacccttgactaccagcttagagtggcaagtcccaggcaccctccttttccagtaacgtggttttttttttcacactgaaaccattgtgtgacggcactgaggaagggtggggtagaagtatggtgtgtttttagaacaagtcaaaggtaaaatgaatactatcacactaaacaccatgagcctttttttttttttttaagttcttgggtgaattttcatagtagtttgtgttcatttctattagcttttgaatggtgaatgaatgactccttgggcatttgtggtttcatttcttgctgggttattttgactcttctgcaaaatgactctgtttatcacctcatttggtttctactgtctaaattctggcaggatagaagctacacccaagatacacaggaagatatgatgccaacctcagaggagggcatatgtgaaattttgttttcagaaacatttttttgtctctattttggcaagcacatttgcagctgctgaactgtggtttaccctgacagttcatcatgagaccagctcctcagaatctggttctccctttgaaaggtgctgtgaagacataccatatttcattctctccttgtcctttccaagaataagacagttgtgtcacacaaaaaaagtgtcacttatttctttaaactaaatgtgttaccatctcattaaattatatcccaggatataatttatcacgagtttataaccaccactatttcatgagtttaaattttctccaatttcactttccatttaagcatgccttctaattccttgactttccactgctcaaaatcaatctacagctgggctcggtggctcacgcctgtaatcccagcactttcggaggccgtggcaggtggatcatgaggtcaggagtttgagattagcttggccaatgtggtgaaaccccatctctactaaaaatacaaaaattagctgggtgtgctggcacgtgcctgtattcccagctactcaggaagttgaggcggaagaatcgcttgaacccaggaggccgtggttgcatgagctgcctccgtgccactgcactccggactgggcaacagagtgagactccatctcaaaaataaataaataattaaataaattaaattaaattaaattaaattaaaataaacataaatttaaaaaatcaatctacactgtccttcagactcattagatctggagacaaagaccgtatgcaccacaaaaatttctccaagtggggtctgtgcgccagtggcataagcatcactaaagagcttgttaggggtgcagaatctcaggctccactcagacctactgaatcagagtctgcattttaacaccatctctgagtggtaagcacatgaaaatctgagaagtgctgctactagggtttgcttacatttgttcatcttcagaggttcctaaagcctggcctcttgtctgagatttccagctgaaagcatttccttgctcctcttctcatctctaatgaatatttacctttactactaacactccaagttttgcaatttttaaactcttattatcttttgtttttctttcagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtctttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaactagtttgcctagtttgttattttgaaattatcatatgttttgttttctccccagtgagattacatgctccttcagggcagagtttgtgtcagatccctggagtatctagtgcattacttgacactcaataaatgaatgttcaaataaatcagaaagagcatacagtgcactgctgatataagtttcagcaaaccctctttctctatggcatctgatgacctgggcagatatcacctaatgtcaacagctgaattcttatgagagaatagagccctttcagaagctagctggaaatacctccttgtcccatggccaatatagatttcatacaaatttgcacacattatgagaataattttttggtaatgattacacttttctttctcaaagacatctcagattctgtattatagcaaaagctgttgcaaaagattctccctatagtacactgtaaatcttggatgtgcaaatcacattcatgtggtttagggtacatcccctggaggtgtacagtgcacacgtgcacagacacacatggcaaccctgacaaaaatgtttattccactaacacatcagggccaaggaacccaaatggacactactccttgtaattatgatgtatatagatttaaaaataaagttctatattcaagctctaggattcctatatgatcttaggaattacataatagtaatcccataaatcaagattcataatataaaattctccagaaaccttggtcttaacctccctgagacttacttcctatgcccataaaacaagaatgaaatttgccttgcttaccccacagggttattgtgatggtaccttaagtatgaaactgctttgtgaactgaatctgaaacacagactttttttttttttttcctcactcaaatcttacctttcatgctttcatggtgtaagattctggttcttatcctaaggctggaacagatggagctctgagtccttatcctgagattagaagccaggaagtctttcacttgtgttccaataggaactcagccctcagattttcactgcacagggtcagctctgccccctgcacttctgcttgcgggaggaggaagggcctgggacagggagtcagaggcatcagtgggaaccctgcctctgtctccgtgatgtgaccctggccagttgttactctctctgaacttcagatttatttatgaaatggggatcccattatcttcgtcacatgattgtgctccacattttatgaaataactcctcctatgctttactcagagtaccaagttcatgaaattgtcagagtcccaggaacacagaattattcattccttctgatttgttcacccaagatcaatgtgcctgggctgtattattgtagtttcctacagaaatagttcaccaaattaaaatctaatttttaaaaaattagctgggcatagtagcacatacctgtagtcctagctagtcgggaagctgaggcagaaggattgcttgagctctaatgatttaatgagaatagaaagaagcaagaaagaggcttcttgtccaaattgcactgtggaaaatgaataaatgtattctttagacatctatatttttccccttaaacttcctcccatctgccagttgacttctctgtacagttctttctccaaagttctttgcattgccctctttcaacttcagcaatttgatttttcccttctgttcaaatgtcctattatggacattttatggaaagaaaatctgccatcaccataacagcctacccaccatttatgacaaaggacagggaaattattaggagaaataatgagatctttacttccctttggcctttgtggccttgtctgatccagtgggccccaacattttatgagatatatacagccttccctgcgagactctgaaagggttttagttaaaagtaatataataattatcacgcgtgtcggtgtgaagagaccaccaaacaggctttgtgtgagcaatgaagcttttgaatcacctgggtgcaggtgggctgagtccaaaaatagagtcagcaaagggagatggggtggggctgttttataggatttgggtgggtagtggaaaattacagtcaaagggggtttttcacttgtgggtaggggtgggggtcacaaggtgctcagtgggggagcttctgagccaggggaaggaatttcacaaggttaatccctcagtcaaggtggcgcaggaacaaatcacaatggtggaatatcatcagttaaggcaggaaccagccattttcacttcttttgtgattcttcacttgcttcaggccatgtggatgtatacgtgcaggcttgggctcagaggcctgacatttctatcttcttatattaataagaaaaataaaacgaaatagtggtaaagtgttggggcagtgaaaatttttgggggtggtgtggagagataacgggcgatgtttctcagggctgcttcgagcaggattaggggtggcgtgagaacctagagtgggagagattaagctgaaggaagattttgtggtaaggggtgatattatggggttgttagatgaaactgtagcaggacaagacacagacaaaacccctcagacactgagttaaagaaggaagggctttattcagctgggagcattggcaagactcatgtctcaaaaaccgagctctccgagtgaacaattccttttcctcttaagggcttacaactctaagggggtctgcgtgagagggtcatgactgattgagcaagcagggggagcaagcagggggtacatgactaggggctgcgtgtactggtaattagaggaacagaacaagacagggattttcacagtgcttttccatacaatgtctgtaatctatagataacataactgattaggtcaggggttgatcttaaccaccaggcccagggtgtggcatcaggctgtctgcctgtggatttcatttctgccttttcatttttacttctttctttggaggcagaaattgggcataagacaatatgaggggtggtctcctcccttaaaacatttgtcgtatagaatgattggtgatggcctggatacggttttgtatgaattgagaaactaaatggaagacacaaggtctgcataagagaaggagaaaaacaggtattaaaggattaagaatcgggagaacccaggacatctaattagagtgcccaagggggttcagcataattacttgcttggttggcaaggtttttggctctatccttgagttttttttatgttgtcatataccaggccagattgatttaggtaaaaacaacactcttcatttaaaaatatgcagagtccccttttttagcagtgagtaaattgaggactcggtgattttggaggaaagagaaattgtaaagccagcaattgtttgttaaagaaggattagaaatggctaggagagagtgagtgagattgatagtgtggtggagatagctggggagaggtagagagtggcataagaatgggaacaagaataagagtgaatataaaagtaaagaatagggctttattagggtgaaagtattggagtgtaccttgtcactgaagatcttctatccactttaagagagacttaagggtggcggtttgaggtaaaaccaggagatatcagttatgatggtttggaggaaaagtataaatcagcactgtaaaaaagggcagggcatttacaagtagttgagaatggtgaataggagtatgactagacagaagattgtagggatgacaagtttttggggcacagttcaagttgggctggtgtctggaatgagactggggcctaataaaaaggagcgtccatacagaatcttaaatgggctgtaccttgtagcatttcgaggacaggcccgaattctgagaatggcaagtggtaaaagtactgtccagtcctttttaagttggaggctgagcttggtgaggtgtgtttttaaaagaccattaatcagttctacctttcctaaggattgaggacggtaaggggtatgaaggtttcactgaataccaagagcctgagaaactgcttgcgtgctttgactagtaaaggcttgtccattatcagactgtatagaggtgggaaggccaaaccaaggaattatgtctgacagaagggaagaaatgaccacggtggccttcttaggccctgtgggaaaggcatctacctatccagtgaaagtgtctacccagaccaagaggtactttagtgtcctgatttggggcatgtgagtaaagtcaatttgccagtcctggggttggggagattagctggacatgatcagcagggagagcacgtgtgttttcatgaagaactatgcctggataggtaatggatgaagaagaaatttgggttgactgaggtaatgggggctgtccatgaagccttgcggcagtacagcccaggtaagttgctgaggctgatgggtgtcagggtcagtccaagtgaaagtgaagagaggctgggatgaagggtgcaaatgaatagtaaagaaagcatgttttgagatccagaacagaataagggttatggaggggttttggagggaggtattgaggataggagagtatatgggtttggcaccatggcgtggataggcaagacaatttggttgataaggcacagatcctgaactaacctgtaaggcatgtccagtttttggacaggtaaaatgggggaattgtaaggagagtttacaggctttaaaaggacatgttgtaacaggcaagtgataacaggctttaatccctttaaagcctgttgtgggatgggatactggcgttgacccaggtaagggtgattaggttttaatgggatagtaatgagggtgtgatttgttgccagggagggagtagaggtgtcccatacctgtgggttaaggtagggggatatgagaggaagtggcaaaggagttgccacttttgggttgggaagaagggcagcaatgagatgtggctgtagtccaggaatagtcagggaagcaaataatttggttaaaatgtctcagcctaataagggaactgggcaggtggggataactaaaaagaagtgtataaaagaatgttgtttaaatcggcaccagagttggggagttttaaggggtttagaagcctggccatcaatacccacaacatttatgaagacaagggaaacaggaccttgaagagaaggtaatgtggagtgggtagcctctgcattgattaagaaggggacggacttaccctccactgtaagagttaccaaaagcatctgtgatggtccaggaggcttctgaggcgatcaggcagcatcagtcttcagccactaagccaagaagatctgggaaggagtcagtcagagagccttgggccagagttccaggggctctgggagtgggtgctgggcaagttggacagtccgatttccagtggggtcccacacagatggaacatggcttaggaggaatcccaggctgagggcattccttggcccagtggccagatttctggcacttgaagcaagatcctgatggaggaggtcctgtaggaatgcttgaccactgtggcttaggcattttgaagttcttgtgtactggagatgtggctggggtttctctcacagtggaggcaaggaattgcaactcagaaatatgttgctacttggctgcctctactctattattgtacgctttgaaggcaaggttaattaagtcctgttgtggggtttgagggccggagtctaacttttggagctttttctaatgttgggagtggattgggtaataaaatgcatattgagaataagatgaccttctggcccctctgggtccaaggctgtaaaatgtctaggagttgctgccaaatgagccatggagtgggctaggtattcatatttgatgaaaaaaagcctaaatactaactgagatgggagaggttggataaagaaaaaggagcattaaccttgactatgcctttagctccagccacctctttaagaggaaattgttgggcaggtgggggagggctagtcacagaatgaaactgtaagctggaccaggtgtgaggaggggaggtgatagaaggattatagggtggaggagcggacgctgaggaagaattggagcctgattcagcctggcggggagcgacctgaggaggagcagtctggggaagaggggagaggtcagatgggtcagtagaaaaggaagattggaaagactcagcgacacttggggttgggactgaggggacaggcaggagggaaagaaggaggatttgggatgagttgcattgggaacagagactagggagggaccgacgtgtaaaagaatgcccagatgtcaggcacctcagaccatttgtccattttacgacaagaattatttagatcttgtgggatggagaaattgaaagtgccgttttcaggctatttggaaccattgttgagtttgtattggggtcaagcggtattgcagaagaaagtaaggcatttaggttttaggtcagacgtgagttgaagaggttttaagttcttgagaacacaggctaagggagaaaagggaggaatggagggtggaaggtggcccatagtgaaggaggcaagcccagagaagagagggtggagacatggagagaaggggttggggggtacttgccccccaggagaggtggtgcttgccccccaggagaggtggtgcttgccacccaggcaaagtggtacttgccactaaggtgaaggatccaggcaggcgtccctgcagtgatcagacagctctgaaatgtgggtgaataatcaggcaggcatccctgcagtgattaaacatcaagggaagactgtctttccaagtccatgaccagtgctggagttttgggttcacagatagaacacgtttcctctgtctctaccagaaaaagaaaggaactgaaattaagggaagggagagattgaagcgtggtgccaagattgaaaggagaaagatgttgagggatagtgagagaggctggagaagagagtaaaaagaggccacttacccaatttaaaattggtgagatgttccttgggctggttggtctgaggaccagaggtcataggtggatctttctcatggagcaaagagcaggatgacaggggactgatctcccaagggaggttccccgatctgagttacggcaccaaatgtcacatggtctgtgtgaagagaccaccaaacaggctttgtgtgagcaataaagcttttgaatcacctaggtgcaggcaggttgagtctgaaaagagagtcagcgaagggagataggggtgaggctgttttataggatttgggtgggtagtggaaaattacagtcaaagggggtttttcacttgtgggcaggggtgggggtcacaaggtactcagtcggggagcttctgagccaggggaaggaatttcacaaggttaatccctcagtcaaggtggggcaggaacaaatcacaatggtggaatgtcatcagttaaggcaggaaccggccattttcagttcttttgtgattcttcacttgcttcaggccatctgggtgtatacctgcaggcttgggctcagaggtctgacaataatatttacttgacatcttggtttgaagcttgatctggtagtggtgttttcaataccaattgttttaacactggtagtaaccataatgatgataacagtaagtaatgtgatttcttttaaaagtttttaaatcttggttgagtgctgtggctcatgcctgtaactccaacaattagggaggtaaaaggcaggaggattgcttgaaaccagaagtttgagacgagcctgggcaatacaacaagaccccatccctaattatttttttaaaagtagctgggcagagtagcatatgcctgtagtcctagctactcagggagctgaagcagaaggattgcatgaactcaggactttgaggctgcagtgagctattattgcatccctgcactgcagtctgggtgacagaataagtacctatctctaataataataataataataataataataataaagtttgttaggttaaacttatcttggcatccagttatcttagtaggcatccaaatccctttttaggagaaagctatcttcttttgataagcctctaatatagcaggtgtgaccctacagacgtagtgttggcaggaactcaaacaatagtaatatgtaattaaggcactctgtgttaagaaaacttagaggagttaattttctctgctcccgtgagcacatgagaagaaaaaaaaaaagagagaaggtaatgaaagtagagagagaagaactagaaatgtgagaagctgaagagctctgtggcgggaggggtaggggtggcagaagcagcctggcctctggggactagtatggatttaaacagcatgactcctcctctgcatcacactaacctctgtaacatcccactaggaatacaaacccagacctgtatttaggttgctttgaaggaggagtttaaggtgaaggggctgcttctttagtttgggaaagtggatatgaagaaatagccataaaaggcaaaattgggacaaaatattttggtagaaacaaaatatttagaagaaaatcggtgctatggtgagcatgaaaattaagctctctgagaattttgagaactcttagagagggtttgcggccagtatttttaattcattttatctggattttagagagatggtacctgacatctggtttacattcctcatagcatttaatccccggccatagatggtattgtcctcattttaaattttaagaaactgaagctcagagatattagtttgtctaagttcatatagctagacagtgtctatagagttactgaatgtctgtttaatagataacgaaaggtagtttaaaagagctgtgtgtctaatgccatagagaaaagggaataaaaaattacttagaatagatttggtttcaaacactcttgctgaagtgggtagtccaaaagtaggcagccagttctcaattcacaacaaaatcactcttgaaagcaattttgagagaataggctatgtctcttgatttcagcatcctcggaactgacccctatgtcaggaagaaaatagatcaaaatagttgttcaatgacaaaggacacaggcatgtttagcaaaaagagaggcttaaggcatgggacagttgtcttcaattaaccaattaaacatttgctgaaaatgtacgactgcaagacatactaccaggggctatggacacataagggcagagttcctatccctggggatccagcatctggaaggggagggaaggtaaacaccctgaactgcaagctaaggctgtgtgtgctatggctatgctaagtgtgcaagctcagagatgctgcggctcagaggaggaagagatcacttggcaaagggcaacagaattcagaggcaaaattagatcctagatcaggtttaattagaaaccaggaggagagtctagtatctaagacaaaggtattgaagttagagatgttggacaggttatactgccttggcagagacctggggatgaaaaagagatagagtggctttcaactctaaagcttataaagtttgtactctagtttctgggaaaacttgagcaagagtggaacaggatcacaatggtattctgggaagattaaggtgtcagagggtttaggagtggagataaacggaagcaggggagaccagtcagtgaatgtaattattcaggcgtgatgatgagggtggggccaggaaggttcaagtgtaaaccattgtgaaggctttggtctctgactagttggggtcagggagcgggggggttggctgggaggaggtgtaacaaagtattcagaaaggaaaatataaaacaacagttctggctaaatatgacttatgcaaatgttccatttttcaaagatcttgtaggaaagtccctcctttgttatatttcctctgcatgaacttagctgttta

SEQ ID NO: 1389 - DNA, 2324 bp, Homo sapiens
ctccctttgggcaaggacctgagacccttgtgctaagtcaagaggctcaatgggctgcagaagaactagagaaggaccaagcaaagccatgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaaatcgcccttggtgaaagaaaattcttggaatactaaaaatcatgagatcctttaaatccttccatgaaacgttttgtgtggtggcacctcctacgtcaaacatgaagtgtgtttccttcagtgcatctgggaagatttctacctgaccaacagttccttcagcttccatttcgcccctcatttatccctcaacccccagcccacaggtgtttatacagctcagctttttgtcttttctgaggagaaacaaataagaccataaagggaaaggattcatgtggaatataaagatggctgactttgctctttcttgactcttgttttcagtttcaattcagtgctgtacttgatgacagacacttctaaatgaagtgcaaatttgatacatatgtgaatatggactcagttttcttgcagatcaaatttcacgtcgtcttctgtatactgtggaggtacactcttatagaaagttcaaaaagtctacgctctcctttctttctaactccagtgaagtaatggggtcctgctcaagttgaaagagtcctatttgcactgtagcctcgccgtctgtgaattggaccatcctatttaactggcttcagcctccccaccttcttcagccacctctctttttcagttggctgacttccacacctagcatctcatgagtgccaagcaaaaggagagaagagagaaatagcctgcgctgttttttagtttgggggttttgctgtttccttttatgagacccattcctatttcttatagtcaatgtttcttttatcacgatattattagtaagaaaacatcactgaaatgctagctgcaagtgacatctctttgatgtcatatggaagagttaaaacaggtggagaaattccttgattcacaatgaaatgctctcctttcccctgcccccagaccttttatccacttacctagattctacatattctttaaatttcatctcaggcctccctcaaccccaccacttcttttataactagtcctttactaatccaacccatgatgagctcctcttcctggcttcttactgaaaggttaccctgtaacatgcaattttgcatttgaataaagcctgctttttaagtgttaa

SEQ ID NO: 1390 - DNA, 1119 bp, Homo sapiens
atgatatttccatggaaatgtcagagcacccagagggacttatggaacatcttcaagttgtgggggtggacaatgctctgttgtgatttcctggcacatcatggaaccgactgctggacttaccattattctgaaaaacccatgaactggcaaagggctagaagattctgccgagacaattacacagatttagttgccatacaaaacaaggcggaaattgagtatctggagaagactctgcctttcagtcgttcttactactggataggaatccggaagataggaggaatatggacgtgggtgggaaccaacaaatctcttactgaagaagcagagaactggggagatggtgagcccaacaacaagaagaacaaggaggactgcgtggagatctatatcaagagaaacaaagatgcaggcaaatggaacgatgacgcctgccacaaactaaaggcagccctctgttacacagcttcttgccagccctggtcatgcagtggccatggagaatgtgtagaaatcatcaataattacacctgcaactgtgatgtggggtactatgggccccagtgtcagtttgtgattcagtgtgagcctttggaggccccagagctgggtaccatggactgtactcaccctttgggaaacttcagcttcagctcacagtgtgccttcagctgctctgaaggaacaaacttaactgggattgaagaaaccacctgtggaccatttggaaactggtcatctccagaaccaacctgtcaagtgattcagtgtgagcctctatcagcaccagatttggggatcatgaactgtagccatcccctggccagcttcagctttacctctgcatgtaccttcatctgctcagaaggaactgagttaattgggaagaagaaaaccatttgtgaatcatctggaatctggtcaaatcctagtccaatatgtcaaaaattggacaaaagtttctcaatgattaaggagggtgattataaccccctcttcattccagtggcagtcatggttactgcattctctgggttggcatttatcatttggctggcaaggagattaaaaaaaggcaagaaatccaagagaagtatgaatgacccatattaa

SEQ ID NO: 1391 - DNA, 51281 bp, Mus musculus
  misc_feature (3889)..(5506): "n" at positions 3889 thru 5506 can be any base
  misc_feature (12248)..(15107): "n" at positions 12248 thru 15107 can be any base
  misc_feature (34241)..(34260): "n" at positions 34241 thru 34260 can be any base
  misc_feature (35928)..(35947): "n" at positions 35928 thru 35947 can be any base
actagatttaaaaggctgaatatgacctcacaggcaggcctgaggatgactgatatgtattgaatgtcaactgcgtactatgaacagttcgcgagcctgaataaagcaatgtgtaaaaatagacacagtactggccttcacggaacttatagtctagtgtaaggcgtcagaggctgccacatcatttcacagataagtagagagttgtaactatgataaaggctctaaagaaggtttgaacagagcatgaggtgggagattgtacagagtgtgaactgggggtgtgcacagagtaggaagtggggtttgtacagtctaaagtgggggtgtatacaaagtaggaagtagggggttgtatagagtgttaggtggaactttgaagagactgtgaaggggatggattttctgaatcagactagataggaaagcctccctgaggacaaatctatatggggaggtggttttggggacagaagagaggaacagaaatccaggcagagaacagaaacatttgtcataactccccctttccagggcctgcggcagtctgtgactgggtctaggaataatcaacgtgagtctccagaatgagtccccccaccccccacatgcaatcctaagagattttttattttgagagtctaagccttgtgtcctgaaatacttccaaacacatcctaaccactagctgggtgaccttgaacagatttccctttaagcatcaatggtctcatttgtaaagttggggtgacgtgttccttgaagaatgtgaaggtgacattcaataaagcaagtataaacgtgtgcatgacagccagacacactaacagaagcgagcaggtgggcgtggtgtgtttggctcaggaagattttcaggcacaaggaagatttgcagggcgtagtagggaagcctgacccaaaacatagggacatggtgctttgaatgcaaattgccctcataggctcatgtgtttgcatgcttgggctgtagctggtggactgtttggggaaggattgggaggtatggccttgttggagatgtgtcatttgggtaggctttgaggttacaaaagaacactctgcttccgagttagtggaaaaagcatctgcccccagggaggccagtttcccatcaagccattgcttctgtctcgtgtcactgtgactccctacaacctgcatgtccatttgactagactctgatggacttctggtcgaccaagaccacccaggagccagaagatagcagggcataaaagacaacacataaaaatctcccagggcacagtccaggaaagggaagacatctaggaagtgaagaaaagacagattttttcatttctgttttagtgactggctttgttctaagcatgttacatggattgtgtcctttgcttctcatgataaaaaacaaaagtataggtatgtatgtgtgagtgcataagtatgcatagacacacacagatggagggtgttaaatttctctggcaaagcagtaaaaatgtctctcttgcttagacgaaggcagcctactgacgtagagttaaattatttcggtaggtgttaatattgcagcttttaaagaagctgcggtagaaaataggactcattaatgtgcagtgtgctgagctccaggctgtggacagggacagggacagcaggcaggctgagctattgcctctgctgcagttctcagttctgctccgtcactgcctgcgtgggtggtgtgtgatcaggagacaggtggcctgcttctgagagccacgggaatggctgtactttgaccaacagcagggacactggcagaggagctcttccccattctgccttgtattgggaagaccagaaataatctcaggaaataaacacacactgtagtttgtgctcctagaccttagtgtgcctaacagccaacacaaagctcattaaagaggcaggttcctgggtgccagctgaaggacttcattcagttaagctgatcagggatttagtaatctgtctttcagttacttcttcagggatgcagggttgtctattagttcagtgtaattcttttgagtgaaaatgtggtgggtgtcaagctgataaagacaggaagattctctggtgaccagttaccgtatttaaacccattgatgtaaagcacattgtagaaaggtgttaagggagtaagtagaccaatgcgagaatgtgtacacatagttaaagggtcatgagcgtgggtgtgggtcttagccagatgtgatcagagtactctgcaaacggaaacaacaggagacagaatcgatgatggtatagaaagactggcctccctaggggtgggaggtgagcgcttcttccagtaacttctagccttatccatctcatcttcaggatgatcagaaggccggagtcagtaaatataatatgaattgtctctcccgaagttggaatggaccaccttcgttctctaaaggagatacttaccctgtaataagatgttacgtcctctgagagacctgaccaatacattggaattgatcatcaaaataaataaataaataaataaataaataaataaataaataaataaatgggagagtgtttttaagatcttttgtactagcggcataggcttgtatgtgaagatctcctcacccactgttctctaactgtaaacatcactgaacctctcaaaacctaagcctatacgtcaactaaatggaaatgatgaaaggtggagtctgtgcccaggaacacaaatatgaactgggatcatattaagccccagggaagaatatatatttcttgtttctctggtgcctgctggattatgtggtgtctatacgtattatataaaatgatgcacacgtgaaaggtactgttattacttcacacgcaattaagcttgagctattataaaggtgacttgaattaggagatttgtcatggaatggcatcacaggagcactttctggttgtgtactatccctccccaattttcccattcttgaatccagaactctctttgggacattctgttagcatgctcttcattgcgaacttcaagttgcactaggaattgtgatcttgtttgctccatcgaaagtgctatatttaccaaagcagtgatcttcacacatctgtcagtctctggcctccattcatcctcacagatcccagacatctatttaagagacaaatcacaggagagcttcctgcattgggcatttcagctaacttgacttaatatcactattcactccaacacacattcttgggtagtctaggctccactcctccaggaaaatggcttctccatttctctgctgcttcaggtgctcctgagtgcccctccccaagtcatgctccccctttagtgttcagtccttgccttcatgactgctccccctggaagcttgctctcagacatctccacaatcacactcatccacgtgtctaatggaaccccatagaatgacagaactgtatcatcaagctttgttcattccgtaaaccctgcagttacttctctacacaaagattctctgctgcatgcagagcccaggggttgctcattaccctgatttacttgatgatgccctcaactccggtgtctagtgtttctctgaggtcacaatgccaaccttcatttgtatcaagcattacagtttataatgtctttaaaagactattatttcttattattttattagatatttattttatacatttcaaatgttgtcccctttcctggtttcccctctgaaaacctcgtatcctctcccccctcctcctgctcaccaacccacccacacccatttcctggctctggcattcccctatactgggcatagagtcttcacaggaccaagggcacctttgcccattgataaccgacaaggccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttggcaatgtttggaggctcttctggttgttacaatggagacgacaggagtacgtctgaaatcttattgatagaggccaggcatgatgctcaagtgctgcagtattcagaatcctccacagcagagattcactgggtctaaagaatcagtagcagtggagtgggggaaacttgatgctaggtcattaagctttcttacagggattctactctgatagttcccacttggaatccttcttctcttcaggactacatgcagtgtcctatggtcctactgtgacagttgagtacctcgggcaataaaatctcctcactaagagaaccaaactgattatttcaagtctgtacagtgtcctgcgaaaacagaggcaagttaacattgaccttttgaaatgtatttacttttttttatgtgcattgatgtttttttctgaatgcatgtctgtgtgaggatgttagatcttggagttacagatagttgtgagctgccatgtgggtgctgagatttgaacccaggtcctctggaagaacagtcagtgcttttaaccactgagccatctctccagccccaccattgacttttttaaaagctttgattgtctcagccccaaattgtttaccttctaactgtttgaagagtaactggtctaccacatagaaagcaggtttcaagcgcatagttgttttaccttattctgcatcttccagtaatttctcagcatcatttctcacaattctctcattgcctctagtatgtgcattttacacctcgttggaagctgctgggactaagtccagatgcttgaatggtgggttccacaacagaaaagcaatggatcatgcaaaagtaactgtcagatcggtgtgaattcaggccccaaaaatgtattacctaagcacttgtgggtttccacagcttctataactcaggcaatgacaagtgctggcgaggagatggaggaattggagccatcatctgatgctgctagggatgtaaaatgatgcagctgctttggaaggcatcctagtagttcctcatcaggttaaacataacgttaccattagctcagcataagagtggaaacagccgggtgtcacccttatgaatggttaaacaaaactcatatattcacacagtggaatcaggaaggaagtacaaatacatgccataacttggatgaacattcaacataaaccaggttaaagaatttggtcatgaaccatcacattttgaatgattccattaatatatccagagtagaaaaattcatagaaatagaaggagattatttgttgccttgggctgaagagttgaggagaaacagtgaccacgaactggttgaggatatcttgatgactaattgaaatggcctcaaactgattgtcaagatggttataaaactctttgactatatactgtcagtgtgtgatataccttaactggtggtgtacaaattagatctccataaagctactgataaataagaaataaagaaaaagaaggaagagaaagagaagccaaagaaaagacttgtgtagtctcttgattatcccttggctgcatttcttcaaagcctcccaagttattaggaatgtgaaggagtgaagcctcatctctctccttgccttagtaagaactaagaacccgatctttagttctggttataaattaaattatctttaggcagattaacaagagacgaggcatacaagttttactaactttatgtgtctgggaaatttccacaagacagtgaagtctgaaaaaaaaaaagtccaaagcaagactcttttctactttgtaaacaaagagtaataaatcttagggtagaggctagacataagagaatgactaaacacagggaaaacagtggagagcaaatatacggaagaattcaatgaagcaaggcttgtctgcagtcccgactggcacctggctctgagctgataaagctagcatcagttaggaatgattaatgccctgtcattaggcagaaatgagaaaagcagaaagtttctctgtgttggaatatttttaaggccaataaacatcaatgttttgggttcctttggcttccaggagaaatatcctctagtagtggtgagctccagctttggagttacgatgactgagtgggattagataggcttccggattactctcttctcccaccagtgtggatcccagaacttgggtgcagtatgaggactctcccttcagcatgcatcagaccttctgggggcttctcaaactatacttggctgtattccactgacagagtgtctgaggcagggggattgagtgagcagagagagagtctacattcttaacaagtttcttggtaacaaccatgctgctggtcgtagaagaacaatctgagataatatttagccccctaggcttgtagacatactttgcaaacaacacagaaatccatagtttaaattagttatgtatgttaacataaaatgctttataaatattttatttgtaatgtccaaatgttgatctaaaaacataactgcagttttgataaaatgataagaaggattgaatcatggaatcaaaagacccaacccatacatctctagctctagtaattgaggtaaagaatttttcagactataacatactcaatagtgaaaaattaataatggttcctcagtatagatcatggggttataaaggaaatgtatgataacctacctgaaaacacattgcaaatcctaaatgcacttctcctttggctcttcttcttcttctgtctgttctgacctattctggtttttatttatttatttgtttatttatttattattattatttagattcttatttgtatccttataagtgagagaaagatgtggtgtagacttgggtgggcggggaaatgggaagaatctgggaggagttggagaatcataatcatactatgttatattttaaaaatctactataaatataagataaatgcaaattaaaaagagatactccaagtgattcaaaatgctagaataggtaagacatttttaaaaatgtgttccataccaaaaatctaatgaaaaaatttctcaaaatcattagccaggagacaaaaatattcatgccaaactgccgctatacgcctattaaaatgaccaaaatgtaaaagaaaggataattttctggtgccatagcacagacagcttcttttaaagtttgacagtctcttacatagcaacctggaaatcagtcatgagtatttactgaagcaaaatgaagaagaaactttatacgaaaacctctgtgcacttatagcaattttattcgtaagcacttatgcatagttatatataaatttttacaaatgagatattccacatgtgcttcagatgatacctttgaacgggacacccatactgtggaacccttctcagcaattacaagaggtcagtgactggcagcacagtcgagtctcaaaagcaggggtaacagagactgacccgtgtggtgtgaccccagttattaacaatctggaacaggcaaaactgtagagacgaacatccgattgttgggtagcagaactaggtatcgggaacaaagaggatgcagagggctatgaggaggtgctctggactatccagtctactctatagcatgatttcagagctgcctgcaggactgtatgctacacagttgaaaagctggcctttattttatacacttcacctcaacaaacagaaaagtcaatgtaaagtttgaaagtgccagctgaaaaaacttaccattcatttgagcttaaccagttccatacttaagccagagctgaagggaccactttcagcagctcaggcagatgctgaagcagagataacgccccgctgctctctccatggaccaatagcacttctacctgaacgttagacattttaacagtagacctgaagacagatcatctgcttctacccccaattaaaagacggactaagaacataaaaagaatccaggcacctaggtttgcagaaatctaaaggttgagttcctttaacttatcaacgtttgtgttttgaaatctccgcctggatttccgtataattctagagagctaagcaggagaacagctaccagatacctggtttgctagtaagaaggggcgtggcagaggggcagcatgccgagagatgagggaaggataggtaggcaattgagggggtctttctcaggtgtttctgagcagagtggagcagctgcctctggtccctctccgtgaagtgattctctggggagatttccttgatttacatgttccttgcatgttcatagaattccaccttaaaacaagctggacgcaagcaaggccagtttctcagcgtggaaaagcttttgcttgagcaatgacacactgcagttggatccagttcacccacatctgggaaccacatgtcagcggcagctgtataaagtcagcccagcaaactgagggtgacattttttttgccagaagccgggcagtatggacctcactcttctgtgggttcttctgccactggtgaccacagcctggggccagtatggtggctacgggtacccataccagcagtaccaggactacggtgatgatggatgggtgaatcttaaccgccaaggcttcagctaccagtgtccccacgggcaagtggtggtagctgtgaggagcatctttagcaagaaggaaggctctgacagacaatggaactatgcctgcatgcctacaccccaaagcctgggggagcccactgagtgctggtgggaggagatcaacagggccggcatggaatggtaagaagcagagagtgctctagagatgggaacatctgtgtatgtactgcatgggagaagtttggtccttaaaatagcagggctcataacctgggcacatcctaaacttgctattgcatgctctggcgggcaggtgtgtacaatgtagataacattgtaaggtgaaaaaccaggatgggggtatgtcccatgaaggatggatctggttctactccttcaaaggccatccctaggctcagtgtgtcccgcaagctgggtgtgtgtacgcagaatgcttaccagacttccaaaatagagatgtcttaaggaatttatagaaagtgggcatccctgtgacatgggaataacacttccattttgggatgatttaccgttttccaaaaatactgctccagggtggttgggacaaaataaacaattgggtcctcagtatccatatcctgaaaaaaaaatattgattcaaagtaagtgattgggtaaacaagactgagaactagaaacaaagggtcctgaagttaagtagtgctctgctgttctgatgaaatatgttctggcgagttttactactgagatttctctgtctccctctctctccctttctcttgaatttaaatagcctctgttgctaggatatagtttaccaaaggtttttagaggtactgtcctgacttctgccttttgcctaatcattggaactgcattggtcccagtttgtgcttctctgtggtgtttgactatcccagccctggcatttgctcagaagcccatcttaagagacaggggtggctatactggtcattcatagctgtccaaatggagcccaaatttcagggcttagggagatggtggaggctgaccctaggagaggcagactgagggaggaggtagcccagctggaaggctgccaggtgtgccctctgctgaacaagacaactgcatgaggggctcctgcagggcactggcagagtgagcatctgggatggatcaacataaaacattagtggtgatactttcagccatccagggagaaatgccctgagcatacatcacaccacacactacattatctgatctgatctaatgctttaagcaagcctataaatcatgctgtaggttggcaaactgtggtctggagataggtgggtttccttagctagaaagacaagatttggatccagaaagtctgagctacagcggtgggcttccaagagcctgctgcctccaccctaagtggactcctgttgacagagccagggccccagaaccacactcaagctgagagaaggtgggaactacagggactggcccagtgtggtaagtggcagtttgattagagctctgctcctgaggacagggcctatctacccgtgttataggcagcattataggaacagaagcagactgaagaatctgtagaggcctcttgagcagggctgttaggccatccttctccattccctctgcttctgccaaacagatccaaacccccttcagacacagatgactcagagaccaaacttgtcttgaggacagaggacagaccctggtgagtcccagcaggcaggctcattgcctggcttcaagggtagaaatgacctagttgtaactgcctgtccagtccacccaccccaagggaccatcacatagacgggccagctttctaacctcttgaaagagccacagaaggacagcactgggtgaagattgcctaacccctaactgggggcagggcaggggggagccctggggtgagtcacaagctgggttttggttctggtgctaatgataaaatgtaatgggaccttaggccaagcttcagctgtctccctgctgctgcctttggaagatgaaccctcaggctttgcagtctctacacaaagcagccactcacttcagcgtgcgcttggcttttgcttgcattctcttgaactgtgtgttcaccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaacatctctaaagccccatttcatgtataaagcaggggaagtatcatgctagcaatttttgcccatttcatagaattgttttgatgattaaaatgactaaacagataccatatttaacagaatactcaaccatgtaactccttgtgaaggtttgttcatgatcactgttagggacacttggttctctgagacaagccacacctagctagtaagtttcaaaatggaagtggcaggatacatggacttttggaatatataattcagttagaatctatgaatatgaaatgtacaatttcaagcatcttgaatacttgccacaacttaatagatactgagctggcattatgccaacaggttataaagtagtttaataacttttgattatgagccctccacccttaagcctgcttgctgtcttttcatagtctgaaagtttaggtttaaaaggacatatcacaaaacaagcgggatctcctccaatgccctttgaatagtcgctactgactgcttttctacagtacatctttctgcctgacaggtcatttctgcttaattcttggtagacagtccagcagctctagaacatggagtctggtgacagaactcatatctaggaacagcaagaacagagcagcctgcgtacagctgaacgttattttaaaagaccgttcatgcccccatcattggggcaggaaaataagtgatgcagtatttatcttcaaaaagcttgtcttgtcacactgggggtgggtgggcagccagatgaagactagttgaaatgaaatgtgtgcatcgatacatcccaaggaagaaaaacatcaatctgagtcagaaagtgtgagacttattagggagtagagactgggactgcatcttaacctctgaaactggacgcattgttgggggagttcagtactaacgattcttcatggaggacccaaggattataggggcttcttaaatccataaataataagttttaaatggaaaaatccagaaattcagttttttagactaaacatccttatcctgcatcaaggtttatatccctgcctgttacctcaacattaccttaccaggtcactaccatgacccgtctagtcccctgctctgtgctcttccatcatcagtctcactttgcttctttttaaaatgtctgcactgtcagaggacctgcttgtcagtacctgaaccccaagaagaagaccaggctcagtacagagcaggctttaactttaatactttttgaaatatttaatgggtaccctaaatttctgtggattatgttttaaatggttaatggtaactaaagaattattccagggaagaatagaattaaacacctaaagtttgattctatgttacaattatccactacaaggaatggaagaaaatttaggaaaagttcaaaaggctgtgtcacatggttccttcaattcagggagttggccactggtatgaaacatgggcaaaactactcttattccatgccagccatggcactggagacaagctaacagcccttaaaatatgtgtgttatgaagtgagacaaaactaacccaaccagaatcttccaatttagaaattttttgagagctactgaccaaggatggtgctgtggcctttgcttttatacccaactcaatcctagtttcagttcattgatatcttgggttttccatacatttgaacatgggctagcagagatcagagttggtgggctaaaactccacaaaccacttaaaaagaaaaaagaaaaagaaaacctgccctccccctcctcctccctccccctcccctccctcccctctctttcttcctcctacctctgactggtgtcattcgttcttccagtctgaccatcccagactcggtgaagctcacatataagggacagtctagctgaggagctgttgggagcagatggacagcaatgccatttttgtttgtttatttgtttgttgtttgttccgtacctccttgaagggaagtgtgcataaacgttttggtaaaaaaacaagtcgcagatccttttctagttagtgactggcttggctactctcattcaggtgtcacttcattgagtcctcaccaggtctatgaggacccacggagcacattcatgtcaaggtggaaaggagactccctgcctgcggattcctcagaatgaggtcctcccatgatctattatttccattttaccattgcagacagaggggtccattttctgtctctgcttctaaggtggtgaccttgagataaatcgttttcagaaaggccattttcctcagaacacgggagcaaatgttgttgtcacgggaagagtaatagcctcaagccttcccttccagaaaactcccagcctttggcggcgtggaactgatatcgctcttgtgtttgaagctgaaattgaatagcaaagagataatgaaaaaaaatgggaggggactctctgaagcagagcacctggccctcgtgtgccaagggaacattttcttggagtctgatgaggagtcgggctcatgccacaactcatcagtaaagctacagccttggagctgacacggtattcggcagaccattcaaaagcaacaagccagtgctgtgaagtgtcccagagcctcgacatgcccttgtaccgttgtttgttttctttggttgagctgaaatgtgtggatcaatgcagaaccttcccgctccctccctcagcctcatcagctgccctcatccattctcacctccttgaaccagggcctgtaattctgaattctgcagctctactcaatgttcacataagctttgttatctaagaggttattgcgaaggcgactgagggtataaacagggcatgcgagtactgcatgaagcagtacccatttggcaccttcatcctccaaaaggactgctcctgcagcagacgttggaaacaggaagattaaccactgctccagtttccataggaacaacctaggaagagttccagagcctttcaaaggctcaaatgataggcccttacaagttaagtctacctccaatagcaggagacagctggtcagtcatttgctcattcattctatcaaacatttacgggacaagcctcaggcattacgacgaggaatacaaaataaaaattaaatggtcttttcccacaaggcctgtactatctgcctggggtgatgagagatagcagagcatctgtgtacagagtggccgaggcatcctctctccgtgagtttcatcctaggggcacaacagctcagaacacgtatacaatgcttcagtgacactcagcatgggactggctctcacaaagtagactccaactggttgtgtagactacaccaaagtataatcacagtaggtgatttacacagccccaaaacaccagcattctcagggttttctatgcatcctcttatttggtttttagagaaatacaaatatatattatgtgcattttacagagaagaaacctacatcattagatgatgtggtaactgttctaaatgactcagctaacggtgaggcaccagtctagaagcatagcccacgatagtaatccccgccccgccatgtccgtctttacattgtgaatacataccgctaccaaagtccagttctagaaggaacaattccataccaccaaactcatatcaggctcacattaacaaattatgaaggccatccagctgacactgtagaggaccactgatattcagttacctttctccaaatggtctggagccggggtcatgtagggagcagccactcttcacagggaagctttatttgagggggcttgtgaaaacgacagtactcttcttgcaagggccatgaggctggctggctagcggagcgccagaagggaatttgtggaactcggactgctttcagaactgggcttccatgaaatgagtctgcttaccttcggatattcattttccataagggagttcaccaccatgggaactcttttccttataggaagctgagtacacagaacagaaggatagaagtgtcttggggataaaagcacacccgagatgggagtaaaaaggctctgctttggaggaaagtagttatttaatgaggacaaaacaggaaatctcatagcacaccagtgtgctctgccttctccctctgaagaccttagggtttgcctatgactcttagagcatagactgatttcctcccatccacactgatttggaattgagatgagcagacccacctgagacacaggaggaaagttatttctccatcacactatgacagtcatagtgtaatgccaaatgtataagcccaaagtgacaatacttttgcagttaaaaaaaaaaaaaggctagataatcaaaagccatccatctcaatttacatattgaatttcattattgatcgctgagttctcactccaaacttgttaccactcttgagaacatagttgagtaagcacccagtccatctctaaattcccttttcatcatacatacagtggttaaaacagaatagtagtaaggtataagttgttgatgagtgaatgtatatttaagtacacatatgaatgaatacacacataaatgataaatgaataaaaaggaaagatgcatgagttaatttccaccaatgggggaagaaaaaagatgatacttaagtaaatgccccagtatttcagctcattagattgcctgtaggttttaatttttctcaaaccctattttttaataacattcttgaatgctttcaacccccttccagctcacagaggtagtggaaaagaaaagttattaggatacaggggaagtggacctgcttagaaattgttctttggagcaaatcccatctgccttgtcaggaaatccacagttcagttcatgggtcagcagtggcagctccatccatttgcaaacacttcatgaatataccagcagtctagtttggtagagttggggtagcaaacacgaatcagcaggggtggcacaacctagcagaaacagccaaggcttggctgaatcagcataagtgagcaggaggaaccagggccaccagggatcccaggagttctttgttgtacctctctcaacaaagtggaggtcagcaaagactcgagacccagaagcattgattgcaaagctagctatgcaagcaagtgctctctgtcactgtctgttgagtccaattgatattccctccaaacatcatgtgtcctccaggagtctggcctcaccacatgtcttgcctcagcccatgagtctgttttagcaaaactccacgtgagtctgtaacagcagacatcactctgccaatcagctggagtccaaggaagcagcaagaagccaccagagcaccaccagaagtgttttggtgcatttctctctacagagtcataatagacagagctcagctacacattgtaaggcaaaccaacacttgcacttcattagtgaagaattcttcatcatgcatccttccacgtgcttgctttagcaaaacatccttccacctgtgcctgcttcatgaaaacactccatcacgtgtctgtctgtcccagcaaaacaccatgagacacaactgactttccaaagaacccttaagtttccacttcagtcccccactcagtagtcagtgaagggaacaatcccccttccatactttctagaggcagttttatttgcaaatcaaggttaatctagcagccttcagtactatgtaccatcagccacccaccttctgtctcacacgagagaggacagatcgatgtcccaggtacctaagaaaccaaaggatacagaagaagctgaagacctgatttggaggggcttgtactgtagtttgaatctgtttcatgtattataaactaaatccttgaacctgtgtgtggacagcattgagacataagtcctttggaaggtaataggaaacagataagggccccgtgatagaattagtttctctgtaagcagggaaagaaaaaatccaaactggtgtgctgttctgttttaacaacagaaaccggcctggaaaaacttagaaaatatcatgttctacataagacaaggaagctccgaggccaggaaggaaacagtcaacatccaaacagaaaggaccaaaccgtcaggcagtgtgtgggtggggcaaaggcaggaagaggaggagcctcactgttcctcacttagagagatgccttaaagatggaaggggtgggccagcagcaccggtagatgaaagtgaaaattccctcccaaattaggaccaggatggaggacacaccatgaagaaaaaaaattggaaacgataggaaagaaaaggggcctctggaaagagtttgaactcagttggcctgtggattttctgttgtgagtttttccaggttcctggcttatctgtaggttctaggggtaaagttcagagacccaactagaagatgatagaaagattcctggatacgcagacagaatgttgactatgatcctaagcttctcatcaggttcccaaaaccagcactgcatctatctatactttgtgtgccgtgtagggagagagtaaaatattaatttgaagtttaacaactcattacagttcttcgtcagctttctagtttaaattcaagtaaaatgatttatagcatcctcaattgtaaaattcacaaactttctttcatctaagcatacatttatggaaagtcattaggagcagggtctcccaagcttccttccattcaaagttactgagacattggaacctttatggcacacatgtaatttctacaatgcaacagctactctttgtatcaaatagaataacttgtgggagtgtgggtcaaagagcatattaactgtgtcaagagggtctgaggaagaggtctgcattcatcagtgctctgatgccttcttctcttcaggtaccagaagtgctccaacaatggattggtggcggggttccagagccgctacttcgaatcagtgctggatcgtgagtggcaattttactgctgccgctatagcaagaggtgtccatattcctgctggtgagtctggtaactaaatcttactccttagagctcctgggggtgggggtgggggaacctacaatgatctgttccttcaaataagcccaggatgtcacaaaccagtgtgataagcagcagctagacaatagaagagaaggaatggctgagggagaccattcatactggaaaaagccctacaggtcatccaacccaatgtccctgtatacttctttgccatgcaaaaataaacagaataatgcctagtggctcctgtccccaagcctgttccctctgtcatgatgatgaccttgcctcacatccaagtctgtttgggacctgtatccctgcagcacttccaggagtgaccaagtctcttctggaccacattctgataaagagttggagacaggaagcaaagcaacaatcacagcaacagcaaaacagcactggtgttttctgagttgcttggcagccccagcctgggatgtcctatttctctgtctctccctgggatgaagcccagtgctccctgactctggcttccaatcttctatgagatgacacacacacatttagtcaccctgataactcacaccagttaaccgcacaacttatcccaaattctttggcctccaaacaacccaggcttttaagccttggatagttatccaaaatcaacatttgaagcttggctcattcaagggcttcgtctctccatagtctgatgtttgggaggagagccttgcagtttctgttctctgtaatcatggtgttactccacagatgtgccagtggtgcacaaagtctctagagtccaatagttcttcttgcagcagtgacagtaaattcacagctcaaagtcagctgaagtctgaagctacatgccagaaaaaaacctcctctagcttcaccaaaactgcttcttaccctaccatgactggtgagcaggtacaccaagggctgatgattgagaccaagcagatccagaatcaaagaccaaagatctgcatgctatgttgggcccaaggaatgctggtacaggcaagggcatcctgaatctcaggctccgtgccattttttactgtgacctctttcctcgttgtcccctctataacgtccctggaaaggcacctttacttctctgaaaacctcaatgcatcattggaaatgatggcaaggtttatttactgtgtttccataaaaaaaagtctgatgaaaactgcagtttgcagtctgtaaggatgagaacaacacactattacattctgtgtatggatacctctttctacccagactttgaatacctggtataggaaaactcattgatctttgcataaccaatgattgtctagcacagtgtttgggtcttatatgtctgtgtgtgcacccatatgcatgacagagagacagacagacagacagacagacagacagacagactaggctgaagtttcttgttttcttgcgttaccaggaatccgtcattctaggcaagtgttctttctagggctgtaccatagtcccagtcataagtggttcattaataggaagagaattcttttttgtttttttgttagaaaaaaaccataggttgttgttttaaacttaaatagatttttaactcttcattcctaccctccctcctctgcgttatgagctctgagctcacagagatcttggtacttatgtatgccaagccctttaaaaagaatttttatatatttttctctgagtgtgtgtgtgtttgtgtgtggatgaacatgtgttcagatgtgtgcacacatatgtgtggatgttagatgtctacctgggatatagccccttaggcgacatctttctgggagacatctctctgaaagagtctctttctgggacttggatcttgctgttctaggttagattggctgaccagtgggcctcagataccctcctatcttggattccccagggctggtgatcactagtgggatcaccatgctctgattttgacacaagtgctgtagatcaaacccttcatgcttatgcagtaagccctttacagactgatctctctccccatgtcccaagaccctttggtgacatcagatacacagcagacactcccatttgttcaattaatgaaggctttagcctacgccctagctttctagtgagggttaaatgtgataacaggatcctggctttgccatgggctatgatcacacaaagctgggttgttttcaaagcagagtcccttccactttcctcaatgcagaagagaccttctatcctaataagcctttcaagggcagaaacacccaacaaggccaagcattgccttgcagaaaacagaacatgtgacaggagttggatgtgcagaggaacaggggtgagccaggggtgcaccgaatcgtgctcacccagggagagaaagaggattctgggacagacacatttgccatcacagtaagagcctagggtctctgccaggatgaataagagagcccacagtgtctgcagacagatcatcatgcctgctgcctggggttctgggcaaacagaactacagggaatgggcttggggcccaaagctttcagctgccaggcagataaatgcccaagaaaatcttactgacaacagaggctgaacatgacaaaggcagaagcgtctaaattttctgtaatccttgtcttctaattgagcaaccaatgaaatgatgcatattctgcattattgtgtgtcaacacttggagcgttgatgcttgaaacttaccctgtttatggccggatacagataaatcactgtgtaccaaattctactacccatctaaggatgccccagactccagcggtcatctgccttgcttccccacaaatattacatgtcctttctctctttaaaaatgacttccaaagtttccccttagatacagctcatcacttataatactaagaatttaatgactatggaaaggtacagataagggacagagaggatcttggttaatttaacaatggtctaaatgagatgagtaactcttctcgaattgacagaaacattcaggtttcataaaattcacccccgagccttggtcttcagggttcttccacttgccttcctgacccccaatcccttattctccctcatcccacctgggtccagatatatcacaattggtcagagtcactgggcagtgagaatgatatcacaactcaactttgaagcagacgccacaaaatgactgcttcaacgtgattggctatagctcagacagcaccgtgtcagaacctcgtggttctgtggaaatgatacttttctcaaggaaacactggagaagtggcataaacactgtgcaccaaacaccacgcaacacagcatatgactcactgttccaagggtgtctggacattttagtgggatctttaaattgcctgagtcatggtgttatattatacccttctaaattgaatgaagcccccaaggtcatacattttcaattcttcagtatctcagcatactgtctggcccttagtataaaaggtgtcaaaagcgtaactatatgttgctagctcttacgagcagtaattgcagtgaaattaatattgatagagtgagtttttaataaatggtaataataaaaaaacttcttttcaccgtaataaaaataccctgaaaaggtaacttaagggagaaaggatttattttggctcacagttggaggatgcatgtgctcacgtacagaggtcatgaggcaggagcttgaggaggcaactggtcatattgtatctacagccatgaatcagagaatagcaaatgctgtgaccacttggctttttcacttttaaactacttcgtgtatatgcatgcatacctgtggtgattcaatatgcttggcccagggagtggcactattagggggtgtggcttattgtgcttgatccttttaacagccctgcatggtgaatggacagctatgttctaccttccccacactgacatgctgctaagccctgtccttggtaccttctcttacgtcactttagctgacttgaattaaatggtggaactagacacatgaaaggatgaacctttccacctacatgtgtgtgtgtgtgtctgtgtgtgtgtgtgtgtgtgtgtgtgtgtgtctatgtgtgtatctgtgtgtctgtgtgtccaggcaccatggaatcctaaggagaccattagatcccttagatgtagatctataggagattgaaagctaccctatgtgggtgctgagaattgaactttggtcctctgcaggaacagtaggtgctttgaatcactgagacacctccccagtcctgtgtgtttgtctgacacaagttttatatatccttggcttgtctaggactgcctttgtagatcagggattcttcaaactttcagcagacatttcctgtctttgtatcctgagagtgctgggattgcaggcatgctccaatgcagcctccttcccttctacattgaaattctctctgcagcatgcatgagaagcctgtcaagtgaatgtctggcacctctgtattttcgagcatttagagactcagaaataatatcattccgggatagaaaaacaaaatcatcaccaactcccagatgcatgtgggatttatttgtttggtgggagccaaggtgctgttctgatttcagcgtgatatctctctggatatcacaacatcactgaaacctggcaagaaagtaaattcctgctcgatgcaggcatgccatttctaatcggttcccactggactagatgagtatgtaaatgcaacacatatttatttagctggaagaatccaaatttgtagtccaatggtctgttaacagccaacacatgtcaccaaaagggcggcaaacaagactacggagaccttttgcctcttccactgtcctcaaacagctccagctcctccaggtcacatcccagtcagtcggcctgctggatggaagctgcgcatatgcatcctgggaccgaggggtttgaatttaggaacgtgttcgcttctttattgttttgcctaatgatccttctctggatctatgactgatcagtaggtttgtagaatgatctgcttggacacagtcacttgtttaaatgacctttacattgcctttcactgtcactggctttctgtgacactcaaactcagcattctccatcatttcccccctgacttccccatcatgtccagtttataaggcagagagtagcttcgcttaattcctggacattcctagttctcaacaacaaaagtcagttaaagagagcatttgtctcttctcttccactgtgaataatccagtcaaagaaaatctttgtgaaatcgggcacctttgttctgattttaacactagatgaggtttcttggcaagaccattcctgtgatgctgtgtccaagtcaggaatgagctcataggccttccgtcagggagtctgtcagcctgccctggctggctggtctcctgtagcatgtttcccagaggcctgataaaaagaggaactgtacacactgatggctctgagctagcataggagctattattgcagagatggaagctcctatatcttgataaaatgaatctggatgttagtgtttaagagggcacactgcatgtgggtactcctgtttttcacaagcagccaccaccctgccctgtgtacactcattctggagaaccacagctcccctgagcctgcgcagaatcaattgtccctttcctcagctggagcagctgtcacagttactgtcccctatttataatgttggcatctatttgcgcatataggagatactccgttttgtgttcagacttcaaacgcagacacttcaaagatgtgtctgatcgtcagagtatcagctcacccaacctgagccacttagaacaaagcaaacctgtcaatcacagccaagtccacttcaatcgacaggactctagaagacatccttcatttctttatccagttagttactaaatgtgaaagaatagaaaatatgtaaatttcacagatttaggagaagttctgaaccatggctattatattgatttatttagtgatatcatccctgtgctcgtggagaccatgagatatggaagctgtgatgctcttcaaaagagtgagcttgattcagaaaggtccagccacttctagatcccatgttatgtgtatagtgtacagccacttacctttatcacaggaagaaaataagaatacagatcaagtgttaggcagcaacacagcagacatctaatggcaaagtgaaggaggggggggtgtttgctttatttggagggaaggagaagttggaggtgaaactgtccttgttgatgtacagctcagggtagccaggcttatgactgtcaacagtaatcaaaacaaatgtgaccactgccgaccagccctgggcttgaagcaagagctcgaggctcccttccaaaacagcaatttgaaaaaagttcagggactttcctcttctaatttaagtcacagacatcctgagaactgtgcttccgctgtgtggtgatacatatctgaaccgtttgaaatagaaacccccaaatgccacagaggatagacactaacattttatgttccctctcacagcccaggttcccagaattcagtctgtcgacacagacaagggcactaatgtgactgtagaggacatggcatgtggtcctatttggccaatgcccagctctctgggagggaccaagacacctgcttctttgcccctgtctatttatatttattttttaatgtaagtccatttgggttttgttgtagtaaacatttaacctcaattgagggtttctaccctgtctttgaccattcagttctcagataaaggacacacaacctttatatttatatccccaatgaaggatctagagaaaagacccaaggagctaaggggtttgcagccccataggaggaacaacaatatgaactaaccagtaaccccagagctccctgggactaaaccaccaaccaaagagtatacatggagggactcatggctccagctgcttatgcagcagaggatggccttgttggtcatcaatgggaggagaggcccttggtcccatgaaggattaatgccccagtgtatggggaatgccaggacaggaaagtgggagtgggtgtgttgatgagcagggcgagtgggaatgggataggaggtttttggaggagaaaccaagaaaggggataacatttgagatataaataaagaagatatctaataaaaatgtaaaaaaataaaagggaaatataaacacacacacacacacacacagtagtaaaacaagaaagaaaccaaaagcactggagctgggcagatatctaccctatgtgttattatgtctacttccctatcaataaccctgagttattacttgctatattccatctgggctgctcttaagtccaattggccagccctcatggtcatattttcatgactcacctaccccatggtgtcttctctctccaccttcttctctctccccttgtggtcctcctcagacacccagtccaagaattgaagctccaccttcctctctcctgctcagctataggctgtcagcacctttattcaaccaatagttttcaattaagaagcaagttcacatagcattactttgtgtatgtgcagattctctcatccctgggacaacccggccttggaggtcagtatgtggcgtcacaacacctagcaaaagaccaaaaccccaacagtgttttatcattctgtctttgcaaaaatagcttgaacaagtcgtgatgtagtatggattttgcatgtcagaaagttatcatctttgatttacatatacattgtaagccagtcttaacatatcaagcctatgcttgcttagtgtctcttctatgctctgtaaacattagctcataaaatacgtgtatgatgccgtacaccaatgatgcctcaaagacatctccatacccaccagccagtgatgcactcagcaactgttcatccagtctagtggtacctattgacaagatctgtgactcaaaggtcacagatgggaaagtcctgtgtcaatctcccttcggttcaaactgagttttttcatatcctttaagttattcctgtcttatccatccctgtctgtgcaagaacttatacaaatcttaagttttccacttctctacgttttggaacaaaaaattgagacgctgtaccccaacagatactttttgaaagtgttaggaaagtgtacacgcatggatgtggtcacacgcacatgcaaacacacacacacatgtgaatatacataaacacagtggattttttgatgaaaagagcataaatatgccccctatatttctcagaaatactttaaaatacactaatttctttattacactgcccttcttctcctcttgtcaagccgcagacgtacttgtttattttacctgggctagaaatgtgtgccaatgctctgtatgagggactttgccaaaaacctgtctgaaactgcacaatgattcacaggaaagctgaaaccacactgaatcttactcttatctgcatggaagacaatactgtgtgcaataaaacattatcatccagtttccgctgccctctcttgactttctgaaaaagtacataaactttgtctcagttttaaccctgtaagtttaaagccttttattttcttgattaactattactcaggcttttatttattaggacagtgtgtgtgtgcacgcgtgcatgtgtgtatgtgatatcataaagaagtaaataaacatatatctattggactaaaaagatggaatcctagattaaattgaaaagaaattcttgctgcgggtggtgtttggaaggctcttattttattaatgattgagaccgtttctgtttccatatctttagtttccagcctccttcactatttcccctaattcaaggttcgggaagaaagtaagtttgatctcctggttttatgatgaaaactaagcaaaacacaaccaaaaatcaaagttaacactaatttggaccaataccaatggcagacacctcaccttctctgggaaactctagaaagtcactggtcagctgactctgctactgcagagggaaacttcctagaaacctatgcactgaccacaaggctcccatctgctcactaaattaataagaaatcctcaccaaagaaaccattaaggaaccgtttgcccctctggaacctaagccctattgatgtttattctaagtgcaaaattttctttccggctttattccagatgtttttaattgtgcaagtgatctgtgggcagggcagagggtcaatagaaacaacagtcaactagtttgggcaattggatgtagcctagcacaatagtgccaaatacagacaatgctagagcaaaattaaaagttttagtaatgaagtttgatacgttgtgtctaaatgtagctttttaaagttctagaatgttttatggaatgaagaaaacacacttaaatcctacttacattatgtgtgttctcaacagtccaccccccttctctggataaactgtcatacagcagctggcactgaattctcaggtcacaagccagtgggatccaactgaggcctggttaggtccctttatgtagcacttagatggatttttgttgttgttgttagacaaagaaaatgctatttcaggatctctttacaagcccaaaagagatttgaattttcctttcatgaacatatcgattaaaaatgcatgtgagattgggcttggtatctaagatggcctagtgatttcttccaaagaaacaaatcaaaaagggagtgagttattcaaagccaaaggaatgactaagaaaagcccaaagagacaatttagatttctgactaagtccacctatcttgtgctaacctaggccctgctgcacctaagcattccttgtagaccctcccatcagcccttctagttcataaatcaggtttgtttgtttttaattctacaaccttaagaaagaccattggattacacaatggcctagtacacccaaatcaaatgggattactggcacttacaaattagctgcttcctgagccgccctgaggatacagatgtgatccagaagcgctggtacatcatgtaaacttggctcttgggaggtgaaggcagaagtgtctggagttgaaagttatcctagctacatagtgaatccaaggccagcttaggctacatgagacctgtctaaggaaagacattgatgtctttttcttttttatcctgaatggatctattttggtcttgaagaattccagtggcaattttttatgagatccaggggattctaaatttgtctcaggattgactcaatctttgagaataaagaaggaagaatgacaaaaggaaggaaaggggcaatgctggcagcggaggagaatattgtttaatgattctacacctgccttagatcattttatcacacatactttggctagttgcagcgaaatgtataaaacagtttttatttttaataggttgggggaaccaattaaatcactctcacaaagccgcttgtttattcagaaaatatttgccatgtagcaggaactgttttagctgccagagataccatagtggacagatagaactgtacctttgtggagttcatattttacctagatattttaaacacatcgactattaccagttatgataagaaatgtgtgtgaaactatcgcacaatatgtgcaaacaataaatgcatacatatatttaaagttttcatgcacaagctctattataagcaaaacaccatgtcaattaatgcttcctgttctggcaagttctcttttaagctggtgtattagttatattttctcagcactgtgacaggagcaacttaagggaggaaaggtttaatttttgctcacagttcaagggtacagtccatcatggtggagaaatgatgaatctggaaacggatgcaactctaggttgtaaggccatgtatcttagtcagggttctattgctatgaaaagacaccatgaccaaagctactcttataaaggcaaacatttaattggtgctggcttacagtttcaggggttcagtccatgatcatcatggcggcaagcatagcattgtgcaggcaaacaaggcactggagaagccaagagttccacatcttgatctgcaggcaacagagggagactgccttctgcatgcagccaggaggagactggattgcacactgggcagagcctgagcataggagacgtcagaacccacccccacagtgacacactttctccaacaaggccacacctcctaatagtgccattccccttgggccaagcattcaaacacatgagtctatggagaccaaacctattcaaaccaccacaccatggttctgtctaccttcagcctcaataagcacaatctagaaaattccctccaaggtgactctagactctttcaaattgacaatcaatataaacctagtcataatcatttcaattgattttatgatctaataatgagtcatgatccaatttgaaacagcacccctggctgacttgaataggatggaaataattcagcatgactttcaaaggcaggagagtcttttgcctatgttatagctacagttgctgatgctgacgcggttgctgtaggtgctaagtggacagtttgatagctagggaaaggaagtggagaaatggaagaaggtatctatcatcatggcttggcagaaaccacctaacttcagttgcgatttcccaagatctcccgctctccttcacactgacctcctgtctgctccaaccctttgttctctctgcacaggatgacaacagagtacccaagccactatggggaagacatggacatgatttcctatgactacgatttctatatgcgaggagcaacaaccactttctctgcagtggaaaggtgagagaggtaacccctgtccagtgatctcagggctggaggctgtgcagattcactcccttgctgaagtcctgactgtggggtcttttacctgatgaccccgataatctagtttcctacttagtcaaggattagactgtgggtttggttaggcggcaggagccagtgagnnnnnnnnnnnnnnnnnnnntgtaagtttaaagccttttattttcttgattaactattactcaggcttttatttattaggacagtgtgtgtgtgcacgcgtgcatgtgtgtatgtgatatcataaagaagtaaataaacatatatctattggactaaaaagatggaatcctagattaaattgaaaagaaattcttgctgcgggtggtgtttggaaggctcttattttattaatgattgagaccgtttctgtttccatatctttagtttccagcctccttcactatttcccctaattcaaggttcgggaagaaagtaagtttgatctcctggttttatgatgaaaactaagcaaaacacaaccaaaaatcaaagttaacactaatttggaccaataccaatggcagacacctcaccttctctgggaaactctagaaagtcactggtcagctgactctgctactgcagagggaaacttcctagaaacctatgcactgagcagaaggctcccatctgctcactaaattaataagaaatcctcaccagagaaaccattaaggaactgtttgcccctctggaacctaagccctttgatgtttattctaagtgcaaatttttctttccggcggaggagactggattgcacactgggaagagcctgagcataggagatgtcagaacccacccccacagtgacacactttctccaacaaggccacacctcctaatagtgccattccccttgggccaagcattcaaacacatgagtctatggagaccaaacctattcaaaccaccacaccatggttccatctacatttagcctcaattagcacaatctggaaaattccctccaaggtgactctagaccctttcaaattaacaatcaatataaacctagtcataatcatttcaattgattttatgctctaataatgagttatgatccagtttgaaacagcaccctggctaacttgaataggatggaaatagttcagcatgacttcaaaggcaggagagtcttctgcctatgttacagctacagttgctgatgctgttgttgtaggtgctaagtggacagtttgatagctagggaaaggaagtggagaaatggaagaaggtatctatcatcatggcttggcagaaaccacctaacttcagttgcgatatcccaagatctcccgctctccttcacactgacctcctgtctgctccaaccctttgttctctctgcacaggatgacaacagagtacccaagccactatggggaagacatggacatgatttcctatgactacgatttttatatgcgaggagcaacaaccactttctctgcagtggaaaggtgagagaggtaacccctgtccagtgatctcagggctggaggctgtgcagattcactccttgctggggtcctgactgtggggtcttttacctgatgaccccgataatctagtttcctacttagtcaaggattagctgtgggtttggttaggcggcgggaaccagtgagaagtgagaattcttgggaacttgcctcacaaggcagtgtgaccttgccaagaaggacagagaccaacctactgaagtaccactgcagccgtgaacttggcatgggcattccttaatgtcctaaacaattcctgcagtcagcctcagacactgcttgcatgccaaggaaaggttgannnnnnnnnnnnnnnnnnnnatttcctatgactacgatttttatatgcgaggagcaacaaccactttctctgcagtggaaaggtgagagaggtaacccctgtccagtgatctcagggctggaggctgtgcagattcactccttgctggggtcctgactgtggggtcttttacctgatgaccccgataatctagtttcctacttagtcaaggattagctgtgggtttggttaggcggcgggaaccagtgagaagtgagaattcttgggaacttgcctcacaaggcagtgtgaccttgccaagaaggacagagaccaacctactgaagtaccactgcagccgtgaacttggcatgggcattccttaatgtcctaaacaattcctgcagtcagcctcagacactgcttgcatgccaaggaaaggttgagatggctggaagggcattcgccctcaaactggatccccttctagtcctgtgcctttgtgtgctcctcacttagaactgtaggaaaggaagagaagaaaagaagaggagaggattcacaaggaagaacacacaaaatccattctctcactacattcagtctggtctaatgcaacatttgagactagacaacttataaaagtcagaactctactgtccacagtcccagagacttggaaattcaagttcaaggaagcagaagatatttggcaagggctgatctttgctttgaagacggaccctctcattgtgtctccacacagtggaaaatggtcttactgcttcagtttcttgagggctaggattacaagcatagttggtatacccactaccacctcgggtttccaatctaagcacagtagattgtgaggttcctgcttccctcagcacatgctcatgcttggtgtgcatgcacacttccccgtaagtccatttgaaaagcaggatatttagggttgttagagggaggggagttgccaaagcccatggagctagtaagcaattcaatctcccatgatctcacccctacccttatacaacataagctgttgttacaaaggcactaatacgactcccaaggacagcataattttacataatcagcccccaacccttacctcttagtactacttagttctatgattactttagacactagtttccagcacacagattttataacagacattaacatgcagaccacagcatctaactaatcatatttagaaatgaaaagggaggaaatcattatgtgatgaagtcagaatatttctggagtaaaaagacgacctaagtaactcaagaaggaaaagcactaagttgcacttcggccctgcttctcccctcattcctttctgggcctctcccaaggacactgaaaccataagaaaagaagagtcaaaaaattcctgtagataagatcatcatatggctcttgtgttatctctccattaatccatgaaaaagtatggagaaatgcagaagttaagagatgagttgactagctttcactccatgataataatgtcacacaaaaatgaattctggaagattacccacacatgctttgcaaaccaaataaaaccgaaagccaatcctctaacgggctatgagctggagtcaatttgagtgccatctccttttgtgtatatgcttccaaagaaagttgcatttcacttagctgcagttaacttatttactatgaaacccacattttaaagacataaaaatagctgtggaaaagcacattgtcttttccaggttccatagacaaagattctggtttcttcacagaaggacaccacagttttcatatgtaactggtctctgtttgagattgggttttaacttacttggttaactgctttctaaaagccacagtttagaagaggaggaatactatggataaactcagccaatgaggagaaacaactgagtggtaaagatacttaagacgagaccaacccaagaactcaaagaatatggaaatctaatgtcattgagcaataaagtgtctgccaaagttcaggacacagtgccagtatcaagcattcctaaagattcccggggtaaaggggaaattggtcctgagttttctggttaaaaatataaaacaaagtggaaacattaaagaatgaatgactatcacctaaaattggtgctaaataaatatttttttggcagccaaaatggccaattctagctggcttggaaatgatcagttacataaattgtacagaatcactgaagtctgaggcttagtgtctctaaattattttaaaatgacttctgcctcccccagataaacataaaattagcataaataaaattagcatgctaattaattagttttgattcggtcttcaacaatcagtggtttggaaatccacagttttagtttgttcatttccattgaagatggggtgcttacccccaatcccattggacaaaaaccagctgagcaagggcttcccttctggaacgaagctcacttgtctatgtccacttgtgtatgggatggtttctcattctggggacagatcattcttccttgcaagggtctgttctatgattctaggtgttagccccacccactaagtgcaactggtatctatctacctacagggtgacaggcaaaactctttgcagccattaccaaatataccatggagtcacttagcccctagatgaaagctactgtctggcatggaaaacagaaccaaggtagaccccccttgattcttttaggaccaagtctaaatttttctcaacttctattaactgcctcttaaacttatatcacagatgcctggccacagggccttccttaccttcttcatgcatagatgcgcatttcttagctgtggtaattaaattcactctcaaaacacactgtaccagtttgttagtcatctaaagcaagccgtatcctctgtgggtgatttttacaagaacaaatatcaatacacatctcattcccccaggcccttaaagacatgtgccggagaacactatccccagtggcactgcataggacacgctagaaaaacagactcagaattagaaagcttgccttgccttgggctatttgctcaccatcccccatcccccaactccaaatagcacagtcatcccacatacttccttcccatccagaaaccagatactggagctgtcagccattggtgtttggtatacactggatcagaaatgagcccagcaggttcaaagagaaggaagaaggactgtactgtggaagaaactgctcagctgaatatggataaagtagttccactctttattgggattatgccaagagcatgacagctgtgtcctctggtggcattaaggacacctggcaagggaagcagcatggtacaagagaaagaccaatatttgagttcagcaccttcgaaatctgacagcatcacctttcactggttggtaatcccttaaagcaagtccgattacactaagcctatttcttcacaaaacaatgagtcacagtggggattactgataggacaggttgtagagcatctagtgcagggttgggcacattggaagcactagggacttcacaatgacaatggtcgctgtcatagttaaatagtatcagaccgcaggagtgctgggcagagtatataactccctgcattcccattaagtggttgaaaacaggacatggtcctaagcttagcaaacagcaggtatctgcaccatgttttccaaaactgaacagttctgtgccctctcaattttatcctatcacttaaataggctattccatttctgataggtgaggcattttcttttcacattttaaggtgccttgagtggtttcccactcaccttagatgtggtttcaaaggggaaacacacagtgcatctcctggagcctggcatatagagagtcctcaggagaaaggaaatattatgggaaattgcattaccttttagaaggaaaatagattcttcaccgtgaaatagaggtagtgctagtaaatgctgaacttgtgagtcctggatgttgagccatggaggactgaccaccagccatagtaaaaccctccatgtgccccattaccagcaacgggcaatccaacctcacagatccatcagttctctggagactttattgaaggtttctgagaacaaggtgagaatctccacagctccgaatcctgccaaagcccatcagtgcttttccccgggagccgctctttctccactcactgacatttccttttctggcgctcctcctacagggatcgccagtggaagttcatcatgtgccggatgactgactacgactgcgaattcgaaaacgtttaggctcgccgcgtacagaagtccgggtgaagggtcagggcccaggtgtcctgagggtgtcatatcacatatgttaatattgattagaacatctacacttctttcttttgctctcttccctgggatgggagctatggtgtcggctgcctaggcctttctcaccacgatcacacatataaataaactcacaattaagccatgtttctccctttcaacacattccaagacaatcatgtctagttgctgatggcagcttccttgcacagcacatgtacagagcctgcatgcttacagcctgccacccggagcacctgtcgcagccttgctgtgattcgcactataacttgagcttcagattcagcttcgtgaacttggagagaaagaaggagcttgagagaggtgggataaaggttctctgtagccaagtctgtttgagtgacagcacctagagacctcacctggggtggtggggggtcactctctgtcttgagggaacacgtctactctctccttccacaaaagccacatagacttagaagttcaagtaaagatctatgtgcttcagaagagaggggacttggaggtgaaagggggaggtgagagggtttgaggactgagctgaaagactttagacagaaagaacgtcctctattcaaagatatacaccagcagacccaacagtgagaatgaatatgagggccaggaaaacctgtgcgaatcagtctcaagacagaaacaatgaaagaaagataagtgaatgagattcacattgggaacctggggagacaagagtggtcagaggagaagagatcttgggttatcagcagcttgagacacacccagtattcatatgaagactgtaatatccctagaagccatagggacgccatctctggattggtcctgaaggataattctccctttcccatggcacttgaaagtgtattctgcagagatgacactgtaatatctctgtctctagccatttgtaccttcttctttaaaaaaaaataaaagtatcaatattcactgtgccataaatattaaaggtcaatttgtgccccctatgctccccttttgatcattcattaacccattctgaaaatacagcttcacactgtgatttgtgaggaggcttgaagactatcatggtgggagccatgtgagatgattggaggaatcagatcattagaacacaaagttcagagtgctcctgtcaccgaagggtcggacaaaggatggaaccatgtttctctggctttagatctagctctttacctgctatatcacatgaccccatctagcacatgaaattgtagctgtaggaaactcatagctcctttatctgtatcacttgcttattaactgcttcagcttctccctgaataggcccaggaaaggcgctagaagaggaaagccccagtggggacactttgctatataccccagggaaatggtgacatagaacatctcagccaacagtggctgcctttccctcagtaagctcccagctttgggatgggcaagacagaaccaaagatggcttcctttgtctcaattcttaagaactctttgataacatctgtctgctgagttccgctatttctttgctgctgcttttctgcagttttaatttataaggagaagttccctggtgttatttttcacagagggtgccattaatattttagcaatcgcagcactggtgcaggatgacaaccaggaagtggccttagctgggttcatgtggagcccagcaggaagggagacaaaccatgcagactggctcactcagtagccacatccctggcggcaacaaaaaactggtaggaggatgggatgtgggggtgagaggcctgtggctggaggagctgtcaggagactgtgaaaagcacaagtcaaggaaagaacagaaggccatctagtaagaggagaccgtgccagatgaaataaaaggggcttttacaaaaaagaaaaaagtaccctttgtgtgcaagccaaggaccatgacaggaaagacatcttcagcttggtttggttatggatcatttacattttatattatctgtcaatcagcacaagagctgagcctccaagtaaggaacaagttccagacctgacgatgagtcttgggtctcattgctccgttctttctactaaccttctctactgtcttggacacaaaactaacattttctaggccagctgtctaaaatgaagtcatttatttaggtcaatggttctcaatcttcttaatgctctgactctttgatacagttcctcatgttgtggtgacccccaaccataacattatttgcattgctacttcatgaatgataatgtaaatatctgtgatttccagtggccttagatggcccccgggaaaggtctattagactcccaaaagaagatccactgatccaggtgactgttacatttcttgcagctttaaaatcgtctgcactctttcccaaatggttgataatgggattcctgaggcaatctctcctgagtaaacagcctggcactgtgacagaagacctaggccctaccccagaatctggcagaatagagttatacatctccaaacctatgttttcctgtgtccaatgaagaaaaaaaaaatccctttcccaggaacctcacaagatgctgccacttaaagcccagtgaatagcaggagagacaggagattcccacttgacaggacatgtgtgtgctgggaaaacagagtcaaagcaggccagtgaggcagaaaggggaaactggggaagctgagtccagatctggcatcgatgaatgaacagaaatgctatgggctatggatatcagccctgactctgtcagttcccaacatcatcatcttggccaagttagccacctttcttgattctatttccttacccaaagagacaacaatatctccatgatggacttgatatgaaattaaacgcaatcacgtaatgattgacctgtaagaccacagtaaatgcagtacaagtagggaagagtgtgcacacacacagaggtataatttctcagaaaacagggtcttaaaagaaatcatatcaatctttccaatgacaggaaaaccgagtgggacttagatttgtctctcattcattcatttggttagttactgaaacaatgaattattatatgcttattataagccagctgctgaataaggttcccatagtttagactctaaaatattgaggatgatgaacaaaaattgagagaaacagccttgtggtatagtggtgagcatagtcaccttctaagagtcaggaaaacaaataaaactctatagttccgtttcattcatgatgatgggtgtaaagcaatctatgaacttaaagagaatttcctaaggaatgggcctcgccaacagggtcttggagtttcatcgtatagccctaaagctatgagcaagaactgatagctcttgacaacaccataaagcatgccattatttgtgcatgttattgaaatttattatttttcctgaactcttggatatctaaggaaatggacggacacacacactcaagaaacatcacacacttgtatgtgcacaatttctccgtgtgctcccttcatcctgcctcttggtccacacacaactgtctttaggttccacttctttgactcagacataattttgacagaatgaaacagggaggacggtgggggcagggagaaactagaataaagtacgatacatacatatgaaaatgccatgatacccttgtattgtgttccaacctcaaatatcgtgtggtatatatttaaaacgatgtctgtgatggctgagagaagaggtagtcagtcttcctcaagtgtgagccccctgattagcttcccaatactaagtgctgagccctaaacacatatccatacaagcaacactagtggactcattgcagcggattgtatttatatatttatgtgtgtgtatataaatgtaacaataataatttaagaaaaaagaaaacaacagtaataataaaagtagggggacttggagatacaggaaggggaacagagggacagggaacagggtctgctaataggggattgaatgagatcaagtattctatactcgtgcatggaatgtcacaaggtaggtaacttatttgtgcaactttaaaatgctagtaaaggtagaaacagatactgagactcgagctttccttaatgcctccagaagaattacagaaagaagtaaaagaaagtaagagagacttagactactagacatgtctgtcttctgcatacattcttactccagcacctttcctggggcctctctaactccaagcctatagagtctctcctattcaccttacaaaatattgttctgtgaagtccacactgaagtgattattcacatcatggtggtccacagaagagaccaacattcactttctttataaagtctctctcagttttaattaaatcatatcagcttagttttgtttattgaaactgcactgttagggacttgaacctgagtaccttcctggaagtcagtgaggagggggaaggggaggtttttgcagaatctgtgtatactggctaggttttacatcaacttgacccaagctgagggagcctcaattgagaaaatgcctccataagagcaatctgtaaggcattttcttaattagtgattgatggggaaaggcccagtccattgtgggtggggacaactgctggaactggtggtcctgggttctgtaggaaagcagtctgagcaagccaggaagcagcatccctccatggcctctgcctcagctcctgagtaccagcactgagttcaagtcattgtaaggaacgattatcttttcacacacagccatgactgtcatgagacttgaggcttttcacaagcttaaatctgaaaaccaagcaaaacgctattgattgtaaaatgtacctaagagatgccgcggggcttgccaactcttcacaccctccactctgtgggctctttgctcttcttaccttacatacctgtgagctcagttcagtaagttataggaaatgctgaatagaaggtctgcaaaatgcagggctgtgtggctctgtggatgaagggcttatccagcaagtaggaggacaaaagctcagattcctagaacccatggaaatgttgggcaggcatggctgcatacctctaatcccagcacttaggtggcagaaacagacagaggataactggaacaaactaagttagctacagaagctggtatcggaaagatccaaggtcagtaagagaccctgtctcagtgaagtggagaagagctgaagaagacacaaaacacctacttaaggcctccacacacatgtgagcctacccacatgcagacatacatacacacatgcatacacaccatacataaaacaccgaaactgcaaattatgatattccttggaatgtagcaatactgtgttgccgtgatttgtacatagctttcttccttctccagttaaaacaattagcatcatgtttaccatcaaaataagagtaattctaaatcttatgagacaaaagctgttactggctgccgtgcagttcagccctaggccagcgttccggctgaaaggcaaccgaaggcttcacttcatggaaagaatgagattatagaatcccagaccctttcactttaccagctgcctagtgggctgtaatttaagatgcagaattacctgcctcttccaatgtttctcaccatccccagagagagcagcagatgtgctcagcctgtcctttggccagtgagaaacactgtccctcggtctgctggtaacatttaaggtagtaactagaaaccctttctctgcttcacccaagttcaatttctgaggacagactctgactccttataccacttttctataccttacaaatctcaagtccttccctggggctttggtctgctgtccttgccttctcttcatctggagaaggcactgaggagatttcatagaacatacatcctttcacaagataaaaacagccctaccccaactgcaaaccaactgaaaagtcttgataactttaaattgtgccacggaaccctgctaagcacttgactttaccacaagcaacctctttcctcttctaccgcactgtaagcctacacacacagaaggagcctagcaacacgaccactgggaataataacagtcagaacgtgagtctagatcgtttttactgggacgatctatcagtgttctaaacaattttcattgaaaattgaagtctgaacagtcttggccattatgcggttttattaagagacaaggcattgcaggggtactacggttctgggggtccgatgcccatctcttactcccttccagcatcattaagtaatgataatcattcatttttacccctttagaaactaaccactaatgataggtgagttggaaaacatgacagtctctctgtcacacaattggaaagcttatgccactatcctaagtaattgaatgccattttttttaaaaaaatgaattaaaagtcatattgaaatgagcatctgagcagcttttggtggagatgagatcaaacctcactgactaatcccccagtagactgcagaccgagggacgatggggatcaggctgacagatggttgatacacagtgaaaagatgtctgaaattaactggacatgtctgtgtgttagggaaagttggagataatgccacagaagtataaacaagtgtatcaggagactggaggaagggacaggggaacctcaataggattcttgcagagaatggtgtgatactggttctggctggtcttggctggtcttggctggtcttggctggtcttggctggtcctggctggtcctggctggtcctggctggctctgtggagggaaagggatctttttctctgtttattttcttgttatattgtttggtttcacgtgtgtgtgtgtgtgtgtgtgtgtgtgtgtgtgtgtgtgtgtgtgtgtgtgtgtgtgtgatttctctgctcccacattttgatggctggagttacaggggtgtacctgactcgtagcctggaacttcttacacagagaaaaaaggaaaaatttcccagtcacaaggcactcgaaggcaccattgctacctgtgttctgtatgtccagtgctgttagacacaccacaaacgtggatttatgcaacgttgctaactcaaaggaaatattcatattcgctttacttcacccacttgaaagtgaagtgttgggctaggtgtctgggttctctgagggatctctggctcaaaaccacaaatcaccctacaaccaagcatcagattcaggtaatatctgaggtgtgcttcatggccagagactccagcattatacaagagccacattaatcaatccaccaatgttttgtgtctgtggaactctttgttggcagactcacaggtgagttcgttagccagtaccctgtggagagatgttcttggaagccatacatgccctgtgtcatgcctgtcttccccctccccccacaacaatgtcatgcagattggttccactcacaggcttccaggaggaaggacctggaactctttcacagtgtaaaaacagtatagtctgagctggagaattcacaaggggtaggcaggttctcatgggtgaaccttgagaaaaattcactacaaaggcagagggattaaagaattggaaaatacaggtgaaactgtgcagtcaacccttcccacacggaccctgttctaaactgacaactgaacacgagtgtgccctcgtataacaaatcacagcaagatgtcactcattaatcacttctgtgtctcctggttcaaactgaaagaggccagaaagcacatagcacacttttttatttcttgcagaaaaaaaattttttttaattctaaacaaagggaacaaggagcaaaacccagaaaggttattgaatgacagaaggctctaggccactaagcatgtaggaatgaaacatgggtgactcgtggtgtttcagaggcaggagggtctctacaagctcacggaacaagctcatggacagatgacaacagcccaacgagtgaaggaagaagggccgtgccaggaactgaggtgcttgagcaagctaggggagggagggaacgcttcaagcttgtgaggggaccctcttgcctcctgccgccagctctcaggtggaagacaagtgggggaaatgatttatttaaaatgtagggacagatctagcaggcaaatgctccatacagactccaggggtgggaacacacatctctatacagccaggagtgggaacacacatctctatacagccaggagtgtgaacacacatttgtaacctagaacttaggaggctgagagaagtatattacaagtttgaagacagcctaggctatatacctagatcctgtatcaaaaaataaataaattccatctactcatacataggcaaatgtatttatacacaaatacataatatatacatctattaaaggacaatataacgtgcaagtccctatctggtgggttagtttgtggcaggagaaggaagcacatgcattttttggtgtttgtgccctatgatctagctgcccttccatctaatatagcatctacagaaaggtaggcatttataaaaacagacccccaaatccttgaagtaggagttaacctgcccaaactcacacaccagtgtgaatggacttgaattcaagacaagtggttctcaaaactcagctggttctacagtaacagtttggagttgagggaatagagagagatactgtttcaaactattttgcagttccatggccgaacacacaatagaaaaaaatgattggcatgcttattttaatactgtaaatgttttccctggagagagagagagacagagagagagagagacagagagagagagagagagagagagagagagagatctggtgtggtgagattattaggagaatgttgctgtaggtttacagagccagctgggtagtctgcaaatcggaggtatactcccctggtgtttcacatttccaggaaccttacctagcacaacaacactggagtgattgaacatctttggtggcagtcctctgactgtctgccttctaagatgatttctgataagaaatgagaaactcactgtgaccctgacaagcagaattcaacaaatccaatgattgcctcaataattgcctttgcttgactcctgggccctctgcacagactcatggccgtgttcagctttgcagcatgggctctgagaatctttctgcctagagaatctgtgtgctcagtagactccgctgtcttcatagctgatgagacctcaggatatttagtcctttggcagaagtgctgttctgtcgatcaaagctccaacccttctggctccatgatgtgctctcaagcttatcttgagcacacaggctacctacaccataaaccgcatcgatggcttgtatttggtagttataatagagtctagacatggaagttaatttattacctttaattttcagagaagaacctaaagaagggaaataacacattcctgttctattagacacagtgagaaattctcttactccatatgagacggtaaggaaagttacaatagtataaccttacggtcctttcccatggggccattctctgtggtcattgtagttaccctgaggtcataggcagctttgcccacactggcctcaatgaaatcagagcaggtctttcctatggctctggaaatatgtaacaaacaataatgatgacaataactaagtgcttttgcacctacaggaatctcacctggatactcatagtagactttaaagatagctccgtcgctctgttttataaggaggaaattgagaatcactttctttctcgggaatatatactgtacacattggaacagaactcaaactcagacctggatgaatataaggcacaatatgatagtgtttcctttactgtcctcagactccagtatagacggtgccatgcttccttctttaggtcatgccataggctccttgggttactgtatctctcctcacttctggcacagtcacatgagcatcaaatcaactcagcttcaaagctcatctaaaacttaagagccagtagtctttctctagacatggacacacacacacacacacacacacacacacacacacacacacacacatgctcatattatatatatgatattcatattaaagaatcacttaagttgattggactctggagtatagacactttattaatctactatctctcatcctctttatttgtattctttccttttataaccttacactgttgtttttatcttcatgttcccaaacatttataccttctgtgccttatagcttttataagctatagcagagatcaaagggaaacaagtagctattcatcttctaccttttcacagacccacacttaacctcctcactctatctgaaccctgccttgccctggaatcctcgtgagtacagtttgtatgcatctgtgtacatctggatactgtggggtcagtagttactgcctttacctgctaaggaattcctgcatggagctttttattgtctttcattgcatctcctgactccttctcatctccaagaaatctacccacatgctggaggaggagccacacttcccctgtgctaatcctcatgcctgggagcctctcacttcacacttttccagcatgagtctcagagctacatttcctggttcccgaggcaaattaatagtccctcgcctgtgccaccaaacatctggttatatcagcttggtcacaccttttcattttcctgtttggagagatattaaatgttctctttgttggtccctttgtacccagtacacagaatatagtaggtattcattaactaacaaatgtttaaagaatgagcaatgagagtctgtagaattgtggaaaataaaaagtggagcccattcattttttgtcccagactatgacaacaactttctgtcta

SEQ ID NO: 1392 - DNA, 1647 bp, Mus musculus
atggacctcactcttctgtgggttcttctgccactggtgaccacagcctggggccagtatggtggctacgggtacccataccagcagtaccaggactacggtgatgatggatgggtgaatcttaaccgccaaggcttcagctaccagtgtccccacgggcaagtggtggtagctgtgaggagcatctttagcaagaaggaaggctctgacagacaatggaactatgcctgcatgcctacaccccaaagcctgggggagcccactgagtgctggtgggaggagatcaacagggccggcatggaatggtaccagaagtgctccaacaatggattggtggcggggttccagagccgctacttcgaatcagtgctggatcgtgagtggcaattttactgctgccgctatagcaagaggtgtccatattcctgctggatgacaacagagtacccaagccactatggggaagacatggacatgatttcctatgactacgatttttatatgcgaggagcaacaaccactttctctgcagtggaaagggatcgccagtggaagttcatcatgtgccggatgactgactacgactgcgaattcgaaaacgtttaggctcgccgcgtacagaagtccgggtgaagggtcagggcccaggtgtcctgagggtgtcatatcacatatgttaatattgattagaacatctacacttctttcttttgctctcttccctgggatgggagctatggtgtcggctgcctaggcctttctcaccacgatcacacatataaataaactcacaattaagccatgtttctccctttcaacacattccaagacaatcatgtctagttgctgatggcagcttccttgcacagcacatgtacagagcctgcatgcttacagcctgccacccggagcacctgtcgcagccttgctgtgattcgcactataacttgagcttcagattcagcttcgtgaacttggagagaaagaaggagcttgagagaggtgggataaaggttctctgtagccaagtctgtttgagtgacagcacctagagacctcacctggggtggtggggggtcactctctgtcttgagggaacacgtctactctctccttccacaaaagccacatagacttagaagttcaagtaaagatctatgtgcttcagaagagaggggacttggaggtgaaagggggaggtgggagggtttgaggactgagctgaaagactttagacagaaagtacgtcctctattcaaagatatacaccagcagacccaacagtgagaatgaatatgagggccaggaaaacctgtgcgaatcagtctcaagacagaaacaatgaaagaaagataagtgaatgagattcacattgggaacctggggagacaagagtggtcagaggagaagagatcttgggttatcagcagcttgagacacacccagtattcatatgaagactgtaatatccctagaagccatagggacgccatctctggattggtcctgaaggataattctccctttcccatggcacttgaaagtgtattctgcagagatgacactgtaatatctctgtctctagccatttgatccttcttctttaaaaaaaaataaaagtatcaatattcactgtaaaaaaaaaaa

SEQ ID NO: 1393 - DNA, 606 bp, Mus musculus
atggacctcactcttctgtgggttcttctgccactggtgaccacagcctggggccagtatggtggctacgggtacccataccagcagtaccaggactacggtgatgatggatgggtgaatcttaaccgccaaggcttcagctaccagtgtccccacgggcaagtggtggtagctgtgaggagcatctttagcaagaaggaaggctctgacagacaatggaactatgcctgcatgcctacaccccaaagcctgggggagcccactgagtgctggtgggaggagatcaacagggccggcatggaatggtaccagaagtgctccaacaatggattggtggcggggttccagagccgctacttcgaatcagtgctggatcgtgagtggcaattttactgctgccgctatagcaagaggtgtccatattcctgctggatgacaacagagtacccaagccactatggggaagacatggacatgatttcctatgactacgatttttatatgcgaggagcaacaaccactttctctgcagtggaaagggatcgccagtggaagttcatcatgtgccggatgactgactacgactgcgaattcgaaaacgtttag

SEQ ID NO: 1394 - DNA, 52661 bp, Homo sapiens
aatacatagaaaattgtgattggaataagggctctgagggggtttatgcagtcctgtgagagtgtggggaattttctgatctgatacaaccctgagaggttcttcattttgagagcacaagctttgttttataacaggcttcaaaacagatcttctctaccagctggataaccctgggcaattttctctctaagcatcatcgccctcacttgtaaaatcgagaggatgtgtctttcaaagagtatggagatgacattcaatatagtggatataaaagtttgtaccacagttagacctactgatgtaagcatgcaggttagcaagatctcactttcctttgctcaggaggatctccaggcccagggacaacatggcctagtgggaagcctgacacacacataaggacaaatcagagggattcccagttgattttcaggagaagggttacctctgacttcctgaagggaaatggttacagaggtgtttggatggaatgatattagagttaagggtagaaaaatggtggaagtggtgctggctttgcattgaagagggaagcacatggatgcttcccaacatcacacagctggggaggactttcttctccccatgagcacctaaggaccacaagaaactggagacagatgcccagtgctggagacagtcacattgtttcaggatcttccttggatcaaatccagacagttgttccttatatcagtcaggtcctggcaggaaacaggtccatattcaacagtagtgactggagagaattaatgaaataactatgtacagagatgtgagcagggttaattgtgaacatcccagggccagctacagctataaaccacggtaagatcacccctatagtcttaaagctgcagggtgagggagtgaggttgctggaacctagcagaagcatttcccttggaaagggggccagccagcaaaagctaaggctgcatggagagaaacctggccactgccaaccaggccttggtggcagggagccaggggaattcatattttgacccctctcctgatccttccatattctgctggtgcctctcattggccaagcccaagcaggaaccagagggcaagagagcaccttaaggtagcacataaagcctcctagaacacagtgcaggaaagagaaagatctgaaaagtaaatagggaatattcagtacatccccttgcaaaatgacatctgattgttttttgtaccagcagtaccaggctctgttccaagcacggtacatttacatgtattgtctcatttagttttcctgataaattaaagtatgtgcatttctatttgagtgcatgtgcacgtgcatatactctgcagggctttagcaacacagcaaagatgccatagccccgttggtgtctttttcggctaagccaacccactgctgtagagagttgaattattttggtagttgttaatattgcagcattttaaaaagctggggtagaaaatagtactcattagtgtgcagcgtgctcagctccaggctgttgacaggcatgagaagaaggctgagctgctgcctttcctgcagttctcagttctgctctgtcactgcctgtgtgggtggtgtgtgacaggaggcaagtggtgggctccctgagagcaggattagggtgcaaagcccttagcagagcccacaggccacagagccaggggagtatttctactgtaaccaacgacagggtagttggcagaggagccctgcctggttctgcctcatacttgggaagcttacaaaatcataaacatccttatgcaccttagcctgtggttttacacttcgggatgcataaaagtcatgtgggaaagctcgttaaaaaggcagattccgcctgggcgcagtggctcatgcctgtaatcccagcactttgggaggccaaggcaggcagatcatgaggtcaagagatgaagaccatcctggccaacatggtgaaacctcatctctactaaaaatgcaagaattagctgggcatggtggcgcgcctgtagtcccagctactcgggaggctgaggcaggagaattgcctgaactgggaggcggaggttgcagtgagccgagatcacgccactgcactccagcctggtgacagagcaagactccgtctaaaaaaaaaatggcagcttccagggccccacctccaggattccactgaagcaaggctgtcaaaaactcaggaatcttcctctaacatgcctccatggctgtgatgcaggtggtctgtggacctcacatgtatcaatactttggggtgggtgtgtgtttttagagctgggagagacagtatgcttcttaggtgaccaagtccattatctgaagttgatgtaccgtgattgaacaatgccgaaaagaggtgccaatctgtagcttcaggaatgggagcaagaatgcgtgaatcttggttaaagagcaagccgagcttgatcagaggaagcagcacacagaaaacgcactggaggacggcaccagcagagatgtcctgtatgggaggatgttattttcagggaggctgctcctcctgctaaagccctgcccccaccacctgccttcaggattgtaggagggaaaggcttggacaaactgtgtgaactggcaaagtgctctagaattggccaccttgcttccctaaaggatgtgtcaccaaatccctcaatgccgtgtcctccaagagaactggcagggctcaaactagggaactttggcttatgcccaagccctgtcacccaatatttctgtaactttggacatcactgtacctctcaaagcctctatttccaaactgataaaatggaaataagaaagccaactttactaccatcaccaatgcaaagatgaactgagatctgttaaatccctgcacatggaaaagaataaatatttattgagtgctggattgtgtggtttatatacatcgtgccaaatgctacacaaatgaaaggggctgttatttattttataaactttaggtttacccacttaaaaacccaatttcaaattagaaaatttggcttaaaatgacatcacttaagcactttctgattaaattgttttctttcttttcccccgtttgtaaccaaatctctccaatgaacctcctcctgcgcttttttttaaccatggtctctagcgagtcatgagctcagaggttgtaaccagtatcctgaactctgttcctccacttatgagcatataatacatttactaaagcaatatttccagcacctacacatacatctctgtgcttcattcatcctcacagaccccagaacactaattaggcacttgggccctgaagcttccttctgtgagtgtctcagagctaacttggcttagcagcaccccatccccatccccatccctactctcaccccaagacacagtcctggttcccaagctcgcaagttcccaagcttcttctccaccacgatagctcctccatctgcctactgttcccaagcctcctgaattctctaccctcactctgcctttagtgctcagccctgttatcctgacacctctccctgcaaactcactctcaggaacctctgcgattgacattcatccacatattaatggaactccagagagtggtggagccatattcccccagctttactcattcccaaacccctccagtcatcatctgcacaagaacactcttctgccctgcggagtcctggggctgttcattacactaatatgcatgattgttccctcaactccagcttctagtgttaccctgaggtcagactaacaacgtacatttgtttcaagctttacacttgacaaagtctttgcaagaccactatttgatatgactgtcacaataatctcgtggtaagtggctggtgttgtgattatcctccattttacagatgataaaacaaaggttatgggttttgtctgattcagtggttctcaaccagagatgatttttccctccaggagacatttagcaatgtctggaacatttttgattgtcacagtggtggaagagaagatgctactggcatctagtggatagaggccagggatgctgtccaacatcctataatacacagggcagccagcctccacaacaaaaaactatctgacccaaatcaaaaggtcattttgattacttgcagaaccagaactttaacttagatatttggattttaggagtctctgctcttctcacaaccatctgccactgctctgaggccctgctgtgaccatttggcacttggggtagtatagttactaacaaattcaagtcacctttctgtactagctgtgaaaattggggtgagctaccagtgatctctgaacctaattttcttagaactgctggaaggtcaattggtctatcatatgtaaagcacatagtacagtatttagcacacagtaggtgcaccttattctactcctcccaatcttctctatttcctcaacttggattgtcactctttctcctgctgcttccagtatgagcatttttaaccttattggtggccctcggggctaaccccaaatgatatgacagtgggttccacaaatgatcttaaaaagcaatgggtcatgcaagggtggcaagtttgctgaaggtgaggacagcctgggtgtactgaggctattgaatgcctctctcagctaaaccgtgaaactggcacagactcattttggaggaaagccacggatggctcagcatacacttgctgggaagtttgtgatagtactctggccacctagagctgcagccaagtcctgattatacacaggagttaaaagggaaaaaagacagcaggcaaaatggaatcctccaataactcacagtcaatattttgggttaagcatccattcatctggggctaccagcttcacccaggcactagcatgagccttgccttctcctgtctgagcagccctcctcggggccagctcgtcacatctggaattctccagtggatcaggtctgctccagggtgacctctgtaagtctacatcattccctcccaatatacaatagcagctaccccaatccagaaagtgtaaaagtaacttaggaatgagttgattctagggccattctaggtgctctcaattaaaatcgggcaaagtattatattcagaatctctcaaaaagggattatatgtttgagaaagctgccagacaggagtggatccaggtcgcaaaaagtgtcaccagagtggctatgagttcctacacctttcagaagaacccagacttaataagcgttggtgaggatgtggagaagaaattggagctctcatacgctgctggtaagaatgtaaaatggcacgattgctttggaaaacagtttggcaggtcattaaaagattaaacacaaaattaccgtataacccagcaattccactcctgagtatatacctgagagaaatgaaaacatatgtccacacatatacttctacatacatgtttgtagcaacactgttcataatagccaaaaagtggaaacaactcaaatgtccatcaacttgtaaatggataaataatatatggtagatgtatactgtagattattatctggcattataaagaaatgaactagtgatacatgctgcaaaatggatgaaccttatgaaccgctaacataaaacctatgctaaatgaaagaacctattcatgaaagaccacatattgaatgattctattcatacgaaatatccagaacagacaaatccatagagacacaaagtagattgattgttgcctagggctaaaggatgaagggaaatggagagcgactactgatgtgttcagggtttcttgggtggttaaaatattctaaaattgcttgcggtggtggttgcataaactctgtgaacatactaatttaagggatatattgaattatataccttaagtggtgaattgtatggtatgttaattatatctcaatacagccgaagaaggaggaggataaggagagagaaaagaagaataagaggtagaagaaaaagaagaatcatggagacttttgaatgctctttgtcagaatctccaaaatatctcaagtccattatctactaggaggtaagatagcccagtggtgaattgtgtgggcgccagaatcaaaattagtgaactgagttatctaggcttcagtatcactacataacttctcgagaagtgacacctggaatttgggtagagtgttctgcattatctgctatacggtaattctcactttagtgagtatcaagttacctaaagggcttgttcaaacacacattgccgggctctactcctacagtgtctgattcagtaggtctgagaggggccggaggatttgcatttctaacaagttcccaggtgacgctgatgctgttggttttagagcaacaccccaaaaactacttattgaacatttagttctttaaagtccccagggtctattgagtagacttttcaaataacagcagaaatgcgtagcgcaaattagttatatgtgtatgttaatatacatactttataagtgcattatttgacaattattcataaatgttataattagtaactgtaactttgatgaaatgatggaaggcattgcagaatgggaatcagaagacatggggtcatatccttccagttctagaaatttggcccaaaatgttctctcaccacagtttccccatctgtgagaaactaattccaataatgcctcactaacatataaagttatgaggaagataacatagtaacctagttgaaaacacatggtcaactgtaaatgcattaatcttatgttctcaatgtctgcgtatggaaatcattctctatgcggccaccagaatctctctcaaaggcatcagcagtttctggaatctcctgagacactggatgagttaggttgctttcagctttaagtaacagaaatctatattaaaactggaccatagcatgaagatatttatttttgcacattaaagggaatccagctgaggtagttctagctgtagttgaaagaaatctgcggagagtggagatcaggcagaggccctggaaattgttggaaaacaaatgtataataaagatgagtgtttatgataatctgctttgtctcttagagctctttaaggtttaaaatagctcatatcatgtccagaatgcaagatacaactcatgagcatcaggatgataaactgaaaaaattaaaaaaaaaaacaaaccctctagcatagaggttctcaaccctggcttccggtgagaagcctatagggaaggtttcaaaggacgtcattgtcaggaccctgctcagaagcttctgatctgatttgtccagaaattgcttagactctggaggtttccaaaagctttccaggtaatccttaaatgctgataaggtggagaatgattgcttcagcatatcatgaatcagagagatccttctaagctaggaagaattccgatgccagcactgggcagttacttacggatggaagtggtgggagaagatggtgctaaaaacaaaactaagcctcacatagctgttcagcccagatcctctccccctcgcttcagtaaccatgatcatcaaagaaaactgcatgcccaacacacacacaaacacacacacacacacacgagttacttgttgctttattctcatgtatgactgtctttccctttcaagactatcttggtgtttgatctagactgaataccgtctggtaaatgtgccacaggctaggcagatggtgggattaatagtgtgatttttctctggctccacattcctttaggaaggtgactcttagcaattgatgtgaataagaatcacctggaaaatttttcaaaatataaatacctgagcaccccttgtgaggttatgatttagcaggcctggagaagagccactgtctacattttagcaaacttcacagaggctgtagatagaattggtctatgatcacaattctaagaaactttaagaacaatactgatgagaaatgggaaatactatgtgcttaagagatgcccaaaggtttcaaaaaatttgaaaagccaaatcatcaacggatgcatggaatgggtaatgagcacatgaaaagatgctcaaaatcatggatcattagagaaatgaaaatcacaaccacactgaaatatcactacaaacctatttgaatagctaaaattttttaatggcaattttctggtagtggtgggcaatggtatcaccactttggaaatcagctaggtagtttcttgctttcttttttttttttttttgagacggagtctcgctctgtagcccaggctggagtgcagtggcacaatctcggctcactgcaagctccgcttctcgggttcacgccattctcctgtctcagcctcccgagtagctgggactacaggcgcccgccactaagcctggctaattttttgtatttttagtagaggcggggtttcaccatgttagccaggatggtctcgatctcctgacctcgtgatccgcccgcctcggcctcctaaagtgctgggattacaagcatgagccaccacacccggcctcagtagtttcttttaaagttaaacatacattaccttgtgaaccagcaatctcactcctaggtattgacccaaatgaaataaaaatttgttcacacaaaaacctatacatagatgtttatatcaactttataattacatttatgtaattcattatataaaatataatgaatataaaattcattacataaaaagtaatgaattttcaaaaactggaaacaacccaaatgtctttcaactagtaaatgtataaacaatctgtggtacatccatgctatggaatattactcaacaataacaagaaacaaaatactaacacatacaatgagatgttgaattttaaaatggatgaaccttaaaagcattatgctaagtgaaagatggacatgaaaggctacgtgtggtatgattccatttacttgacattctggaaaaggcaaaaccatagagacagaaagtaaatcagtggttaccaatggctgggtgtttgggaagatttgactgcaaagggatataaggggatgttttggattgatggaactgttctaagtcttgattagggtgctggctatgttactgtacattatgtattttaaaaggtgaattaattatatgtaaattataactcaatgaaaagaaaattcaatgtgagggcaaaaatactgaaggataaatagggggtttatttagattaaacccattacattttgagagcagagcacactttctagacttgactgggtccaatttcagcagcatggtagaatgcttaagtgtagaaatcatatccaacttatctccccatgggcccatagtacttccttatgcaacttatgagttctcagagtagccctgcaaactggtatacccgcgcttatactcaagggttaaaaagtgttggattgacaacttaaaaaaaaaaacaggcattcagccttacagaaatcctagatggctctgttacttcagtctatgatttcggtattttgaaatcactgtctgggtatttgtgtggcccggaaggctagtttggagaacaaatacaggggtttgctagtagcgggtagggtaggacagaaaggggtgaggtgctgaaaggtgagggacaaatatgctactaatcagtgtttttcaagtgaatatttctacagggtagagcagcagttggcttttataatctagatacaaagttgttctttctccagggagcttcttagacttacatgctgctggtatattcctagaattccaccttaaaacaagctgaatgtccttatggctgacatctcagcatggaaaagttttgcttaagcaatgacacactgcagttggatccttctcacccacatctggaagccacatgtcagcggcagctatataaaacggtcagaccagcaatcttagagtgacattgtttgccaaaatcccaggcagcatggacctcagtcttctctgggtacttctgcccctagtcaccatggcctggggccagtatggcgattatggatacccataccagcagtatcatgactacagcgatgatgggtgggtgaatttgaaccggcaaggcttcagctaccagtgtccccaggggcaggtgatagtggccgtgaggagcatcttcagcaagaaggaaggttctgacagacaatggaactacgcctgcatgcccacaccacagagcctcggggaacccacggagtgctggtgggaggagatcaacagggctggcatggaatggtaagggccagtccctgcactgcactggggctgggaacatctctgcatatccctcctcctgggggctgctagactctcaaggaatatcagtaaccaaagcctgggcaaatcccaccccaaacctcaccactgcatgctctgggtggagcagggctgctgctgagcagactacatgacaggacaaaaacctgggatggggagtgtctgtgggagacagactcctctgtggctctgttccttccagaagctgttctacctactctcagtttgggccaggggctggtgtaggtcggcgagaagcttgcttaccagactaccaaaagatatgtacagaaactgaaagtaataaactttatagaaattaaaactttctgtgccatcggaatggcatttttcttttttagaaatttatttttaccattttacaaaagtactggcccacagtagtttgggaacaagaaaaataaacaattgatctctcagcacggagggtttgagaactattgatttagagcaagtgaatggaaaagaggggacaaggacatttaggcaaaagaaagtggaattaaatagctgtctactgccttgattaaatgtgctctctcaattatgagtactgaggtccttctctctgcctgaatttaaagtgggttttattgctggaaaatagtttactaaagggttttggagagaggtgctgtcttcccctgactgcattctgccctaagcagtggcatggaattttttcgagcttgtacttttttgtggggtgtgattgtctcagctgggtctcagcccaggtgcttggtcaggagctcatcctagtaggcactgactgctaggctgattatttacaacagcctagatggagccagcactctaggaggcttggaggagagaacggaggaggcagtccagggaggaggaagcccacctggagggctgctgcatgtgctatctgtagagcaacccagatgtgtggcaacaagtacttagtgtagtggggattggaggggtcaagcacaaaatctggccaggtgtggtggctcacgcctgtaatcccaaacactttgggaggctggggagggaggatcacttgagatcaagagttcgagaccagcctagggaacacagccagaccctatctctacagaaaaaaaagaaattagcccggtgtagttgcatgcagcctgtggtcccagctactcaggaggctaaggtaggaggatcacttgagcccagggagtcgaggctgcagtgagccatgctcgcaccactgtattccctcctgggtggcagagcaagactctgcctcaaaaaaaaaaaaaaagaaaatagaaaaaagaaaaagcatagaaccctgggggacacaaccagtagagaggtgatgatgggaaatccaagaggaagaaacaccgatgggtgggggagccaggaaagagagcgggcctttaagtaatgacaacagctaccatttattgagtgcttaccctgagcaggctccatgctaagtgctttatgtggatcatctcgtgtaatgctcaaaacaagggtatatgccatttataggtagacaaactgcagtctagagatccagtatttcctcggctagaaagctggggtttggatccacagagtctttgcttcaaagagtttgtactttgccacagtgacgggctcctgagaggctgctgcctccacccagagtgggctcccacccgacagctgactctgtcagcagagccagtgccacaggaccagattcagggcagttcttcctcctggagagggtggggacctgcaagaccacagcagaagcccagccccagagggatgatccctacttggttaccaggactgtggaggggctcagccggactgtagaaggggtggggagaggactcacacaggcagcagcaggtgagggtgccggggctgtggaggctgcttggacagcctttgtgggccattctcatccacccccatggcctctggtgagcagatttagttattcaaaaccccttctgacagatgctgattcagagaccaggctcaccttgattgttgtctccatgactcctcacagccaggcccactgcctaatgtggagcatggcaatgacctaattacaactgtccctccagtcctcacctctcaggagcactatcgcatgggtgcgactcctttctaacagccgttttttgtgccacagtcaagcagcactcagccatggttccccaagccatagaggaagagccctaggctctgaatcaggaggcctgggtctggatcctggttctaatgacttgtggtgtgaccttggcccagacgctcagccctccagtctcccgcctcatttggaaagtgagcagtcaggctgcatgatctctgaaggctccacagagctgtggctcacccctgaaaacactcttggctttttcttgcattctgttgatctttgtgttcatccctgctagagagagaagccaaatgatgtttagttttaaacttgccaactgtgactggtttgtcatgaactcccaaactatttgaagaaaagcaaaagaggaagaaggtgaaataacatgattttatttggcccatgggagtcaagggaaaagctgataggcgagatacctcttccacctcctcttactcggcatttttgggtgtgcagtgtctagtaattttggtttcctttcctccttccaccctctgttgcctccttctccccgtctactaatcacagggttgaaaactcacaaacatgcaaaacaacttctttacaataagatccagctgccccaggactgacacgaattaccctggaagcacttttaaaaatgattatgcctttgagttcagcctccagtctcagtgaaaaatctgtaaggaaagaaattgcttatgggctggggagctattacatctgacgttggctacaggcttagtctgttctcagggaacagttgttgatggttttgtgcagttgggctgccttgtataaccaaattagctttcaggtttattttaaaagaggggaggagtctcgaatataggtttgacaatagcacataggatctgctaaaaagaaaatctttctaatcaaagtgccatctttaaaaggtgttgccatcatagctgagtggtctgtggtgctgccattgatcacagtttctctgttgaaaatcacctcttcaagtgccggcttctgaagtttggatgatggtctctggcactaacaactaccaggaggccttacctgggtccccatgagtggtatttcaccatcccagggcatgcctaggttgttctcagggaatctgctctaacttgggtcagcacaggctgtagggcactgggtcctgtgtggaataagatgaaggtgaaattttctagtgagattgagctactgtgtagcggaaggagccctgggcttggatgcaggaaacctggattcacagctcctgcttgtatctgtgacattcggtatctcattctggcaaaaaagaaagagaagaaagaaagaaagagagagagagaaggaagggagggagggaggaaggaaggattgaaggaaggaaggaaagaaggaaggaagaaaggaagggaaagagaaaggaaaggaaaggaaaggaaaggaaaggaaaggaaaggaaaggaatggaaaggaaagaaaagcaaaggaagaaaaaggaaggtgtgactcccacctcacaagctgctacttgtgttactgtgatacttgtaggataaagtataagaaaactctaaagcaaattgaagtctaaaacaaatgcctagcacatcatgggcaggtagtaaaagtttagtgaatctgaaattgatgtggctgatgttgggcaagccagctttccacggagtctgagttcagaggaaaagtgttccatttattggtatctactttttaccccgggcttcaaagaatctcaaggagaagttttggagtggcagtttgtgttagagctgagtttatgaattcaatgacaagccacagactggagaagaggagaaagaatctatgcaacagggctatggcagcatcgaggtgcatttgaaggtggagaggttgggtgggaactccgttttccatggtcggactatttccctaatctaagcaagaccaagcctcagtgtagttcagggcagtcgtcctgagtcatggttctgagtattgagtactcacagggcccacttcctcggggatgctttccaagaccacctcctctccccacacatctcgctgtctccactccctcagcctgctttgtttcctacaatgcccttgtcactacctgattggcatttgtttcttgttttgtctccctcactaaaatataagcttcatgaacacaggggctttgtctcattcaccactgtatccccagtgcctagacaagtgctggtacataacaggccctcaatacatatgcagtgaaagaccaaatcagcagtccaaaccccagccagtgtccccacggccctccgcaaggaggcctgcaggttttcccacaggggaaccattttgcttatgtctttgattcccaatattccagtgtctatagtaggggttccaactgtattgttcacatctcattttgatttattgcatttaccaacatgcaggatggtctttcaagatttcttaaggatcgctaaaacatgcacagaggatggctgacacactttgccgccgcagaatgaagtttttatcaggttttcattctctcaataatcttaaggtctcgatcaatttcaaaaattgaaagtaaactctttatttcaaaagccataagggctaaatgctgcacagtaacctatcctggtttgacatttgtggaagaactgatgaaatcagtttggtgttataccaaggttaatttcttagcatttcttagcattcctagacactctagagttatgaaaattaacattagaggaacctgggtgaagagtatacatgaattttgtgtgctgtctttacaagcattctgtaaatctgaaattacttcaaaataaaatttaaaaaaataaatataaggatgcagcacaaatatagtacaacagaatcgtggaattccagcactggagggggtcttgggcacaatctagagcaacctccttacctcacagaataggaataaaggccatgagactgaagcaattaaaaactgaataaaaacattgctgtcaggttaggaactgtcatcctctttttacaaaagtagatataaatatcagtagaaggggagagatgggtcatggagcaattctgtttggaattaggagagaaatccataactttacataagtataggttctatggccctaaccctgatctacgtggtgatttatgatttatagagtattcctcatttatatgttcatttgtttattcattcactaccaaatgcttattagcacaaactttcccaggccccaggaagatggagatgaataacatacagtctatgcccatgagttattcaaaagctaatattgtttgatcttcacaacagtattggaatccaggtgtttcacacatgaggaggttgcccttgcatggctagcagatggcagacggaggacctgagccagccagcctgattccacagtgctgtgggtgatatgaaatgctgatgttatttttgttcctggataaagccatagtgagtgctgacctaaaaaagatatcaaatccacctaaggatgacttctgagggcaagaaggctgagtgtgggagaatagggttatgacagatctaggattcttgccaactttccatctaggtcactctcctaagtgctaggaatcaattgtctgggggaacttgagctctgcaaaaatggttgttggctgctcttgtaaggatggcaaaagctccctcctcccaggaggggatttgcttctgtctgggaacctgcaggacacaatcttctcaatcaataagagatttctgcagagttaagatatcgtgtgtgtgtgtgtgtgtgtgtgtgtgtttctttgagggatcttgaagtattgaaaagttaatgaagtttagagtcagaacaattctcaaaatgcagccccactgaccccactactacctttactcaagtcgtctcaactccgaaatactcagctttcacaactaaaacacacctccctagaactgttgttgtgagaattaaataagataatatatgtacattaacttgtgtccttaggggaattacttaccttctctaaacctaagtttccttatacgtaaaatggtgatcgtggtgagaagctcattatttgaacccattttataggattgttttgataattaaaataattaatgcacgcatagtgctaagcacaatgcctgcacattgcaagtccttgataaaggttatttattattactttatcatgactactctgtgtaaactgagactcatggagacaagtatcacacagttggtaaattacaaagctggagttgaaaaccaaattgctagattacagagcctctgaaatatatcattttgcttttggaacatataatttaatcacaatctataaatattatgtgtacattataagtgtcttgaatatttattacattttaatagacacggagatagcattagatctcttgtttaaaaatattataattgatattcataaactcacgtcaaatttactgtgatgctaatgtagctcatgcaattcctgtgtgacctggaattgctctcaggacataaatgcatctcacaagataatctagatcttctcagaggccttaggggaagcctctcctgcctgtatttttccaaaaaaaactgaggaatttgtatttttggaggcattctcgctctgtcctgtgctaggtctttctatccagagatgctgttctgcaggtcatttctgcttcactgttaaaaccttgtagacagactagcagacttaaaacctggacatggagaagacagcagaattcttacccagatgcaggcaggaagagagcagaatgtgtgcaacttaacactatttaaagagactgttcatatccccaccatggtggcaggaggatgagcagtaaacggtgcagtgttcaaaaactttgcattgtagccccatgaggctactcagtgacagtatgtgttaggtgaaatgtgtaatggtgatatcaacatgtcacaaggaaggaaagttagtatgatttggaattgtcaagaaaggaaggatctttgaaggaggagaggcttggtattgccttttgtgctctgatatgtgctttctgaggctcctctcagtgtctaattggagaagttcaatcctgacaatttctaatgtaggctccaatatttactgaaagtgatgtttcgtgactaggatgtagcctgtctttctatcagattacaggtacttttatcatcatggtagtaataactatgacttcccctgcctttcaattatatacgttgtgccaggttctatgctacacttgatatatagcatctctttagtttttgtgtaatactgtcaggttaagaactgtcatcctagttttacagaagtaggtataaatatcagcagaaggggagagatgggtcatggaacaattctgtttggaattagcagagaaatccagaactttgaaggcttcttttactgggcaaacttgcccccaactgtgtttgtctctgtcccttgccacttcactgctccactgtccccaaccactctcctatttctctgctcctctgtctttggtaccagtctacttatttccagtatctgtattatcatagtgtctgcttatcagttacagtgtctggtaattctgcctgtccaatgtcatagtgtttacttatcagtaccagtcttctgaagagattccagaccaagtgcagcatcaggtatagagtaagttctagtgaatatttgtcaaaagacttaatgaacattctaaaattctgtgggcctttttataaatgcctgatagcaactcaaagaattattctggggaaaatagaattaacaaaaatcaaagctttactctaaaagaaagaaactcttttggtactatttaagacctcatccacctttggggcgggaaagaaatttgggagtgttaaggatgctgtgccacatggagtgagccacttgtctagatcatgggcaaaacttctcatagtccatctctgcagtggggttggaaactggctaacagcccttgaaacacctgtgtgtctgtgaagctgggaaaaaaaagaccagcacaaccagcccatctattatctatttaatgaaattttgagagttcttgaccaagatggtgctgcttccttttaccttgttcatcacttgactcaaccccacaccacaccacctaaagtccaaacttcttagcaagtccaacttctaaaattgtatagaggggttcaccaacaaaaccagacactcacacaccttgcaaatgctctgtaattctgcctgtccaatagctttggacttggtaaagaatgcagacaacaagaagaagtcctgtccagcataccaatcagagctgtgggaccatctcgaagagatttattatatttcttgagagctcatgaacatgagctttgacctcagatgaatctgagttgggtcctggctcttccagttactctcttggccgagagttttgtaggcattatcactgactccacacagtgccttaggtgaggctccacaaagcatgtaaaggtcagggctaggactagaactcatgtctgctgattcctcaacaagggctctttcccctgcaccccactgctgttatgttttactattgcagatacaggagaaagtcttccgttttagctttcagggtgatgaccctgagataaatcattttcagaaagtccactttctcagaataggttcacaaatgtgttttcagaggaggagtaattaccttgtgactttccttctagaaagcttccagtttcagatggagcagggctaacaatactccagtttctgaaactgaaattgaacctcagccttcaaagaggtggtaagaaaaaaaaaaagtatgtcttctcagatgggaaggagagtcttgtaagtaaggtaccagtgccctcctgctctaaggaaatagtcttatttccttagagctgcggtcatgttatacaattcaccaggatattagccatcgtattggtgactgttaggaactcctcactcacatccatgaaggggcctgaaactccctccaagtagtttccctccaagcggaatagagcattgagccactgccctgttctccaggccattcaggagcaacaaccaggtgctgtgaagtgagtcagagcattagtcatttgaccgctacccatctcttttgaaattgagtttgagtaactttagcaatgcaatccctgacagttcccccagtcctgttccatttagaagttgcctctcttctcacctagctctgtgtttgtaatcctgcagctatggccagtgtttaggtgagtcttgttaaataaggagctttgttaaaagtgaaaatgagaggaatggaggagaggaatgcccaaagctatatttattttgccccctcatcatggagctgcagggagagaacggaagcaagaaaagggattgctcacccaagatccatgtaaactacttggagggagtttcagggcccttaatggaattgagtgatgagctcttaaaagtcaattctgcctccaataatgggacatagtcgggtcactcattcggtccctcattcttctattaaacatttgctggacaacaatgtcagacactgcatggaatactacttcctgagagtggtaaggcatactaaagtacctgtgctccaaagtgggtggctaagacatccaacctcattgagctttgttttagggaaacagcagctcagggagggcctatgaatccaccagtgttttactgattagagacaggggagccaagggacagcttttacaaagtagactcataattactgtgtagactaaacataagtataatgacactaataagcaatttattaatcccaggaattttacatgcgttgtcttatttggtcttcacgataactttaatacatatgtgctattattatgcccattttacagatgaggaaactgaggctattagagggcacgaaacccgcccagatgatacagctaagaacagtggagccatccagcagcatagccaatgctcttggccactctactatctgctccccacagtgtgaaaaggtacccccacaaagatccggctctggaaggaatgctttcacataccaaactcctgaacaggctgactctaccaaaatgtgaaggcaatcaaaccaaagccggaggaggagggttatgtttggttatctaactttcactatatgttcttaggctctgagtctgtagggtccaaataatcttcacagggcagagttatctgaggtggtgtgtgagaaagtgacacacacttcccgtacaggcactggggccagcagcctggccaacagctggcggggaatttgtggaacttggattgccttcagaactggtactccatgaaacagttcggcttatcttcctacatttatttttacttaggggaacttacccccatgggagctctgtcccctataggggtctgagtacagaagacaagccaaaacaatggaacaacaactccgtggaaaccacagcccagctcagttctgaaagggctttgttttagaggaaggcagcattttagtgatggtaggagaacaggtcacagagagcactagcttatggcaaccttctctttttggacacatatgagttttgcttatgattcttagagcttcatattgaaattacctctcacctactttactaagaattaggatagaatagaacaccctggtagatcagcccctaaagctacctttccaccatatcatgagcctagtccattccactcatatagcttgctgaagtatgccaggcatttacaaagtgattagtatactcctgatgagatgcgagcaatggtagaatgaagaaggctacatcagtcatatgcagaaaactgaaactggaccccttccttacaccttatacaaaaattaactcaagattaattaaagacttaaaggtaaaaacccaaaaccataaaaaccccagaagaaaacctagacaacaccattcaggacacaggcatggacaaagacttcataataaaaaacaccaaaagcaattgcaacaaaagctaaaattgacaaatgggatctaattgaactaaagagcatgtgcataccaaaaggaactatcatcagagtgaacaggcaacctactgaatgggagaatatttttgcaaactacccatctgacaaaggtctaacatccagaatctacaaggaaattaaacaaatttacaagaaaagaagaaacaatcccatcaaaaagtggacaaagtatatgaccagacacttctcaaaagaagacatttatgtggccaacaaacatatgaaaaaaagctcaacctcactgatcattagagaaatgcaaatcaaaaccacaataagataccatctcatgccagtcaaaatggtgtttattaaaaagccaagaaccaacagatgctggcgaggctgtgaagaaataggaattcttttacactgttggtcggaatgtaaattagttcaaccattgtagaaggcaatgtggtgattcctcaaggatctagaacaagaaataccatttgacccaacaatcccattaatgggtatatacccaaaggactataaattattctactgtaaagacacatgcacaggtatgtttactgcagcactatttgcaataacaaagacatggaaccaacccaaatgcccatccgtgatagactggataaagcaaatgtggtacatatacaccatggaatactatgtagccataaaaatgaatgagatcatgtcctttgcagggacatggatgaagctagaagccatcatcctcagcaaactaacacaggaacagaaaaccaaacagtgaatgctctcactcataagtggaagttgaacaatgagaacacattgacacagggaggggaacaacacacactgggaccagtcgggggtagagtgtgaggagagggagagcattaggacaaatagctaatgcatgcgggccttaaaacctagatgacaggttgataggtgcagcaaaccacaatggcacacatatacctatgtaataaacctgtacattctgtacttgtatcccggaacttaaagtaaaataaaagaaaattgtaaaacctagatacatgtataataaactacacagttgcacataccaaaaaaaaaaagctagatcatcaaagagccataggtctcaatttacaccttaacctgcattactgagcccctatagctgagttttctagtctgccagaacttcttacaagtcctgggaacagggaattcaagctaatttacatggttgaccgaataccgagcccatctctcaattcttctcacaacataatagcaaagtgattgatacagaacagtagtagagtatgagatgtttaataaatgaatgaataaataaataaataaataaatgcatatttgaattatatacattaggtgaataaatgaataacaagtaataaataataaatttaaaaggacggatgatttctgatgacagacaagtaatatatttaatatctaattttgttagatctgcaagttcattttcagcaatggaaaagaataaatgaaatccacttgttgataatgttacaatttgtgtgtcaacaaggcctctctcaccagtcagcacacggtacttactttatgcattatattttctgaaaacttatcttcccatgaaatacaaggttgcattccagcagctgtctggccatgcacatagacaactgcctgctctggctctgcccactcataagaggggatagaccaatggctgggatggtgggaaatgcaaagaaggagaggtaactgaagaactattttggaagggtttgtgaaagagctcatgctataaggtggaaatccactggatttcatcaaagggccatggctcaccatacccatctgggctttgcatgctgtgtgggggcagaacaaatgatcatccttgtgctcaatttccagggctctgctgttaagcagaagaaatgtttatttgaaattcgtcaatacattgtgcttctctttgtcttctttttattttaaattccagtaaaatgaattataatatcttttattttaaatgacatgcataatacaatcttgaatttgtaaaattctagatgtaaaattctagatcctggataagtagcaagaacagtggaaatgccctgactgtgtagagcttatggtcttgtgggtggtggaaagattcctggataagtagcaagaacagtggaaatccactgtggtcaggtagaaaatagtgttatcatcacagcaaaaagtgggaagcctgaagacgccataggaattgggcccaggaatgggagaaaatcatactagagatggaacaaaggaagaaatgattgtactattctaagtcaatgtttagttcaaaaggtgctgtgaagaccagcagcagcacaggtagaatgaaagagcaaaaattatttcttgtctgtggactggagtggagcggttatatatttgaagaattaggactaagcagctaggacaggaaagggatctttagagggggtttgaggcattcagttggcctgttgcaactctgtaaggactgcctccacagccaggattcttggtggccaccaggaatagaattctgagaaaaacatgccatggctgtgtagagcttatggtcttgtgggtggtagaaagattcctggataagtaggaagaatctgggttgtggtcccagctttcctactgggctgccctgggcacattcaccatgcccatctgggctttgcatgctgtgcaggggcagaacgaatgatcatccttgtgctcaatttccagggctcttctcttaggcagaagaaatgtttatttgaaattcatcaatacgttgtgcttctctttgtcttctttttattttaaattccagtaaaatgaattataataccttttattttaaatggcatgaataatacaatctcgaatttgtaaaattctagatgtaaaattctagatccacccatttatgcaggcttccatctaacaatatatattgaaagaggtatgacaggggcagtgttccctaaattttgttcagttagaaaattctgagtcacttaaattttaatggaggggctatgttatttctacaaatataataaagactattatttgcataaaatggaataaattgttaagaatctaggtcagagaaagagtgtgtaactgtggcagtggggtcttgggaaggggtctgtgtatgtgtcactgttcttaggttcctggggttgtcttctcttcaggtaccagacgtgctccaacaatgggctggtggcaggattccagagccgctacttcgagtcagtgctggatcgggagtggcagttttactgttgtcgctacagcaagaggtgcccatattcctgctggtgagtctggcagccgaccaaaccctcatgactcctggggtgggagaggcacctaggaagtgctctagcttcaggtaagcttgagggtcacacacaagcctggaaggcagcgctggcatatagacaagaatgaatgaatgacttaggaggatgttcccgccaagagggatctttcaggttatccaaccccccacatccttcttttggcagaaaaggaaacagaaccatagagccggcactgactggcccaaagtcacccacctactctgtgggaatgccaagtcttaagcttaggcctaatgactcccatcccagtgctgttctccttctccccaacttctggtaacttctcatcatatccaaggctgcagggcctatttgggaacctagtttcctgtagtctttctctgggagaaaccaatcctctcatgggtcagagtctagtacatagttatagacagaaaaaataaaatattaaaaaattaaaaaattaaaaaaaaagattgtgctgttttctggatccatttggaattccagcctctgatgttttgtttctttccctatccctgggctcatgccgaatatctcctgacctagccttccaattgactaggagaatgtgtatattgtcatttgccctgatgacttacactgggtgttgataacacaaccggcccaggtttttttaatctgaaaatgagccaggcatttctgccttgggcaaggggatccagaagtgtcaacatgtgaaggttggctccctcaagtgattgatctctctacagtttgatgcttgcaaggacagcttcacaggtcatgcttattctctgcaatcagacagcttactccacagatgcccagtggcacacagtatctctagggatacaaagccccaaaagcttaacgtttttctttttaaagtaaggaccgatagtaaattcagagctcaaagtcacctgtcactgtatgatggagcagaaacctcctctagttcttcaaaatcgcttccataaagcagcttttactcctctacagtgggtgaacaggcctggcaaaggattacgatgccactgggataggtcctgaaccaaagacctaaagatctcttgcagtggaggaggtagaaggagcaccagtttgggcaaaaagaaacttgagtttcagtctctgtgttggcctttcctcacttccctcccttctttcccctttccccttctcccctccctctcataactctgcaggctcaagcacatcacctaaaatgatgaccaccttttttgagtctccaagatctttaagactctgatgaaaactatagaccttgtcttcaggggggaaaatgcacttagcatgttaatacaatagtttgcagagaatttcgggagtccttaaactccctgaaggccattcatgaacacactgccaagaacccctggatcataagttgaaattccaaggactagaagatctttcaggttgtgttgaaccctaaaaatgtcttaattccaaagacacttttggaaaagatgatccagatgccagaactgttttgagaggatgaaggaagttccaaagacgagtgcgccctaatgaaaggggagagtaggtaggagcttggcctccacaaatctctcattcctggtctattaacagaatggcacttcccacaaggaaaccagcctccctttgttgcaaagcattaaaagccagttaaaatgtatgtaaattacctgaaagagcaagcaaaacctaatactcagtcagtgaatttatttactacattagtataactttccctgaatcagactccaaaggaacacatcagggctggggtatgctgggtggccaggaggagtgggttcaggagcaggggaaagagtgaggaggtgaggaggtagccctgcacgggctgcagtggggaggaaggggaacatggacagcctaggggcagctggaggcctggatgttggtggctctgtctctctgcccttcgtagatgcctctgtcacagcactttatgcattttaccacctgtgtacagttgctcctctctacctggacttccagtgtctggaggatatggggccactcactgatctttgtattttcaatgcccagtatagtgcttggaacatagtgtcttcttaacaactgttgaacaaatatccacattaataattgtggagggtgtatataatgtgaagtggcccagaaaatataattctcttacataaaattttttgttctctcccccatccctccacttctgcccagaatataagctctacacaagcagagatctttgtgctgacatatgccaagccctataaataatgacaggcacataacatttgtttggatgaaggaatgacttcaggctactttttgttatgagcattaaataagataatatatttctggccttgccactgtctatgatcacacagagctgacctgtcttgaaacagagtccccttcaccctcccagatgcaggagagacccagcctcctcaccaactaacaggacattcaaaggcaaactctgcccaggaacaacctagcaggtgtcaggtcattgcaggaagcagaacttgagagcggggttggttatgcagaggaacaagacatgtgaccagttggacagtctgttgttagatgtactaactcattcttccccaggcagagaggagtaagctgaggcagcaacattcctcatcacagcaaggctcgaggtctctgcagagatgagtgggagagcctgctgtgtctgtggccatgccatcatggttggctggcccctgcccaaacagaacaacaacagatagtgggcttgggcctcaaggctttgggtgaccaggcaggcaaggagctaaggctcactggttttagaaaatttgtcaaggccgggcatggtggctcacacttgtaatcccagcactttgggaggccgaagtgggcagatcacaaggtcaggagatcgagaccatgctggctaacatgatgaaaccccgttctctactaaaaatacaaaaaaaaaaaaaattagccaggcttggtggcaggcacctgtagtccctgctactcaggaggctgaggcaggagaatggcatgaacccaggaggtggagctcgcagtgagccgagatcacgccactgcactccagcctgggcgacagagcaagactctgactcaaaaaaaaagaagaagaagaaaaaaaaaagcaaagttgtcaaacagaagaaatagggggtggatgaaggtaagtgtgagagaaagggataaacatctaaattttcctggaattcccatattccgtggatctgtgggatctgtgttaacactctgagcattgcttcttgaagcttatcctgtctgtttatttgaatgctgagacctgaaaaagacaggtctttgtgtttccagttccaccgttgttttaatgatgccccagatttccagtggtcacctggagactggttccaggatacttctgcttccccaagaatgctaggtatcgttcctctcacatactttagaaaggcttctcaagctcccttagatgcaattcaccagctaagatgctaaaaatgtaatgatcatatagacatatatgtaggaacaaagtctcaatgttaaagattgatagataaagatgagcaattttgagttgccagagatattcatgtctctgctcacaaagtttacccaaagccttgatctgcaatgactttgccactctgaacccaccccaacccccatacccttcacccttccttaccccatcctaccatccagacatgttgctgttggtctgtggagccaaaaggtggggaaagtacagagaattaatccaaaaggcatgacaagtcaactttgaaacaagtcccactaaggtgtggttccacctggctggttctatttctgaaggcatggtgttagagctgagagctatcacggtcaccaaataaaatggtattttttcaaagaaaacattggagaagcagcagaacaagattcaagtgtgcaccatggtacacagtgtatgactcactatcccgctggtgtgtctagacattttagtggcatctttaaattgcctgagtcatgatgttgtattatatgtctttctaaatgcctccagggcataaattaggtcttattttttcaacatctccaggatattacccagcacaaaatagactcttaataaatgtgtcagatgaataactgaatgttgcaagcccctaggaacagtaacaatggtgaaacctgacattgatgtgatgatgttttatagttgacaaagacttctttcatgtacattattttatttgatccttttaacagccttacagagtgaagtgagaactctttttcctgcaccttcccacagtgaaatgctgataaccctcttatctgaaaccttcccttacatgactttaattagcttgaattacctcccagggaactggacccatgtgggtgggaacgacatttttccccttccctctttgaaaggcattcttcagcacgcagcctgacactgtatgaactagctaagtgaatatctagcgcctgcgtttgtgagcacttagggattcagaaatatcatcactctgggctggaaaaaacaaatcatccaaccaactcccaaatgagtatgagatttatttgtttggtgggaaccaaggtgctgctctcgtttcagcttgtgcggtttctctttggatattacagcctcactggactctggcaagaaagcaaattcctgagagatgtggacatgccattaggaaatggtctccactggattggatgaatagtgaattttatagatatttatttagatatgaaaattctaattcttagtctagtggtctgcaaaccacaaacacatgtcactgaagttgccacaaccctttagacattgtttgtcataatctctcttctccaaacagctcagcagctgcaggctgcacaccagactgtctactgtccaggcggagactctgtgtcccaggatctgatggttgtgaatcattttcttttccaaatggctcttctccagacccatggcctttcattaggttcattggataatatcttttgactgtaaaataatgcatccatttaggtaacctttacttttctcttcaaccctgatattctgtctctcagactttgcattctccactgcctacttccccactctctgtgtgcaagtcataagccagagagtgctttttttaaattcctgtatagctctagttaacatcagttgattagaacattcttatctctcccaccccaaagcacccagtcaaagctaatctttaattcttagcctctttgttcagatgttaatacaagatagggagtgtttgcatgttcactcctgtaatgctgttttagggacatgaacaatctcacaggcctctgcattgctgtgcctgtcatatgccacctgtgcccagacagcctcctgcaattcagctcccagaggcctggtaagaagagcagcttccattaggtatatctcctaatgttagttaacaggtgcagcacaccaacctggcgcatgtatacatatgtaacaaactgcacattgtgcacatgtaccctagaacttaaagtaaaataaaaaaataaaaatgaagagcagcttccatactggtcctctgcgcaagctggaagctattactatagagatggacatacttaagttttgaggaaattggactagatgtctcaatttaaaggaacttatattgggtttagatgctctgcgccctactaaaaccattgccttccattgcatgatgtacatagcactcattgtgcagacagcagcctctctgaacttgagcaaaatctatcatccctttcatctgctggaatggtttccataattattgtgccatatttaaaatgtagacatgtacaattggcactccatatctggggttccctatccaagaattcaaccaactttgaatcaaaaatattcagaaaaaaacaataaaaataaaaataacaatacaacaataaaaaatgatacaaatacaaaaccatatagtataataactactcacatagcatttgcattatcttaggtattatacgtaatctagaggtgatttaaagtaaacaggaggatattcataggttatgtgcaaatgctacaccattttagatcaaggacttgagtttctgaaaattttggtatccatgggggtcctggaatcaatcccctgcagatgccactgatgactgttgtattagtccattctcacactgctaataaagacatacccgagactgggtaacttaacaaaggaaacagtttaattgactcacagttccacagggctggggaggcctcaggaaacttacaaccatggcagaaggagaagcaaacatgtccttcacatgatggcaggaaaaaatgccaagcaaaagggggaaaagccccttataaaaccatcagatctcgtgagaactcactcacgatcatgagaacagcatgagagtgaccgtcctcttgattaaattacttcccactgggtcccttccatgacatgtggggattatggaaaccacaattcaaggtgacatttggttggggacacagagccaaaccatatcgactgtatttggtgcctgcattataggtgatacctctctccttatgttcaaacttcaaaagcagaaatatcatagatgtgtctggctaagtattggttaacccaaggccagctacttagaacaaagtaaacctctcagttacaaaccaaatctgatgctttattctatctagtctgcttccctctactataatagattctagaggcaatcattcttacttctatttattaattcacttaagcagtcaatgaatgtgaatggatatgaaataataacaattcataggctttgggtgagaccctactaatgataatgatgataataataatatttatttattgacacttaccacgtgttcctgtgttactgcatttaatcctcacacacaaaaattatgatactatcatacagatgagggaactgagctatagaagttgtggctcccttcaaagttccaaacttgactcaaccagtctatctgcctccaaatcccatgctctttgcatagtactgagctgtctctagatgaggaataagacttctacaggtgaaatattacataatagcacagtaggcatctggtagaaaacagagaataaaactattttaattggaggggagctgttgaaggtcaagtagcccccactgacatgcagacccagggtgaccaccacataatgtggctaatgaaaatcaacacgagtcaaagtgaatgtgcttactgactagccctgggcttggacagtgagttagaaactcagttccaagagagcaatttggaaagtgttcagggactttcctctactcatttaagctacagatatccctggaactgttattccttcgtgttgtgatacatgtctgaaatgtttgaaatgtaaagtcccaaaatgccataaaaggacagacatggacatttgtttttatttcacacacctcagagcccctgggttcagattttctgtgcagagaagggcacttgggtgactaccagaggtcccgcttggccaatccccagctcttgtgggaagaagcctggggattgttctctgtggctgttttcctttacacataactccatttggggtttattttttctgtctttacaaaactaattcaaagggggtctgatgtagctcctaataaagacaaactaaattaatctgaaatatgttcattccttatagcttacttggaaaagcattatgcaagaggattgatcatgaacagactggctttatttaacaaacttctcaatgatttgactgtcagaaagggacatctttttagctgaatatataaaacgtaagccaacctcaacacaccaaatccgcaaatgttgagtttctcctccaaacccacctctgaaccagatcataaaagcatatttgattccatgcaccagtgatccctcaaagagctcactatattggccatcatgatgttatacagtattctattatcttgctaaatatatagtgctgatgtattagtccattttcatgttgctgataaagacatacccaagactgggcaatttacaaaagaaagaggtttaatggagaactcacagttccatggctgaggaagcctcacaatcatggtggaaggcaaggaggagcaagccacatcttatgtggatggcagcaggcagaaagagagcttgtgcagggaaactctcatttttaaaaccatcagctctcatgtgacttattcactagtatgagaacaacacaggaaagacctgcccaaaggttcaattacctcccactggatccctctcacaacatctgagaattcaaaatgagatttgggtgagacacagccaaactgtatcagctgacatgtcacaggacattagaatgggatatttaaagtaaggtgctaattgagtggtagagaaatagaagaaaaacagaattcaatattgaatgaccaacagaagcttctctaaaatgttgtttgagcataagctgggctataaaagatcatttggaagacattctaattttattcttattttttaaaaagctgaagtatggcttcctcaggtacccgttctgatctgttcatatgtaaatgctggggtttttttccagtttttatggtagggagtctgtggtgtgtgcttttctggtgtccccacaaagtgggccaaggttggggatatgatgtttcctgaccatgagatgaagctgtatctgttcatgtgcacatcaattggagggaaagtcctgaaagaggagcttccaggtgacaccgactaatccagttgccctaatttccccaagtgaaacagctgtaacaaacacatctcagtgctatgaagtttgactttcatagaagaaaagtgtctagctccgaataaggtctcgtagaggtgggttttcacaaaaccttacgctgagtcactttatgtcaaggaatagattgaaaatctttactttaactattaaaaacctaataagttctcaacccaacctctgacaatgaataaaattggccactgtatataactagattgtatctctatttccctttctaaaatggatgtgagagcgtatacctggactcagctctgcaatatgtctgttcttgtggcaacggagccgagacatctatcagcagcagctcagtctatgatattgtatcatagcaaacattcattgagtccagttggatctgttaataattttagagcttcaagaatcttagatgagaaaaatcctatatcaatcttaaaattgtcttcagttcgaactgatttccctcagctcataagtaagatattattaatttttttaccatcagcttcagctgacacaagagttgtgcaagtggctttatgttatcaagttttttcttagctttggaacaactctctgtctttcatcttgacagcagaaaaagtgctgtgaagtgagaaactgtaccacaagagtcattcatctgaaagtgcgcatgcacacacacacacacaccccacacacacaccagtagttttgctttttttgttgttgttgttgtttgagacggagtctcgctctgtcgcccgggctggagtgcagtggcgcgatctcagctcactgcaagctccgcctcccgggttcacgccattctcctgcacagcagtagtttttattaaaaattaagtaatagctaaaattgaataaatctattcaaacactttactttaggggaaaggagaaaataaggcttcccatagaaatgtttgaaaagtagactcatttcaataaaggcatcttcctgacctgcgctcttcttcatcttgccaagctgaaggtttgtttgattgttttaattggtctaggaatgtatggcaatgctcagtatgaagtgtgtttttccaaaaaactgcttaaagtgacctagtaattcacaaggaattcacaaggaagctgcaaccacaccgaactcttccccgacctacactcgcaaagcccagtgtcacagcttaggaaaccctgatcattctgcttccttgtagcctcttttaatttcctgaaaagtccctatgccctgtctcagtgtctagttctgaacgtttaaattcttttttctctctaaggagctattactgggctttcacttattaggacactttgtgcgcgtgtgtgtgtgtgcgcgtgcacatgcagtgtcatcaagcgctaaatgcagccacatatatctggtttgaaaatacagaacagagcatcctgggccacattgactcaatagttcttcctatggatggtgtttgggaggttcactttctaccagtgatttgggtcatttctcccttggtatttttatttcataaagtaggagagatttccatcgatatccaacctccttccctatcctcctttacccaggtttctctaggacagtctaaactcaatcccatggtgttataacaaaaacaagacaaaataacaacaaccaaaagtcacacaaaacaaaacctgtctgggaccaagaagaaaaagtaccaatggtcatgcacctcaccttctctaggacattctagaaattcactggacatcagtacctcatggagaggcttctcggacaaactgtccagttagacagggggcttatgtctggtcactaccaaaaatgaagcaacagagaatcctaattaaagaaagcattaaataacattttccttctttgaagcttaaaacttcttgatgtttttaaaggtaagcttttctttcccactttattccgtgatatttatccaagtatctgaagacagatcagagtggtcagtaaaaacttaaaaaataaaaatctagcttcataatttccaaatacttttggcaattggatttagcttaatgcagtgttgctgtatgtagattctgccttagcaaaaaaaagaaaaaacacacaacttggtaattaatttttacacattgtatccagagatgcttcaaaagttttagaaaatattttttgttccctgaagtaaggaaaacacacaccccctcccacccccatgcaacctcttattctaatttgcattattgatgttctcaacaaacctctctttccttgggttaactttaatacagtccttgttagaattctcatggatcataaatcagtgggatccaagtaaggccctattagttctacttataagacatttaccatgctgggcgcagtggctcatacatgtaatcccggcactttgggaggctgaggcgggtggatcacttaaggtcaggagttccagaccagcctggccaacatggtgaaaccccgtccctattaaaaatacaaaaattagctgggtgtggtggcacacacctgtaatcccagctacctgggacactgaggcaggagaatcacttgaacccaggaggcggaagttgcagtgagccgagattgcaccagtgtgcaacagcctgggtgacagagtgagacttggtctcaaaaaaaaaaaaaaaaaaagacatttacctgaaaggtaaagtcctgcttctggatctctttagaagcacaaaataagtttctggatttgcaggaccttatttcccttcatgaactcgttaagcaaaaacacaggtacctcactttgggttggacttggcatcctgatagagcataattacgtcttaggaaaagtcaaatcagagaacaagggttagtgaataatgggtaaaaggaatgattatgaaccaagagaatgagctaaccattgatctttctccatctgtgcactgagatcctcctaggagcccttacagtttataaatcaatcttttcatgatttaatgacaatcttggagaaagatcaccatcagtctgcagaggagaagatctttctagcattaataaacagtgatctggtaaacccaaatcagatgaaattattgacactcacaaactagttgttttccaagcgtccctggggtgtggataaagactttggaggagctatttcatggtaaaaggactgttttggtcctgaaggttccagtggcaaagcccttatgagaactgggggattctagactttattccaggatggactaccatggacctactcatatgaaggctcaggatttactcaatattggaagagaaggaaaggaaaggaggaagaggaagaagaaacaaaatagttcttagtgattcaacacctaccatgtactagtatagcacactcatcactcatttttattagttccaatgacaaacctataaggtagactttattcttctacagatcagaaaacagattcattgactttccccaggccatatatttattcagctaatatttattatgtatgtgttttaggtgctggatgaacaatggtggacaaggcaaaaactctacctttggggagcttacattttaattaaataatttttgaacactttgttgactataactcacaataagaaacattaaactatcgcaatatgtacatcttataaacaaacacacatatatatttgaaacaaaatgtttacatacatagactcgtccttactgcatgtgatgcatgcttttatattttcttttctattttatgtctcttttaaagccaattaaattgattttgttatcaactaatgaatcataatctaaaatttgaaaacattgtcttagttgacttgaatagaataggaatagtattgatattaatcaatatcaagaattccaaagttattttgataattccaaagcctggggaggtatcttcatctttttcagtgcacagtttaatggcctagaaaaggaagatgagaagtgggaggagagctgtctgtttcttcacagcctggagttgtttggtggatgtcatttaacttcagtctggatttgccaggatgctcaaactccatctcttcttcatagtgtgtcttctgtttgctcccagcaataataatgtgtttcattttcctctaacctttgttcttcctgcataggctaacaacagaatatccaggtcactatggtgaggaaatggacatgatttcctacaattatgattactatatccgaggagcaacaaccactttctctgcagtggaaaggtgagaaagacagccccttcccaatgggctagggttaaaggagttgggactaactccctgcaaggattttacctgcaggaatttataaacacaaacacacacacacacacacacacacacacacacgtagaatacaagtgaaaatttcttacatgcacatatatttctgcaggaactttgacctgaggttttacttatcttagtttcctacctggtcaaggattaactgcagttttggctggaaaatgggaggcagtgggaagtgagctgttctcatgagctcacctcatggagctgctcaccttgcaagtgagggtggattccagcctgctcaagagcagagagtcctaaactcggtatcccttgatggtctaagcttttcccctcactcaatttcaaagagcacttttcctcatgaaacaccaagaggagaaggcaaatatgcttagaggagtgcccattgtcaaaatggacccccttccaccccgtgcctctatatcatccccactttgggttttaggaaagaagagagaagagaaagaaaagggattggagataagaaacacacagaacctactgtcttagtctgggctgctataccacattaccttagactgggtaacttacgaacaatagaaatttattttcacagttctggaagctggaaagtccaagatcaaggtgccagcaggttcagtgtctggtgaggggttgctcgctgcttcagagatgttgctttattactgtgtcctcacgcatggtggaaagggcaagccagctcccttcaacttattttatatgggcactaatcccattcatgagagcagagccctcatggcttaatcacccccctaaaggctcctcctcctaatactatcacattgagtattaggttccaatatataaattttaaggggacaccaacattcagaccatagcatctaccaaccatatttagaaatgaaaggagttaacaatccctcagtaaacctgcaaaaattaatgaaagaagagaatttaaatggcctaaagataaaaacagcactaacacttttttcatcacctttctctcacaatcaactccttaatcctatctcaaatacatcaaaacggtaagaagaaaacaagaattgtactccctattaatatagagaaatgtgtgggtaaattcaggtgttaatgattggtttggcctacttttagtcagccgataatcactttacacagaaatgaattcctgaaaagttaccaataaatattttgcaaaccaaataacacttacattaactcattagatagtatgctatgatgaatttgagtgtgacacatctttggtgtgtgtctgtgttttcaaacagaattacatcttaaataaagtgaacttatttaatatgacctagaatttcttttttttttttaaaaaaaaaaaagacattaagtagctctggaaaggcacaatatatgttgcaggctgatcagcaaaaacctttatgtttacccataggcaaaccactcagtttgcacacattacttatttttactttagatacactttaaactagcttagttaccaattttctagaagcagcaaattagaaagggaaacgagtatatactacttagaatgaaactcattccaccaatgagaataaatagctggatgacatgataacaaatatgcttaagaaaaataaagaaaatgaaaggctcaagaactcaaagaacatgggttgtcatttagcagggccatgctccccaaagtgcaaaacgaaataacaggggtgctcaatgctccaaatgatgacttcagctcaacaagaaaattagttctatgttccctgtttaagaaagcaggaattaatacagtaaaggaagagtgccatccaagattagtatgaaataaatatatctgagtagttaaaatgctcaattcagttttcagtaaattcactttttagtaaatttttcggttatgtggattacccagaatcatgaaaaactgaaatattatgtcattgcattaatttaaaatgagtatcctccccccaaaataaaataaaataaatatactcatgcaactttgctactgtcatcaaaaataagtagcttaatgatccacaacttgggtttcttctcctctgctgaaagatgctgaggtccccagcttggagaactattgtcagggcaggactccttgtgcaagagctttccctccacatgcaaatcatagtggtttcctcttagaatgctgttgttccatctatgcgctattgacatctagggccagatatttctttgtttcagggtctgtcctttgcattctagatgtttagtctacccactagatgccattagcaccccaccctaaccaaaagaagttgcagacattgccaagtattcccttggggagcaaatttgcccccactgtcctggtgtgaaatcagagactgaacctggtggaatcatttggtcttcataagaccaagtctaagttttgctcagcatcaattaatagccttctaaaagagtagtttgaatgcctgatcataagatcttgtttatctgtgtttgttgctacacagataaataagacctggctgcagtaattacagacatttggtaaacccacaggccaccaattttctaatttccttctaaaacaatctatgacctcttttgacaattgcaggaatcaaaatatcacccaggccctggtatcacccagaccctcaagttgatcacccagatttgtgttgagggactctatacccaattgttctaaacaaacgacccggagcaacagactcagaattagaaagcctgccttaagctgtttgagcagagtgagccctgcttcctaggactaagagcaatcagccccacttttcagtttagaagctggatggaggccttgttagtcatagtgtttaggataaattgttgaaaagagggcttgcagattgaaaagggagatagataattctgagtttgtaaaggaccccaccaagctttggaatgatttgcataattaaatatggaaaaactcttcgtttttgccctttatcaggactgtgcaaagggcatggcagccacgtgttcttctgggcttaagattacctagttaggcagactgtgtggtttaagagaaagaccaagatttgagtacaataaactgcgaatctgaaattgtcacctattacttgtattaccttaaagcaagttaattatttctctgagcctggtttttcacctaaacaatgaatcgttgtgaggattaaaagagaaaacacgtaaagcatctggtgcaatgccagatatattagaggctacaattatcattatcactgttcaacagtattagaccacaggagtgtcatgcaatgtaggcactcaaaacatttctcttaaatggatgaataaagaacataaattcaccctgagcaaagaacattccttgaaatgtatccacaccacatttttcaaaatttagtaatgctatgtacactcttcccatccccaaccacttaaacacataggcaattcataacaattcttgtgatgccagaatggcagccattttcttttttaatttaagggactttttcattcctctgtagcagtgttttctgaagggaaacacatgtatagcacagagcccagtgcatggtgagcactcagcatatgttaagtgctcagaaagagtcagtgggaaaatggacggactttttaaaacaagatttttttcttttttttgagacagggtttcactctgtcacccaggctggagtgcagtggcaccatctcggttcactgcagcttcaacctcccggactccagcaatcctcccacctcagcctcccaagtagctgggactacaggcatgcaccaccacacccagctaattttttgtatttttttgtggagtcagggtttccacatattggccagactggtctcaaactcctagcctcaagcaatccacctgcctcagcctcccaaaatgctaggattgcaggtgtgagctaccaagcccagcctaaaacaagattctttacaatgaaatggagatgatgttaaataaatgcttttattccaagctgttaacccacaggtccttgaggtactttctggaggcagcaggggtgagctgaccaccagtgatgaacagaggcctccacacagccagtgacctaattagtcaccttcaagggtgacctgaactcacagatttgtcggttcttgggaaactgcataaagatgtcttctaagagcaaagtgaggttaagtgtcccttcagttcccagatcctccaaatgttctctgctgctgtttccccagcagcgattcttcctgccatgtcctttctcactgacattcattttctgactctccctcccacagggatcgccagtggaagttcataatgtgccggatgactgaatacgactgtgaatttgcaaatgtttagatttgccacataccaaatctgggtgaaaggaaaggggccaggggacaggagggtgtccacatatgttaacatcagttggatctcctatagaagtttctgctgctctctttccttctccctgagctggtaactgcaatgccaacttcctgggcctttctgactagtatcacacttctaataaaatccacaattaaaccatgtttctcacttttcacatgtttcatagcaactgctttatatgactgatgatggcttccttgcacaccacatatacagtgcgcatgcttacagccgggcttctggagcaccagctgcagcctggctactgctttttactgcagaatgaactgcaagttcagcatagtggaggggagaggcagaactggaggagaggtgcagtgaaggttctctacagctaagcctgtttgaatgatacgtaggttccccaccaaaagcaggctttctgccctgagggacatcttcccactcccctgctccacatgagccatgcatgcttagcaatccaagtgcagagctctttgctccaggagtgaggagactgggaggtgaaatggggaaatggaagggtttggaggcagagctgaaaacagggttggaaggatttcctgaattagaagacaaacgttagcatacccagtaaggaaaatgagtgcaggggccaggggaacccgtgaggatcactctcaaatgagattaaaaacaaggaagcagagaatggtcagagaatgggattcagattgggaacttgtggggatgagagtgaccaggttgaactgggaagtggaaaaaggagtttgagtcactggcacctagaagcctgcccacgattcctaggaaggctggcagacaccctggaaccctggggagctactggcaaactctcctggattgggcctgatttttttggtgggaaaggctgccctggggatcaactttccttctgtgtgtggccaggagttcttctgcagagatggcgctatctttcctcctcctgtgatgtcctgctcccaaccatttgtactcttcattacaaaagaaataaaaatattaacgttcactatgctgaaaatattcagggtcagtttttgctctctactctttcccttgctgattatttatccattcattctgaaaatcctggttagcattgtggtttgtgccaagcaccatgcagaccccaggaataaaatgatgacaatgacagagtgtggtgggggaatcagatatttaagacataaagtgctaaatgctttacttaagattaaacaaaggaaggaatcacatttcttggcctttgagttcagcctaatcttttttcagcatccttcaaccttcctcatcccaagatgtcacatgaatttttaaccacaggaagtccctcttttctttatccacagcagattgccttttttttttttttctgatccatgctgctcttccctcatcctctctcccagtggacccagaagaagagccagccaggcaaaaccacagggatcgcgtaccctgccatacaccccctctaggtggtcaagaaggtgactctcagccagtggtgatggtatttcccacggcaagatcccagcattgtgatggggaaggcagggctaaggatatcttctcctgccttaactcctaaaacactttttcatattagagctttgctttatttcctccatgtcattgtttctgactctctggcaattttaatttataataagatgcttcggtgttatttttcacaaagggagccattaatattttagcaatttcagcctggttcaggatggaaaccaggaaatagccttagttgggtatgtggagcacagcaggaaaggagacaagcaatgctgattggctgacttggcatccatgaagaaagcaaatggctggtgagaggatggggagctgggagggtgcagggagcatggctgggggaggagaggctgcagctgggagtagccaggagactgcaagaggacataagtcaagaaaaaaaacttctttaaagcaattcaataaatagtgcctgtgccaagtggaataaaaggagtttctactaagaagaaaactattatttgcacgtagataggccaaggacaatgacagaaaagacattgtcaacttggtttgaatctgaataattatactttatgttataggtctttcaataagaactaagtgtcagagtgaatactaaatcccagatctggtaactgcaagttttgttctctgttttttcattactccaaactttctactaacttgctccacagtcttggataagtcacctctcctttctaggcctactgtttaaaatgaggacatttatctaggtaaccattgtggtttctcgcaattctaagaatctctgaactctatcacctcctgaattgtttataaagggattttctaaggcattttcttccaggaaaggagcctggaactaaagatgataacctagggcctaccgctggctctgacagagggtggctgtgtaagattagagaaatccccaagcccccttcccctcatctgcccagtacaggtaggaattcctttctaaacaactttacaagatgctggccacatacaatgagataatagaaagaggagatacatgattcctgcctcacaaggccttcagcctaatggtgagatgagaagatagatgatgacaataactgcaagaaagtttcctgaggaagccgagtctatgtttggccctgaaggacaagtaggacttctgaggtgagtagaaaagactgtaagctctggcgtcagacttcctggacacaaatcatggtcctgtcacttcccagctttatgaccttggccacgtcacctacctttcctgagactctatttccttacctgtagaaatatagtacttacaacacagggttactgtaagaattaaatgagatcacatagtgtcttgcatataataagtacccaataaatgtagtcagagaaggaaaacagtgtcagtatatattggaaataaaattccttaggtaagccggattttagtaaacgtcaataataggaaacatttatcaagcaaacttaagtcccacttacatttgctcagtaactgaatcaataaattatcaagtgtttattatataccaaccattttactaggcacagttcctgcattctggagaattataaactaaaggagttagtcaagcaaacaaaccgtgacagtacagtttgataagtcaagggcaggcggcatttcaatagaaggcggtgagaggtcaggataggaaaggggatggtagaatttaaggcaatggaaatgatattatggaaggcaaaaaataaggtatgcatttgagaaaggttctccaggaaatactggccttaccaagggggcctgggaggtccaacatacagtcatattgttctaaagagagattggtttctcacatcagtaccataaggcattccacaatttggtcatgttagtagtaacttattctatctatctggaactcagatggcctggagaagttctctctccatcctggcccttcatccatatatatgtcttcatgcttgattgctttaacccaaacatgaaactcaacacttttgtaagttccttcagaaaaattcattctcacaaaagcattagtgctcacaaatgcttaaacagatctgggatttagtccccacaaactcaaaaacaacaacaacaacagattctgcatatttctgtctttataaatgttcttgttcaccgggaaatcaaggatttccatctctctagctggtcccccagctagctccaagcctacttggttcttctcttattaatcagagaaaatgtttctcaatatagtccatgaccaaacagttgtgcacatcacggtggccaatagaacagagatcacatagtcaatagcatccactctccttttaaagtctcagtcagttttaattaaaccacttctgtttaatcgaaccacattattaagcagtgctatctgaacctggttaccatcctgagatccagaattggtgagactggataggcagaacccttgacaaaatgttgcctagacatacttgggcatagcatccctttcctactaacttgttgaatctctgttattaaatgcattcctttataaagcaagaattaaaaaacacacgtaccttaaaatttatggtaagaaataataacatattcatgcatatctcagattttcatatcccacccatatctcaatttttcatagaatgaaatatttctaaaaagtcaaaaccaaccaaaaatccctattaattttaaaacctattcattagatgccactgtgtcttgctaagcacttgaatctacctttgtgtgaccttcttcttcctctcacaccaatgcaggcctatttatccataagaagcccagttataaatgtgaatgaatgactgtatcagtgaaaaatgctcaatagaaatattgcaaaatgcaaattatgaatttgcattgtagcattttttattcctttgttcttctatatacttttctgccttccccaacttataaaaataattatcattgattgtatttataatcaaaaaagaaaagtaattttaatcttataaaacaaaaaaagtcaccggcttccaggcagttcagtcctaggacaatgtttcagctgaaaggtgaccatatggttacttcatggaaagaaagagattatgaagccaggccctttcatctaaccggccgcctaatgggttataatttaatatgcagaattacctgctctttccaaggtctctaaccatccccagagacaatggaacagatgtgcagcctgtcataaggccaatgtgaaactaacatttacagcagaagctggaaatcttctccccacgtcttccacgcatggaagtcctacttcagggccaagtataaattcagcttccccaggaaacttccctgagccttccaagactggggctcttcactccctcagcattctgtgtctttatcttcatgtccctgaggacaggagtctcatttccgtttgttcattggtaaatttcccatgcctagctaagtgtttcacacataatgggcatccaagacatgtatttttaaactaatctggatttctggttggtttcaatagatcgatcaacactctaagcaaccaaaaactgaaaaaacactttgaaaattatgaaattctattaacaggcaaggtattatgatggtactgtggttctgatggaggttaataccactcttactctctttattcatcattattgggtaatcattcatttaatccctttaagagctattcactaatgataagtgagttggaaagtataacatacgatcacaatgatcacttacacattcagaaagtgtattttaccatcctgggtaacataacaattttggtgtttttatgaactgtgaactgtatcaaaatcaacacgtgagcagctagcacagtactaggcacttggcagaaatgagggaaagtctcactgaataactccttgggagactgggggaccaagaggcaaaggggctcaggttggtaaaatagtgtaaacctgtgaaaatttggatgctgtttttaagtctcatataagcatatgagttctaggggtggggtgggcggggatttttgtctgatatatcccccgcacctagaatagggactgacccatggtaggaattcaacaaatatttaatgaaaaaataaaagtagagccctaagacagaccctaatgcagattatgacttcattaacatagaccttatagccttttctttttcttgttactcccactgaaagtgtacctgtgggatcacctcatgattagatggaccaatgcagtgaagctggtttttcagaattaggtagctttctttttatatggctgtctagcaggcattcgtagaccctgctggtgtctggaatctgtcttctctgtgtctggtagatttcagctgacctgggtgtctctgtgggcctcttttgttggcagactcaaaggtgaactcattagccattacccccttggaaatatgttctgggaaatcaaacatgctctgagtcacatctgtctgccgcctaccacaacagtgtagtatgcagactggttctgccaataggcttctgggaggaagaaatggaaaatctgtcatggtatgaactgcacagctcaacttggagaaggacttcagtccacagaaattcacagagtgaaggcaggctcttagttctcttcatgcataggtaagcctcgagaaaattcccaggtccctgcagaggaggagaaaaaatggaaagaggtggacaagtggattgtgttgggcagggcggcgacactcagtgctttccagaacggcactttggcttgttctaaatggataatgtcacatggctatgcttttgtacacataaggttgatcgctacttcaacaaggtgccattaatcagcttccttgctcctggtacaaactgaagaaagccaagaagcataaaacacatgcctttcctcagagagattttttattctagagagggagaaaagaacaaaaaactggaaaggttaatgaataaaagaaggctgctcacaatcccacacccagtgagtaatacacaaagaaaaccttatgctattgcagagagcaaaggatcactatgagctggagaaacagaaggcattaggacaggtagaagatgaagaagacttatgccagcagcagagactgcctgagcaaacctatggaagtgaggaggctcctcaagaagccaagaaaaaccttgggtctcctgaacccaattctcaggctggagcccagtgaggcaaatgaattgcccaaggacacctatgagtaaatgttggggacacttagaattcaagcctctgggatctgagcttggttatatcctctgtcaggtccctgtccagtgagtggtttagtgaggcgaagagagagggagagaacatgcattgcaggctcttgcactctatgctcaaacaggctttcccatttgctactcgcagataccctagactggcatagttactgccattttatagataggttcaaaggtccccaaaataataggtgacttgcccaaggtcacacagctagtggaaatggatgttgaactgaagtctagctgtttacaaagcccagtcatctcagctatgtcaacttggagtcaagggtttccactgggagtaaggagagataactgctttaaactctgctttttaaataatgttcaatttgaaatagttgaataatgtccaattttaaaaaatgattcaaagatttattccagtattttaaacattgcctctggagggagagatggcactgtaaggtggtcaggaggacgttgttggaagttagaacaccagatgagttgtctgaaaataataatgttgctactcgactgttttatattactgtaaacattacccactataataaaatcagacacaggttcaacatctcctgtagtaataataactcttgtctgccttctaaaatgactcctaaataacaaaccctccataaactcaatctaacccaaataaacagaattgctgtgacaaccgagatcataattgtctttgtttgatccttcagcctccacaattgtgcaggctctccacaccgagtcatggccttgtttatctttgctgtgtgtgctctgggaagctttctgcctagagaattagcacactcaataagcatcactgttctcttcagttgattaaactccagcatactcggtctgttagcaaaatgtgttgggctgatatcacagttctagctcacctcacctcatgttgctctttttcaattttatcttagactgtgcaggttttctgcatcataaaccaaattaatcactgagatctgatagttataacagattctagacacataaattatttttcattagctttaattgcctgtaaaggaatttggacacttaatctaaggaagtgaaataatgtggttcagctctattagacaatgtaaagctctcacttattaaaaaataaaaagtgtagaaaggtaagcaaatttccagtagctgcaaccttaaggtccttccacaggaagccaatctctatggccaccaacagagctgtctttgatgttacgtgcaacttcagtccacactggcttcagtgccttcagagcaggtctctatctcctgaagatccaggtctttgattctcctatggctctaaatatatataccaaataataatgatgactacaattaattatttttgtgcatactctgagccacgctctttacttaacctttatatgcacctcatatgaatactcaagtagatttccaaagtggctatcattatccttattttacaaaggataagactgacacagagggattgaattcctttctcagggacataacagtacacactgaagcagaactcagactcaggcctggatgagtccagagcctgtgcattccaggatattctgtgctctcctgagactccaatatagactgtgccatgctgcctcctataggagtaacagccgctcctggcgtgttttctctcaccacctagggctcagccagcatgaacaccacgtcaacttaacatgaaagctaacttcaaacattgagtctagtaggtcctttcctggtacacatggttcatgactgtatccccagtacctcacagagtacctagtacattgttgatgctcagtcacaaatatatgtttgttataaataaataaacccaataaataataaataaataaaatataaatatatatacaacatatgaatggaataaactcactaagtgaacatttttggagtgaatgaatgacttagttgattattcttggtagatgctctaagtggcagtcccttcattcacctgttcttcccccagactcttcattcgtagtctttcaatccatattctttcactgttgctttcattcccatatccccaaacatttacactatctgtgaccttagaacttataccccatggctctaaaaaaatgaaaaagtatgaccacacatattccattttttcatagactcatgcctgacctcctcaccttaactgaaccctggctttccctgcagtcctcttgagtgagggtcatgcattcacataggctctgagtcctgtggaatctctagaataattttcacctcctaagtaattcttgaatttgagccctttcatctattctccaactgtctcctttattcagatccttatccttgctttcctgtctcctttggtctatgcttttctttaggaagtccatttaattgctggagggagatttttccaaaacataaatccaataggttgtatccccacttaaaatttttcctaaacactttccaagcaaaccacatagtctttcagtggcatagcacccttcacacacaccgccaggttcctgtgctccagatatgcagaattagtcacgtttccctgaagagaccatgtgtccctatgcctctgtgcctgttcacatacaatttcccatgcttggatgcctctgtacctgtaccttctttccctggaggactttcagtggtgtgtttcctggtttccaaggtgagttaatagttcctcactggtgctgccatatacctgattatacctacgtcatagcacttgtcacatttctgcatttttttctattttcacagtaactaaatgttctcattgtctcttcatacccagtgcccagcatatggtaggtgttcattaactattaactatataaatatttaaagaatgaaaggagagtcttctgacactaggcagtctacagttccatggaaaataaccacaagtagaactcatcatctctattccagactactgcaatggctttctacctaatgtagctgtctttgttcttgctgtccccttcaaattccacttacacacaaatgccagagtgatctaacatggaaat

SEQ ID NO: 1395 - DNA, 717 bp, Homo sapiens
gggagcatggacctcagtcttctctgggtacttatgcccctagtcaccatggcctggggccagtatggcgattatggatacccataccagcagtatcatgactacagcgatgatgggtgggtgaatttgaatcggcaaggcttcagctaccagtgtccccaggggcaggtgatagtggccgtgaggagcatcttcagtaagaaggaaggttctgacagacaatggaactacgcctgcatgcccacgccacagagcctcggggaacccacggagtgctggtgggaggagatcaacagggctggcatggaatggtaccagacgtgctccaacaatgggctggtggcaggattccagagccgctacttcgagtcagtgctggatcgggagtggcagttttactgttgtcgctacagcaagaggtgcccatattcctgctggctaacaacagaatatccaggtcactatggtgaggaaatggacatgatttcctacaattatgattactatatccgaggagcaacaaccactttctctgcagtggaaagggatcgccagtggaagttcataatgtgccggatgactgaatacgactgtgaatttgcaaatgtttagatttgccacataccaaatctgggtgaaaggaaaggggccctccagctttccactgcagagaaagtggttgttgctcctcggtatatgtaatcataattgtagatc

SEQ ID NO: 1396 - DNA, 606 bp, Homo sapiens
atggacctcagtcttctctgggtacttatgcccctagtcaccatggcctggggccagtatggcgattatggatacccataccagcagtatcatgactacagcgatgatgggtgggtgaatttgaatcggcaaggcttcagctaccagtgtccccaggggcaggtgatagtggccgtgaggagcatcttcagtaagaaggaaggttctgacagacaatggaactacgcctgcatgcccacgccacagagcctcggggaacccacggagtgctggtgggaggagatcaacagggctggcatggaatggtaccagacgtgctccaacaatgggctggtggcaggattccagagccgctacttcgagtcagtgctggatcgggagtggcagttttactgttgtcgctacagcaagaggtgcccatattcctgctggctaacaacagaatatccaggtcactatggtgaggaaatggacatgatttcctacaattatgattactatatccgaggagcaacaaccactttctctgcagtggaaagggatcgccagtggaagttcataatgtgccggatgactgaatacgactgtgaatttgcaaatgtttag

SEQ ID NO: 1397 - DNA, 22055 bp, Mus musculus
  misc_feature (12157)..(12460): "n" at positions 12157 thru 12460 can be any base
gtagcaaagagaggggaagccataatcagaatatatcttatgaaaaagggtatcctcaataaaacaaaaatagaaaacaaatctattttcagtaaaaattatggactcctattgtgttatttcttattcttttttttttctctttattttcctcgaatgcatatgaagatacaagctgggcttagtgacacaggcttatgactcctgctattgagcccacaaaggcaggaggatcacagacttttattcagcctgagaactgagtgaaactcttcttcaaaggtaaatagtaaaatgaagaccctgctatttacctgagtatgtcagtgcttgcctggcatgtgtgagtccctgtccaactcatgaaggatgacaatattcaatcacctataacttaaattgttcattgtaaaataatttataataaaaagaaaagaagtatggtcaaagaagccatttatggttttttttcattttttttatttgatattttctgtatatacatttcaaatttcaaatgctatcctgaaagttccctataccctcccccagccctgctcccctatccacccactccagcttcttggccctggcattcccctgtactggggcagagaggtagatcaatagaatataattgaagacccagaaatgaattcacacacctatggtcacttgatctttgacaagagagctaaaaccatccagtggaaaaaagacagcattttcaacaaatggtgctggcacaactggtggctatcatgtagaagaatgcaaatttatccattcttatctccttgtacaaagctcaagtctaagtggatcaaagacctccacataaaaccagggacactgaaattaattgaggagaaagtggggaaaagcctcgaagatatggtcacagaggaataattcctaaacagctatgtatgtttttttatctcctaccaaaaggtacattttcaaaagtacagagttaagctgacgtgaggaagctgtttgagtaaacatgaagattctgagactgaaacataacctttggttttcctgagttatcggcatttaatattatatagggcttcccctaaaataaaaattaacaatgtgcaacaccattataaaatatgtaattgtagttgttttcctagcattacagctaacatgatacaatatggaaccggtccaggttcaatgtgtgagttagaaatcaattggagttggcacaattttctgataaggactttattggctccaataatggcacaggtcatgagaaaggcacaaagactgcctgtgactgccccaattccagcaatcaatgtcaacatcccagttctttactaactttgcttattggtctcagagatttaaagtctatcacttaatttattttacatggagcatatagcctgattaccttacaatgatatgagaagtctaaagtaacaccctggacataaggttactgtgtatcaaagcagggtgattttactggccaaggttcaataaaaaccagctcaaggctatttttgacgtgaggccttatacaacatcttccagtaactctccagatatgccatgcttggaacaagaatactgggctcttgataaagggaccatttcccactcatattttaaatgtaacaacatgaagctatccacatattatttgacacaggagaaaagacagataaaatgtacaaaagggataatttaacttttgacagaggagacattaaaacctagtttttggttataacaagaacaaagattcctttcttgccaagaaatgaactgtaaatatcccaaggccaattcagtaagcatagaaattgaacaacttttcatgtttagctagtcagcagtgaaaccaaggtgctacactgcagttagagacattataccccaaagttttattacaagtattgtattacttcaattaaagacaaaatttaatggaggttttctttaattgtggttatatttttgagattaattatcactaggattaatgagctctcacagaggggcatgaacataaatgtcaggagaagagtcaactgtgcattttgatttatgtatatttatacatgtttttcatatatttaaattattaaatgattcaatatgttaaatgttactcatgtaattttttaattatcatcgtgataaatatgatatttatcataggaaagctctatttgttatgattgagtaggagcttgtagagtaaattagaatgttttcttaggaacattttaaacatatagtaaagtagaaaacaagtataaatgctgtcatgcctactttttggattatcaatttttaaaatttaggctatttgttttgtttctctattctcagcccaactctgtctcttttgtcttgaactatttgaaatccaaatatatcctttttaccctaagtctcttaagtgcaatatatttgaaaataagtattaaatagtattttaatcataaacatccatagtacaaaaaattttctctatatatatccatatatccttatatatctcatatattcaaatatatatttgagatccttctcatttttagacttcacacaacctctctctctctctctctcacacacacacacacacacacacacaactaaaaataagcaaaaattaagaaattctttcacataggattcttcagctagttatatattaaaataattgttttggaacaaataaatattagcaatatacatacatatatatatataaaataaggagatgaaaagattgtgtgtgtgtgtgtgtatgtgtgtgtctaagttggaggacaatgttgtatagggtggtcagttattaagatgcaattcatgtcaataggcaaactagccagtgcttttatacactgagcagttttgcacaattgcacaccttacatatccataaattaatcacaatagagaaaattgaaaaaatttcatagctaaatgttggcacatattcatagttgctcagtttatttccagaagacatcttattagatgaagctcagtaagtttccttattagatgttttcatattctttcaagtccttctggttattggttcatgtatatgtctgtgtagctttgtgtgtacctgtatgcacatggatgcagtggccattgaatagtctttggggtttttttcttaagtgtaactccatcatcaaccttgtttttctgacagggattggatagggactcacacatgctaggctagccctgaaggactcagaaaaacattcagtttccattgtactgtttacaaggtatgctgtctgaatacagaatctcagagatccaatcagactctgcctcctccttcccatcacagggcttaaaagagaacatcctcagtctagcttttgtttttaaatgtgggttctggtgatggactcaggtcttcatgactataaggcaagcaccttgttaggcaagctctcactatctagtcaggttcttttaaaattttttgttgttgttgttgttttgagacaaggtttctctatgtagccctgtctttcctggaactcactctgtagaccaggctggccttgaactcagaaatccacctgcctctgcctcctgagtactgggatcaaaggcgtgcaccaccatgcccggctggttcttttaatcttaaattttgtctttcctcagtgaacatttttagtttgtgatatattacattcgtgattcatttgctaatatatatttattcaaaaaacaattattttaatatataattatctgaagaatcctatgtgaaaaaatttcttaatttttttcttatttttagttttgtgtgtgtgtgtgtgtgtgtgtgtgtgtgtgtgtgtgtgtgtgtgtgtgtgtgtgagagtgagagtgagagagagagagagagagagagagagagagaggttgtgtgaagtctaaaaatgagaaggatctcttggagtgcttgttactgtcaattttgagctgtctaacttggatgctgggaaatgaactctgaacctttacaagatctgcttatgctcttaacttctgcacccacactctaacctgtaattatttttattctctgagaatttaatgcatatctacaatcaaatgatcacatctaccaccatttctgaactctctgtagattatctcccaaagtttatcttctactattttaaattttaaaatttctctactaagttcctgcaaagttcctgactgtattggctgtttatttatatagttctgcatttttttaaaatcaactatccagatccctccctccctccttctacctcctgtgattattttgttaccccttctatgtaggattgaagcattcacactttgtttttttctttttctttaggtttatatgatttgtgatttataccgtgagtgttttgagtgattaggctaatatccacttatcagttagtacaaaccttgtgtcttcttttgtgtctgggttaccttacataggatattttctagttccatccatttccctgtgaatttcatgaagtaggggaacggaaatacaggagggcatgatcaggtatggaaagaatcagaagagaagtacagagggtcatgaaatttaacagaaatatgtggcagtgggacatagggaactggagtagccactagtaagtcctagatcccagataaggaagtctcccaggacccaattattatgatataagctgaaatatgcaagaaaggggagagagaacctgtaaagaccacctccagtagataggcatgcctcctggttgagaaatggggccacccacccatctcaaaaattttaaaaaagaaatgttcctatacaaaagaaagacaggaacaaaaaatgaccagagactgaacgaaaggccatccagagatccagcccatccatagacactgacactattgctaatgccaagaagcacttgctgaaaggagccttgtctgactgtcccctgagaggttctgccagcatctgaatattacagatgcagtcacagtcaaccattggactgagcctgaggaccccaatggaagagctagtggaagggctcaagaagctgagggcaattgtaaccccataggaagaacagtatcatctaactggaccacccagagctcccagggactaaagcaccaaccaaatagaatacatggagggatccatggctccaactacatatgtagcaaaggatggccttatctggcatcagtgggacaggaggcccttgatcttgtgtaggcttggtctctagtgtaggggaatgctagactggtgaggcaggagtgggtaagtgggtggaggagcaacctcatagaggcaatggggagatgaaatgggatgggagtgttgtagagggaaaactgggaagggggatataatttgaaatgtaaatgaataaaatgatgaataagaatgaatttatctttttaggaaaagaatatgatgcctatacttatgattaaatgacttgaagaagttccatggacttttcagacgagtctgtaaattatgaacttaaatctcaatatcacaacagatgtctacctttattcacaaattgcattagcaataacagtatgaggatcaaattttatagacatcccagtataaccaaaccaaaccaaaataaaccaagttaaacacatgaccctcctcatttaagcacatctatatattcctatgttaccaatgaaaatgaggtggtaatttaaatcctagacaaatgaccactttgcaagagagctttttaaggaatgaaaccttttgttagatttctttggtctctattcattactctctccatctacatcatttcatttatcccccttaagtgttaagttctctggctgcctcttttctggccattttgccattattccattattcaacagagacagcatacttgactcagaaagcatgcttggctcatcaggcctgctcaaaaccttagtttcttatataaccttaaatgttggtactaattctaatttatttgcccaactatacttatgacacagaattctacataaaaatattacagggctataatcatattaaattaaatatgctcctgagataatctagaagcaatttatttttatatgagttttgaatatctagtgtaagaattgatgtcctggatagataaacaataaggaaggtgctaaggaaaaatattcttcctgaacttggaaaagctgacatgctcactggaaagaggaagcattcttaacaagccaaacccaagggtcatataaattttctggaagcaatgacaaaccctacccatgaccttatcgtatgcatccctgtcatgcacataagtgccctttccttaatactcttatgaaatcacaatatctattttctgacactaccaatagttacaatggacagattcaagggagatgaggaaatttgaaagtcctagaagagggtctagcatctgtggtagaggattcaagtggtgtctttatcagagaacaggaatagtctccattagttctccaactactactttctatctcgaacataatagttctgtaacaacaattgctaatataggatttctcagtggaagcagagaatgtaaatactctaggaatacaagggaaattaaaatgagctggagagtaagaagaagtagattaaacacaggcagtaggcaagaggtagtgggaagtttgaatatcttctttatgattatattccttttagtgtcttcgattgcttccttacagctatgatactgaatcctatgcatcccagcatgtttttcaatgctgcttttctgaattatacttctatgtcaggggcaaaattaggtttctccgttggcatcactgatctccataagaatgctcagagtaggggaacattcttaagatgctcatatggtaatgataagaaatgttccatgcaggaaatctccctgcaagtctatcatccagccttcttctaggtccactatcaatgtgaactagcatagtggcccatcaccagaaacttctcatgtaatccgtagatagtttgaagtgacccagtgtgaaaaggtgaaacagaaatgccagtgtagcaacatttatctctagaatgaggtagaagagggaaatgtaaaataaaaagactttcttatgaagtaagcctatttaatgaataagaatacctgagagagaaataataagatatggtcaagatttgagacacaatcccaaaatacaaaacccataaatgttttctaaacttacattttcaacaaatgtccactttcctttagaccattcctattcttttctcccatcaccctaggtgaactctaagaaggaactgtcttcttcatacatcagctgcaccagtgatccccaggcctacggctaacaccattatgctttgtttagggagctctgtgggtactggttagttcatattgttgttcctcctatggggctgcaaaacccttcagctccttgggtactttctctaactccttcattggggaccctgtgcttcatccaatggatcatttatttttatttttgtgctaaactttcactcaaatctgtgttttgaagttgttaaataaatatcttatgaacttcatataaagttagaatcatttgtttcattttgatttcaatatttatgggtagctttaaaatctccaaaatttggttttgtatatttaaaataacaaatgaaatatccatgtatgtatatacatattcatatggttatcttttttcatctacccagtatcttttctatttgactgtactggatacatatatatatccattgtttgccataaatctttttaaattatactttggaataattttaaattataaaatttgtgagaatttcaggttatttgtggagagagtccctttcatggttttacagtcactgttacattgtacagctagggtcaattctggaccttctagtacaccttcacaacatactatgttcattttagtttaattaacaatttctttagtcaatttatgtcttgacaacagccctccccttctcctagtcctacccttactaatacattacctcatgagtccttcacttctcttcagaaaccaggaacaccttgagcatcaatttgtcctaggatggaaatttcccatggaataagttcctttgggccagttattggttgggcgtttcctcaagctctgctccatgtttatccctgcacatatggaaggcaggacaagttttgaattgaacattttgtggatggtttaatgttccctccctccacttgcagtcccccctggctataggaggaggccacttcagtttccatacacccaactattatgtttctcagtgagggttaaccccatatactcctaggaatctccttatcttcccgggtctcgagatagttccagagatgcccctgccccaatttgtattctttctcccagccctctctgctccccctctccaaacctaatcccaatccccgttcaccttcttacctcaactcccaactagatccttccctccaacaacctccaatgactattttgtttcctgttctgagcgacattcaagcatcttctcttgggccctccttattactcaatttctttgagtctgtggattgtagcatgattatcctgaactttatgtctaatgtccacaaataagtgtgtacacactatacatgtctttctggtctgcgttacctcactcaggttgataatctcaacttccatccacgtgcctacaaattttatgatgtctttctttttgatagctgaatagtattccattttgtaaaagtgtgtagaaaatataccacattttctttatacattcttttgtgagggacattgaggttgtttccagtttctggttattacaattaaagttgctatgaatgtagttgagcatgtgtccttgtggtatggtgaggtatctttgaggtctatgcccaggagtggcatagatggatagaactattcttaatgttttgccaaattgatttccaaagtgattatacaaatttgcacccttaccagcaaaccagtagtcttccccttttctacatttttgccagcacgtgctgtcacttgaggttttgatcttctacagacactaagagaacacaaatgccagcccaggatactatatccagccaaactttcaattaccataaatggagaaaccaaagtattccatgacaaaaccaaattcacacattatctttccatgaatccagcccttcaaaggataataacagaaaaaaaagaaaaacaatacaaggacaaaaaccaaaccctagaaaaagcaagaaagtaatccctcaacaaaccaaaaagaagacagccacaaaaacagaatgccaactctaaaaacaaaaataatacgaagcaacaattacttttccttaatatctcttaatatcaatggactcaattccccaataaaaagaatttatcacttttaatcaattaacttacacctacaatttttaatctgctcagttcttactaatttttagacttccagatgaatattaagaaatctctatacaagtgaggtttttccaaattgattctaagtacactcatatttatttttcttaactaaatagttttatcttccttaactgatgggtaataatactttacaaactatgtcatagcataatttgtgccccaatgttgccattgtttgcttatgcttcccagaacagagtgtctggaagagggtgtggatggttcaaacttcactcacacctgaggtaaagcaggtcggctaacgggaaagaggtaatgtttatgagaattcttagttcttatcagaagagtagcctgttctttcttggaaactctttgagtctgtgccaaatgctgcccaccatccttaactggatcaatgttccagttatttactacgatgtccctccctcaaattctgttataaaaacacagtcatctctgtcctgacacaccatccagatctctggaagacaggtaagggtgaactgaaagatgctgaaaggtaggcatgggttcttctctcacacacaggacaggtgtctgtgtcctcagacaacacagagttttgtaacttgaggtatttaggaagttctcagggagaggaaaaaacatcaatttccacttaattcctgtatcacaggagaaagacaggatgatataattttcccttgagagttaatcaaagaaggggagggacggttctctctgaatgtcctcactaaccacacaacctagagttattctggctattcctccctcacagacaagatgctgcctccaacagcctgctccgtcatgtcctggatgctgctctcctgcctgatgctcttatctcaggttcaaggtaagacctctctgcatgtagcaatgatcccttgaaagtgtttcaagataggaaagtttcatgttgtaattaggaggaaaaattcacacaagtaaactgcctgcaactttccagcctttcttcaggtcattagttatagaagatatcagacgggtcatctctgtggaaagacaagatttctcatgttgtcagaattttgtaatttattcttccaagattaaaggggaaaatatgatggttaatatgaactgtatagaagaggaaagatggacaggtgtatttaagcctctctgcccagtgttggtagagtcatgaactaatgtgtagaaaagaagagaaaaatgatgctatcccatttactatgtctgttcatcataattttttccaaagactattagaaagcttgatattgattttcttccaaaagataatctacaaaaatattcctactttaacctttcatctaaatctcactactcatctcaccccatcgctctatttatctcactccaccccaggtgaagactccctgaagaatataccctccgcacgcattagttgccccaagggctcccaggcttatggctcctactgctatgccttgtttcagataccacagacctggtttgatgcagaagtaagtgctgggaaggagaaggtacacaaggaacacacggaaatgttaggttctatcctccctaattccttccatctgagaatagctgactttaaaaataacctctcctcttgcttacctatgtcttccagtgaagtctaaatctccttttcattttgattctcacatagctggcctgccaaaagaggcctggaggacacctcgtatctgtgctcaatagcgctgaggcttcattcttgtcctccatggtgaagagaacaggaaacagctaccaatacacttggattgggctccatgaccccactctggtatggtaacctcttctctgtttcctctcaatgatcgtatcatgggggaatacattatctatgcgtccccagagtgaacctggaaagacagagatcagaccccgcatgatattgggaccagggaaaccatcaggagcagttgtcaagctgagctctatgaatgtcttagacttcagatgaagtttatgtgttaattattgacttttacagaggtctatgtgaggatttggaattattctcatttagtttcagggagcaaacacacaaccagtcaagaggcacagaaataaagaggcaatttacattttctcttaatagaataaccaccttccttccattttaaaggaaattgctgatttagcactatttatattttgaatacatttcaggggatattaattccatcagtagtttctgtgtttataaatagacatgaagacaagaataatttctattggtgtgctcttgaaagctgcatatgatcacccaagttctgggaggctgggagggaatgaagggtttcattcacagttgcacacatgcagagctttggacccttcctttcatctgcatacttcctcactagggtgcagaacccaatggaggtggatgggaatggagtaacaatgacgtgatgaattactttaactgggagaggaacccatctactgccttagaccgtgctttctgtggcagcttgtcaagagcttctggtaagaaggagaagatctgtgtagcctaaatgcatgcccctcttctcacatccctgggtgcctctgacctaggaaattgaatgtgttcttgctttctctcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatctgctctttccatatctgtctttagtccttttggtataagtttgggctcaattctaaaataaaaataagctttctgtcacactttgagtttttgcattctattaatattattgtctgtgaatgcatgtgagcatgtatgaatgtaacagaattcttatggagatcagaggataacttattggaatcagttgttgctatctatctattgagaaagggactctcatatttttgctacaaagtaaattaagaagaatttgttgatggcataatccacctagcatccacctaattttaagtaagttccctgagagcaaatcaactctatttctggcttaagaaacaaatttttgatccatcaatccaatgtgctagcactgtgcataatttttaattgaattctttttcatgcaaagtattttgattatagttttccagagtattcttacaagtgtagaaacacaagctgttgaactccatagtggttcaaatacagttagaataatggaaataagcacaactattaaagaaacatctttattttcaacaaatttcaaataatgttttatgtacaaccatcagaacatattataaattgcttttgatagctcatgtaaatatcatgatcataagatcaaactcagatgtgttgtggaccacagtataatgtaagatctttaaatatgattgtgctgagaagtgtatacaagaaggctaactagaggtatccagtacttgcctgcttgtctacaaggcagaatcaagatgagtcctgattgttgaaactgaaatttaccagtagacagaatgacagttagaaaaacagagacttcatcccagtgaatctgaggaggaaatagtgtccaaagaactgagtaagtagcatcaaggaagaatgaaatgagggactgggtcttcctttaatggttagttatattgttaatgtgccgcagtgtggaatcaagtatgaggagagtctctatgaggaataagttacctcaggctggtctgtgggagtatctgtgggagattgtcttgatagttaattgatatattaagacccatcccatttcatttggcatcattctttaagtaagtacacctaaacgttttagctgagcacaaggtagcaggcacactttcatttctttctgctcttgaccatatggtgcaactatctgtctggagctattgctactaggtctaaatcccaatgatgaactctggctaggagcagaagctgaaataagtctcttctcaccatgctgcatttttttccaggatgttttatcacaggaataggaatgtaactagaactctggctaaagatgagacaggacagtcactgtgagccagagcttcccaggaaaaagcaaattcagaaatcgtataagtggactatggaggtgatctggcattagacaacatctttggtcccacctataaatccataggatgccgaactgggggacaacttaaggggggggtgaacttacttgagttcagagcttctgagttgaatggtatgatcagatctgatcagatcagatcactgcactgacatagagggtggctccttcagagtcattttgaccagggaaagatagacacaaatcaaccaggaattatacgttggaagaatgcaaactcccattagcaagaaaatggaacatctgctagtctaattttcttggtctaaagtactgattagtgttacttaactttgcattggagccaaatgtaagaatatcagggttatgagggaaagattgataagaacctgatccttgtcctgtcgcttcatgaatctctgaccttggaacactcaacaaagctgtcttttatgatacctgccctgggagtgtgaaacaaaacgtgaagagaatctatagggaatttcatatttatagtagctccttgatgtgtagaattccttgtgtgactgcgagctctgctcgcccagtcagtgtaggatgaactcattctcacacttagtatctttttttcttcacttctttacctttctcatgacaccatttttcccatttaaattgagattttctggttttaagaaagttcaaagctgtttatctgtacccttttggtagttacatggaagtaattatttaaacaataatttaaaaaaggttgattgttcaagtagattgcattttgctaaaaataatacttcaaagatgatatttgcagagaatggcttaagtaacatcagactctatgtgtcccaacatgaatgacatatataaacaatcagtgtgaagcgagggcaatgccttcatttgttcacattatcttccaaaagccctgtccacaagttcatcatagtatgccagtagattagccgttagacactgtttcatagaacaatggttagaactggaatctcccttagcacttccttgcggttcctttggtaactactctgcatgacttcatgtcttattgtaaaaatggagcacaatatcacaaagtattgactaaattttattattgttctccgaatccttaggccagagtccccagagaatacacttatggaagaacagcagagatgagatgaggaattcggtgtcggggtgtgagaaggactttcttggtgagccatcatgcttgctcctttgtctatgtgatcttcaggatactttcaggcagttgaaatcagaactggcctaacccttgaatttgcagacatagggaaatattgtgtcacaataataatctctccacttctgataacctgcagagagacaagaggtaaagggaatgggtctggtaaatttgtggttgtaaagaaagaacaactcaatcctctgctctggacttagacttctgcatgctcttcatttttgcatctttaagggaagaagacacagaaggaaccataagaaatgactgatcactattctacagtgcatttgccagcttatggctgtaccttggaggtcaacatagatgtggtaaatgggtttagttagagaaggcttttctctctcttacctgaggcctgagacaaagctgcacagtagccgtggtgtgcagacatggagggtggtatctcccagttatagaaggtcagagggtcagagctgctccacttccatccattttcattgggcaaactcccctgaatgtgggaagcagtgtgcagcaaaggttcattaacactgcatgaaaacgtcactgaaatacctgatttcctgcttattgtccttaaacattttatgatcatacacagttgctttggggggtagattaatatttgggaatttcttaatcctatttacaaactccattaattataggatgaaattagggttactgaaatgtatctcatctttgtaagttcaaccagtgttacatttgagagttcttcagacacgtgtggacaaaatctattctataaagaaattacagatgtaattctgacagcatttcctgacaattttatgtgcagactttctgaggctgaagaaaaattcatccaaggtctcaataataacagtaaaagtcaacaacagtgatatgaactttgtgtgaaatctcagacatctacaaagctcagctcttcagctgtagttccccttgttctaatgctacacagcactgaagatctaacacccatttggttcttcatggggagttcgaggtactcttccacagggacaaaaggcactaaggggaacaatcaaggcaaagataggaacccacaagtgacagatcatggagtccaatccagatgtatgggaatgtggtcaaactgtttttcaccagagaggacacaaagataatttcaccataagtgagcagaaatgccaggtgtcctgagaaatgcttctggcagtggatctgtgtgaagaacagaatgagagagagagactgaaaccttactagaaaatggcaaataatatgtgatggattgtatacctctcactcagctataccatagagattgaaacccagcactccttgacccacaagtattttgtcctattgctcccaactctgcctgtcttcacttacctctgcattagcccaggtctgtggttccagaatcagtaaatagcagtaggagccataagcttgggcttcttggggacagctgatgcgtggagaagacagttttttctgggattgttcacctggtttaaagggtgatatagtcagtgatggagtgaatgtgagagtggagtggagagaaggaggtcaacataaaaatgactcctcaaccttatttgagattatgactgtaatactgagtgcttcctcttagtattttcctagttgttgattttgactatgtctgcatgtgtatggggtgagcatatatgtgctgggctatacatgaggatatggacatgatgccagaggtcatttcttggtctgtatttatattggacttttaaaagggggtttcttgctggctttgtccagtttataattttgctagattggccatccagtgatacccatacaaattcctctcttgtcctcctcagaatttggattatggccacctaccaccttgtcaagtttaatttacatgggttctaggcattcaacttggcttctcatgcttgcttaacaagcacttcactagctgagatatcgtatacccaacattaggttcttaatttaacaagacattttaatgtggagaagcgtgcctttttaattttaccctgtcttcatactcatttattctcccttctctgggataacagatggagggctttatattctgtcctctgtgtccttccttagagttcattactgacctgtaagctttcttttttcaaccttccaagatagttagagtttgctgatgacacgggggaaactttcattctataacagtgaaacactgtggtatatctcccctcttccaatgatccagaggaaggaaggatgtggaagatttttctgtgtggattctcctcatacttaacacacgagactctccagattccttctctctccttggttctcaatattcatggggaacccagtgctagacacacaacaactttaccttgtacccaagaaagggacatcaggcaacacagtagcatccaggacatgctatgaagggtcttgtgagacaccatggtatatctgtgaggtaaaaggagtaagcccctgaagagagtgtggttagaagtgacataaaaggagaccacaatcactttcattattatttatatagctctgcaaggaaaaaaaatctaatttcagtctgatccccctgttttctctggttccggagaaaaatggaagggacatgctcatctttcagttcctagtttttctgagttttagagatttgccttgtgaggtcagagaaagttctccatctactactgcagtgtgggagacaaatacctgccagccttgcattgtctattagctccacttacctgtctatacagaggtctgcaatgctttgacagcacagaggtgatttcacttttaaaacgacatctgaagtagggccatgcaagtgaagaagtgccagctcctgctgctctctgtagtgggtagtgcttggcacaggttacagaagatttcccataagaatacaggactactcagggcagagagtgagaactgccacacatgttcctttcctgttaatctagctctgacctcaggtgctgattaggtttgaaaatggctaccctctaccaggtgtcagattctgggaaacttaagtaatcacaggcagtctcctgctaccgaatatgcagttttataaaaataattacaatttataaaacttacagtctttatttttaaaagaattgtctctatttgtgtaaaaccaagaatgcgtctttagttgtactgaagaacttacttctgtagatacatgaacatcatctcataagattttaggtatatcaaaagtgctgagttttgtgtgttaaaatttgattttttgagtggtgtagaacaagtgtacaatacaaagtaaaattacctgttcaatggctacttcaacattttgatagcagtacataaagtgtaaagcaaccagtgagacaacattttagccaggattttaaggaactgaatagatttgcttcttagctaactccatgtataaacagagagagagagagagagagagagagagagagggagagagagagagagagagagagagagagagagagagagagagagagagagagagagagagagtttgctggtacttattcagctctcagttatatttcagaatagcatacttagctagtccgaggagcctgaggctcagaacaaagtcacacaggagcagaggtctgtggcaatagaggggttactcttccatcggagcttctccagttccacagtccacttcttatggtcacatattcataaggattccaagagtcttctttcagaaatgattcaagcttttttcttttataatttcttttataatctgttctttaaatatgcccatgcatgtgtctatgtgtaggtttatgtgagtatgtgtatcattgtgagagaacatacatgttcctataggtgctcaagaagactaaaacagggaatcataccacctggagatggttatgaattgcctgatttgtgtggtaggtaccaaagcagtacctgttaacccatgtctccagcctcctaagttctatatgttaaatggtattagctgttctcattgtgcttacatttgtacccatagaggcaaagaaagatggctaaaaaaatgtaattctttaatgttaaatgggtcagtatcatcagcatgtgtcaattacatatttgcatttgcatttggcagaatactctatttttctaaatggccttgcacttggtgattcgatggaataaataattgaagtaaagacttgcctttaagcacatcttatcacagtctgtatggctgtgtgcgaagtttaaatttgaaactcagtggtcacaatatctaagactaaatgctgctcagttgtgttgtaagtcacaattttcatgcatttaaaaaattgagaagacaaagaaacttcagtggttcatctataggaaatatggtcatatattccaaagaaataatgcctgtgaaggagaaaatattttaaatgttgccattttactatcaacattgcagaatttcaaacatcactggcacctgaacacagaacatgtttgctaataggaaatagccccaatgtgtgttagtttctgtctttgccaggaagtgtcctgcaagttttgctgggaagttttctgaatgtatgccaagcactagctatcacccagacttaaataagcattcacttaatcactttgatgcccttccttcaaatcctatcataaagcagtcacctttgtcctgacaaaccatctcagatctctacaagagaggtaagtgggagctgaatgatggtgagagccttgtgtctcttactatagagcgaagatacagaagaatctctgtcttcacattaattagggctcttagaaatagcaaagtcttccccagtcattttctgggcaaggaaaaacattggattcttcatttcattccagaccaatccaaagctgtgatggagctgagactactgtagccctttagatctaggcaaaagtgaagggagggatggccatctttgcttgttctgtctactacactctctctggtgccctgtttgttgttctctcaaagacaagatgctgcctcacctggtcctcaacagtatttcctggatgctgctctcctgcctgttgtttgtatttcaggtacaaggtaagtcttctctgacctagtctgtaattgtccatgagcgataagtgatgagaagcaaagaagtgttcttagaattcctgtgtggtaattgtgagggatatccacacaggaaagtcacctacacttcatccatcctcttgccttcttctatgttgctggtgggaaaaaagtatcatggtattccatcattccctgagtgagagggtttctatttgccaggaggctctcaattatgatagtaagcatgtaggagaggagaagaaatatgtgagtcactaatgaagcatgcaagtagaccttggggagaatggagtatcacagacagtgaaatgtgtagaaagagtaaaatgaaaggaagctctttcacactatatatatatatttaaatgtggcacctagctaagtatagtacctagctaaatacataacttgaaaaccagcattcagggaggagtttcaggaggatacctctgagttcaaggccaacttcatctgcacagtaaattccaggacattcaggcctgcagagaaactttgtcacaaaggaagcagaagcaaacattcaagcaacaggatcacaagatggaaagcttagtgaggctgtcaccaccttaattgtagccacccactctacaaaaaatgtcctttataaacattcccttgagtgttcctccccattcaattcccattctcggtgtcatgacatccctctcattatctctctccaccccaggtgaagacttccagaaggaagtgccctctccacgtaccagctgccccatgggttacaaggcttatcgctcccactgctatgccttagttatgacacctaaatcctggtttcaagcagatgtgagtggtaaagggtggggttgaagataccagcacaaagtgcaagtaggtaacaggagagtagggctcatgtttccatggttccatggggggggagcgagtgggtcacaatattggttcttcctttttttttctgtaatctttttgctcatggacatctggagtatcagtctttctcgccttctgtccctcatgtagctggtctgccagaagagaccctcaggacatctcgtgtctattcttagtggaggtgaggcttcctttgtgtcctccttggtgaacggcagagtggacaactaccaagacatctggattgggctccatgatccaacaatggtgagattctatttttctctgtttgttctctaggagctaatgtctcccaaacacaattttctgtgtgttctctctgtgtataatgtaaggtggatctagcactcaagctgggtgacattagagtaaggaatatcctcaacactggggtgaaaggctgaattatatagaggttcctcatattcagcttaatttgtttgcctattgtcagcttttacatttttcttttatttaagaaagtccacgagtgacttctttcttttgtcttcaaggaaccttcacaaaaagtactgagagcattgtaaattaagatttacatttattcattgaaaaaatagatatattcattttatttgtatgttttctctaaatgtatgtgtgtgcatgatgtgcttgcctgatacttgaagcagtcagaaatgagcttcagatcccttaggactagagccatagattgttatgatcctctatgtgggtgctggaagccaatccttaggagcaggccatattcttacctgctgagctatctctctgccgtctacttttgttgtttattgagacgatactgtgagatcaagaggctattctgcaatgtatcattcattactcattgtgtagcaaggac

SEQ ID NO: 1398 - DNA, 759 bp, Mus musculus
acaccatccagatctctggaagacagacaagatgctgcctccaacagcctgctccgtcatgtcctggatgctgctctcctgcctgatgctcttatctcaggttcaaggtgaagactccctgaagaatataccctccgcacgcattagttgccccaagggctcccaggcttatggctcctactgctatgccttgtttcagataccacagacctggtttgatgcagaactggcctgccaaaagaggcctggaggacacctcgtatctgtgctcaatagcgctgaggcttcattcttgtcctccatggtgaagagaacaggaaacagctaccaatacacttggattgggctccatgaccccactctgggtgcagaacccaatggaggtggatgggaatggagtaacaatgacgtgatgaattactttaactgggagaggaacccatctactgccttagaccgtgctttctgtggcagcttgtcaagagcttctggatttctaaaatggagagatatgacatgtgaggtgaagttgccctatgtctgcaaatttactggttaaacttatcagacagcaaacatcccgaatttgtcttgaagagcatcatggacaagggacaaaatgtgaagactcacctagaaaaagcattttctatctacagtccacattagagccttaatctgctctttccatatctgtctttagtccttttggtataagtttgggctcaattctaaaataaaaataagctttctgtcaca

SEQ ID NO: 1399 - DNA, 528 bp, Mus musculus
atgctgcctccaacagcctgctccgtcatgtcctggatgctgctctcctgcctgatgctcttatctcaggttcaaggtgaagactccctgaagaatataccctccgcacgcattagttgccccaagggctcccaggcttatggctcctactgctatgccttgtttcagataccacagacctggtttgatgcagaactggcctgccaaaagaggcctggaggacacctcgtatctgtgctcaatagcgctgaggcttcattcttgtcctccatggtgaagagaacaggaaacagctaccaatacacttggattgggctccatgaccccactctgggtgcagaacccaatggaggtggatgggaatggagtaacaatgacgtgatgaattactttaactgggagaggaacccatctactgccttagaccgtgctttctgtggcagcttgtcaagagcttctggatttctaaaatggagagatatgacatgtgaggtgaagttgccctatgtctgcaaatttactggttaa

SEQ ID NO: 1400 - DNA, 22436 bp, Homo sapiens
ttccttctgacccatatctcctgggtcctgaccatgactttcttgaaagtgtagccccaaaattcttacctctgaatgtacttcctctgatccccgcctcctaggtactaatggttcagactttaatttcctcgcaagttgtgtctccaaagggatctagggaagctctatgctgcatccttaggcatctaggctataaatgcagggagtcttgtgtccctcgtgtccctcccaatttaggcataccgctctcgacacgggcagttatgtgggacctgttccccaccactcttgccaggaccccaagtttgtaaatggctaaaagagacagagagagagagagagagagagagaggcagagaggtgaaagaggcagagaggagaaagaggcagagaggagaaagaggaagagagacaaagagggactcaaagagagaaagaaagagagatagaaatagtaaaaaaaaaaaaaaaaaaaaaaaaaaaaaaaaaaaagtgggccctattcctttaaaagccagggtaaatttaaaacctataattgataattgaaggtcttcttcatgaccctataacactccaatactacccttgttgtcagtgtaaacaaaggcatagcctgaaaacactgagaccactgacaaccatagccttcctatcaaaaatccttaacccggtaacccgtggatgacccaaatgcattcaatctgtagcggcaactgctttgctaacagaagaaagtagaaaagtaacttagaggaaacctcactgtgagcacacctcaccagttcagaattattctaagtcaaaaaagcaaaaaggtagcttactaactcaaaaatcgtaaagtatggggctattctgttagaaaaaggtaatttaacactaaccactggtaagtcccttaacccaacagatttccttacaggagatttaaatcttaattactatacaaaggtccgaccagaccgaggaggaactcccttcaggacaggacgatagatgtttcctcccaggtgactgaggaaaaaaccacaatgggtattcagtaattgatagggagactcttgtggaagcagagttagaaaaactgcctaataattggtctgctcaaacgtgcgagctgtttgcactcagctaagccttaaactacttacagaatcacaaaagactatctcaatcctgactcaaaaagttcgctacaccctttctgaaatgaatttgcataagaactgttgtttatgggaatgcatcttgatggggcagctgggttgttatgaaatactcaggaacccagcccagctctaggactcacccctgagcacaaaggcaatgttaggcatgctggtaaaggaccactagaatccagcagcccgaacccctttctttgtggtcaagaaaggcggtaaaaggggtgtaggaccactacatcggtgagcgtaactagtctgataagcagaggtccatgggtggttacgtgccctggaaaggaataagcattaggaccacagaggacgctctaggactaatgttcttcagaaaatgactaggggtgctggcatccctatgttcttttttcaggtagcaaacattcccctcaaggcaaaaacaccccgaagatgtattctggagaatcgggaccaatttgaccctcagacgctgagaaagaaatgacttatattcttctgcagtattgcctggccacaatatcctcttcatgggggagaaacgtggcctcctgagggaagtataaattatgacaccatcttacagctagacctcttttgtagaaaagaaggcaaatggagtgaagcgccatatgtacaaattttcttttcattaagagacaactcgctattatgtaaaaagtgtgatttatcccctacaagaagccctcagagtgtaccttcctaccccagcatcccccctactccttccccaactaataaggaccccccttcaacccaaatagtccaaaaggagatagacaaaagggtaaacaatgaatcaaagagtgccaatattctccgattatgcccactccaaacagtgggaggaggagaattcggcccagccagagtgcatgtaccattttctctctcagtcttaaagcaaattgaaatagacctaggtaaattctcagctaaccctgatggctatattgatgttttacaagggttaggacaatcctttgatctgacatggagagatataatgttactgttaaatcagacactaaccccaaatgagagaagtgccgccataactgcagcccgagagtttggcgatctctggtatctcagtcaggtccatcataggatgaaaacagaggaaagagaacgattccccacaggccagcaggcagttcccagtgtagaccctcatagggacacagaatcagaacatggagaatggtgcagcagacatttgctaacttgcgtgctagaaggactaaggaaaactaggaagaagcctatgaattattcaatgatgtccagtataacaaagggaaaggaagaaaatcctactgcctttctggaaagactaagggaggcattgaggaggaaaacctgtctgtcacctgactcttttgaaggccaactaatcttaaaggaaaagtttatcactcagtcagctgcagacattagaaaaaaacttcaaaagtcagccttaggcctggagcaaaacttagaaaccctactgaacttggcaacctcggtttttttataatagagatcaggaggagcaggcggaatgggacaaacgggataaaaaaaaggccaccgctttagttatagccctcaggcaagtggactttggaggctctggaaaagggaaatgctgagcaaattgggtgcctaatagggcttgcttccagtgcagtctacaaggacattttaaaaaagattatccaagtacaaataagccaccccctcgtccatgcccgttatatcaagggaatcactggaaggcccagggccccgggggatgaaggtcctctgagtcagaagccactaaccagatgatccaacagcaggactgagggttcccggggcaagcaccagcccatgccatcaccctcatagagccctgggtatgcttgacctttgagggccaggaggttaactgtctcctggacactggcacggccttctcagtcttactgttctgtcctggacaactgtcctccagatctgtcactatccgaggggtcctaggacagccagtcactagatacttctcccaggcactaagttatgactggggaactttactcatttcacatgcttttctaattatgcctgaaagccccactcccttgttagtgagagaaattctagcaaaagcaggggccattacacacctgaacataggagaaggaacacccgtttgttgtcccctgcttgaggaaggaattaatcctgaagtctgggcaacagaaggacagtatggatgagcaaagaatgccatcctgttcaagttaaactaaaggattctgcctcctttccctaccaaaggcagtaccccttagacccaaggcccaacaaggactccaaaagattgttaaggaccgaaaagcccaaggcctagtaaaaccatgcaatagcccttgcaatattccaattttaggagtacagaaacccagtggacagtggaggttagtgcaagatctcaggattatcgattaggctgttgttcctctatatccagctgtacctaacccttataccctgctttcccaaataccagaggaagcagagtggtttacagtcctggaccttaaggatgtctttttctgcatccctgtacattctgactctcaatttttatttgcctttgaagatccttcgaacccaatgtctcaactcacctggactgttttaccccaggggttcagagatagcccccatctatttggccaggcattagcccaagacttgagccaattctcatacctggacactcttgtcctttggtacatggatgatttacttttagccacccattcagaagccttgtgccatcaagccacccaagcactcttaaatttcctcgctacctgtggctacaagattccaaaccaaaggctcagctctgctcacagaagtttaaatacttagggctaaaattatccaaaggtaccagggccctcagtggggaacatatgcagcctatactggcttgtcctcatcccaaaaccctaagcaactaagagggttccttggcataacaggtttctgccaaatatggattcccaggtatggcaaaatagccagatcattatatacactaattaaggaaactcagaaagccaatacccatttagtaaggtggacacctgaagcacaagcagctttccaggctctaaagaaggctctaacccaagttccagtgttacgcttgccaaaggggcaagatttttctttaaatgtcacagaaaaaaacagaaatagctctaggagtccttacacaggtccgagggatgaacttgccaactgtggcatacctgagtaaggaaattgatgcagtggcaaagggttggcctcattgtttatgggtagtggcagcggtagcagtcttagtatctgaagcagttaaaataatacatggaagagatcttactgtgtggacatctcatgatgtgaacggcatactcactgctaaaggagacttgtggctgtcagacgatcgtttacttaaacatcaggctctattacttgaagggcctgtgctgcaactgcgcgcctttgcaactcttaacccagccacatttcttccagacaatgaagaaaagatagaacataactgtcaacaagtaattgctcaaacctaccccgctcgaggggaccttttagaggttcccttgactgattccgaccttaacttgtatactgatggaagttcctttgtagaaaaaggaccttgaaaagtggtcagggataatggaatacttgaaaataatcccctcactccaggaactagtgctcagccggcataactaatagccctcactcgagcactagaattaggagaaggaaaaagggtaaatatacatatagactctaagtatgcttacctagtcctccatgcccatgcagcaatatggagagaaagggaattcctaacttctgagggaaaacctatcaaccatcaggaagccattaggagattattattggctgtacagaaacccaaagaggtggcagtcttacactgctagggtcatcagagaagaaaggaaagggaaatagaagggaaccaccaagcagatattgaagccaaaagagctgcaagacaggaccctccatcagaaatgcttatagagggacccctagtgtggggtaaccccctccaggaaaccaagccccagtactcagcaggatgaatagaatggggaacctcatgaggacatactttcctcccctgaggatggctagccaccaaagaaggaaaaatacttttgcctgcagctaaccaatggaaattacttaaaacccttcaccaaaactttcacttagacattgatagcacccatcagatggccaaattattatttactggaccaggccttttcaaaactatcaagcagatagtcagggcctgtgaagtgtgccaaagaaataacccctgcactgcaggccatacctttcaatccctgtacctttaacctccttgttaagtttgtctcttccagaatcgaagctgtaaaactacaaatggttcttcaaatggagccccagatgcagtccatgactaagatctactgcagacccctggactggcctgctagcctcatgctccaatgttaatgacattgaaggcaactctcccgaggaaatctcaactgcacaacccctactacaccccagttcagcaggaagcagttagagcaatcattggccaacctccccaacagcacttgggttttcctgttgagaggggggactgagagcaggactagctggatttcctaggctgactaagaatccctaagcctagctgggaaggtgactgcacccacctttaaacacggggcttgcaacttagttcacacctgaccaatcaagtagtaaagagagctcactaaaatgctaattaggcaaaaacaggaggtaaagaaatagccaatcatctatcacctgagagcacagcgtgggggacaatgatcaggatataaacccaggcatttgagccagcaatggctaccctctttgggtcccctccctttgtatgggagctctgtttacactctattaaaccttgcaactgcaaaatatatatatatatatgaaaaataattataaaattggtaatggagaagcatggaaataagtgggactgaggaataacataaatggactactatttatttatcattttattaatattattttttaaaataatattaattattattatttataattttattatatttatcattttattaatgatattatttattatatcatttattatttatcattttattaatcattaatattaatgtattatttatcattttattaatattaatttgattgtattacttctttttgcttcatttctctaaaaaataaagctaaaaaagatggcaagatattatcgctgtagattctagatggtcaacctatacttgtttgttaaatgttttctgtatgataaagataatttattacaaaaagaaaagcaacatgactatggaattatttcttatttttatttttatttgctaccacaagaaatgtgaactctgatacattgtgaacagttcagatctgcaaaattatcacccacaagctgtttgagtatgatttatggtaattaattgaaaacattatcttaattttttcccaaatgaacattttgtattataactagcttattctaaaagaaaaatcaataaaaagcaatagcctttttaaaatacccaaatagataacgttagaagagcaaacatgatatgaacagggaactcttccaagatcaatgtgaaaatttgaaaccaaataaatattaacacagttttctgataaaaattattgcctccaataactgcacaggtcatatgatagttactgttcatggcttacgtataattgaccaaatttcagtagctatgttatcagctttccagttctttgatgttaataacttccctcattggcctcaggggctttgaagttttgtccctttttcctgttttatagttgctcagcacctaatcttatccctttcccaattcttctgacagtgttaggataagatgaaaggaccaaagtggcattctggacatctggttaatatatctcaaaggggtgcactttagtgataaatctccagtgagatacagttcaaggctatttttgacatggaccctgctgagccatcttccaggaaacctctacattttaccatccttgaaacaaatatattaggctcctgcaaagagatcagttttcacttttataattctaagaatgactactaagtcttatctgcaaatatctgattcagaagataatagggataaaagtacaaattggacatcttttggcaaaggaagctccttaaaactcagccttggttacatcaagaataagaattcctgtgtcatccctaagaagtagatttttatataactcaaaaccagctcaagaaatataatatttaaacaaacttctcagtgcttggttaataagcattgttatgaagaaacaatgaaaaataaaacaaaaacaactcaactttagtgagtttagtgagtgtcattgcaaagaaaatttcacattgcacttagggattttataaccttaaggcttattacaaaggtcacactatttcaattaagaacaaaagtgagttttaataataaactgtcagcatttcaaatcttctctcctaggtatcttgaaatatacaacatattgttgttaactatagtcaccctatgtgctatcaaaagctagaacatattcctcctatctagctgtatgtttgtacgatgaactaaactcttttcatctcccctcacccgtctcagcctctggtaactattctaccctctggttaccttctaccccgtacctccatgtgtttacatattgttgtataaattttgtggaaaaaaatcctttttaacaaaataatctgctggctatatttcttctcatattatttgaggaattgcattgaattttgggtactgaattttgaggacgtgaattaaggatgagctacatctcatgacctcgtcacagacccctactataaacatctgcatacaagttggcatattacaacaatagcatgagagtcagggtctgtagaaattcccagcctaactttttcctggactggccaaactgaacctgaaccagtgtatgggcaatgtagtatgcttgtcagaggcaccaaactgctaactcaaaaataaacatgactaaaagaacttctcccagtatacccatatgaagctgaccatttgcccagtaagaatgcaatgaaaagggcttttaatgtacagccaaatggcagtccagcaaggaagctcatgagcaacctacaagtagtgagcattttgatgtaatagagacttacatgcaattcagaattatgtttacaacatcacaaaacaaaaatttagagataggctctcactctgttgcctaagctggagtgcagtgggatgatcataacttactgcagccttgaactcctgggttcaactgaaggtcctcctacctcagcctgctgagtagctaggaccacaagcacacaccaccgcaactggcttaaattaaaatataaattgtagagatagggtcttaatgtgttgcccaggctgctcttgaactccttgcttcaggtgatcctcccacctcagcctctcaaagtgctgggattatagacctgagccacagcacctggccaactgacctatgattttacacaatggctgctcttcccttctttaactattattcattcttctttgatcctcattatttgactgtagtccttcttatgtcttgttttccttcattacctcttattctatcacattgccattgtcattctccactggggaagctctttcttgctgaagactggaaagacaagtccattcacctgattttctgtaagattgtggctcatgtattgacttgtcagacaattctgaagtttcatcaaaattagctatcatgcttgcataatggccctgaaccctcactcctactcttagcttcagtaccatctatgtcctcaactgtccatgatacttataattcccgtaaatcttcacttaacacctaacatttatttaatcttactaggcaaggtaataagaaatacataggtttgcctccagaagtgggttcttaagaaacccaccagaggaactcctctttcagatgtccacattagaagatttcatatcacatttggtgccacaggcctttgacaaggaggatgcagaggaaaaagcaaacttcacctcttcctagggaaagtgttggcctgccaacaggaaagaggcaacatctgggaaaatccccagtctttgccaggaagagtccatgccaaccccaccccatgacccctgtcctgcctactcattgtcactcttcactccaatgtccctcccccagatcctcttataaaatcccactctttcctgaccagacaaaccataccatatcccaccagagaggtaagtgggagctgagagaagatgagacccagggaggagctactgcacatgacacaggagaatacatgggagggtcccttcctcagggagcacaggaactctgagactcagcaagggtgtcctgggagggctcggggatgggagagtacacagattcacaactcattcagaactgtagaagatgatggatgtgaccaagatcactttagtcctaggggactagagaaggaaaatgacatgaggcagtggggtatctgtgtgttctcccactgaccacgctttctttagtgactcctgattgcctcctcaagtcgcagacactatgctgcctcccatggccctgcccagtgtatcttggatgctgctttcctgcctcatgctgctgtctcaggttcaaggtgagattgctttgcctctagcactgggttccctatgaatcctcagagctaacaagaggaggaaggctcctgtgtgtcatgtgaggtaatgacgtggtgtctaatgaacctgcctgcagttcttgcatcatctctccttccttcaggttaacttgcagtgggaggctccatggtggtccactaacagtggaatgagatggcttccatttagtcagtggactctaatatacactggtgggaaagtggactctaatatacactggagggtcagtaatgagatgtggggagggacaatgattggaggacccaatgtagagacagcccagagtgaggagagtattgaatggttgaataaggggaaagggtaataagagactggatggtgctccatttactacggctattttgagataaagaatttctgaaaacataagggaagatgaaggggtgtcaggaatgtggtcttcctccccaaggacattcctaggtattccccaaggtcatctcccaccccaagccccactcttcattttaccctcccccctcttcttccacctcaggtgaagaaccccagagggaactgccctctgcacggatccgctgtcccaaaggctccaaggcctatggctcccactgctatgccttgtttttgtcaccaaaatcctggacagatgcagatgtgagtggttagatgtggtgttggaggtgaccggtctcagggggaggagggtctccattcaggagagttccttgggaatgaggatgaacacgtttatctttcacacagtcctcctcccacctacctttgccctgccctccctcagcaggtctcaggctccctctcattctctttgttgccctcaaagctggcctgccagaagcggccctctggaaacctggtgtctgtgctcagtggggctgagggatccttcgtgtcctccctggtgaagagcattggtaacagctactcatacgtctggattgggctccatgaccccacacaggtgccagtatatcctcccctctctgttacctctcaaggtgctattgttgcccaggcccactccctgtcccctgtgcctgcccaggaagtacttcagggagcactggagctcagattctggggaatatttggggggaaagggaaggccatgaagcatctgaagatctgagttctgtggaggtctctatctttcagataaaatcaatctgccttcctcaggcgtattacataattctcatatgaggctgggttaacaattctctgagcttcatggagtctttgcctactattctgaaggaactcttaatgaagataggatcaatttttgtccccatacagaactgacattacttttgaggttcacaagctaatcacaaatgctacatcaattattgttctgcaaataatatattaccttgagttgttccaaaggtcttatgtttattggctggaattttccaatagcaatgaggagtcaaggaagagtttcctactcaccggcagcatctggaatagcagaccaactttcctcatgctggggagcaaatcaggtgttgcagctaaggggccatgcaagaagagctgcaatggccattcccttcacctggctacctcctctactctacagggcaccgagcccaatggagaaggttgggagtggagtagcagtgatgtgatgaattactttgcatgggagagaaatccctccaccatctcaagccccggccactgtgcgagcctgtcgagaagcacaggtaagaaacagaggagctgcctcttcccagtgttttccatctcatcccccattcctgggtctgaccttcaggaaatcttcctgagctagaaaatacaatgttagtgtgtcttctcttatctcctctcttctccactttctttgaatctctctcctggattgggacactggtgaaggtgagggagaggctttaacttctaggctaaaacctgggatgccccttcattggattcacaagcttcctcagccccattccatttatgtcttctgtctctccagcatttctgaggtggaaagattataactgtaatgtgaggttaccctatgtctgcaagttcactgactagtgcaggagggaagtcagcagcctgtgtttggtgtgcaactcatcatgggcatgagaccagtgtgaggactcaccctggaagagaatattcgcttaattcccccaacctgaccacctcattcttatctttcttctgtttcttcctccccgctgtcatttcagtctcttcattttgtcatacggcctaaggctttaaagagcaataaaatttttagtctgcacttgtttgtcttgtatatgccagtgtcatagccatactctgagaaggacaaagtgtttgagtggaggaaactttatgggtcttgcttcttccctattcacccaggcctctagggaaaatgatgaagtgtgcatccctaccagtgtgttatgatgagggtgtgggtcctgctcatgtaggatttgtgttgtggagagatgaggacatttctctcccgcgtacttactgccctcccattcccgtagcccaaacctgacagtgtgacatgaacagatttaggaggctctgatggtgcttagaatagtacttctcagagaatggcatcagcaggatggtagataggactttccagctcttgaaccttcacagaaacattcatttgaactactacccattaaaatggaaataccttcacaagagctaacaatcccaagtgagtgattaaagcatctgaatgttgcaaaaaataagaaaggatgcatcgaagagggtagaaagaagacttttacattatttatatcacccctccatcaatctcagtaagcacagcatggagagacattccctaaacttggggaaagagagtgaaataagcacttgagttttccatggaccctaacactaggtttgcctcagtaagacccagtggcctctgactccaggcagacacccttggacttagactccaggctgccttgatgccaggccaggctctgtggccccaggctctgtgaccccaggctccaggtcagcccccatgactgcagcctccagtcttgccccagaagatgcaggctctagacacacacagcatcatgcttttccccatagctccagaccacaggccagcacccactgacaaagactctaagcccacctcaaggacaagctagcacttgcagccacagactccagggtgacccctgaaatcctagacatcaggcctgcccatgtggacctgcccttcagacccaccacagctccaggatagctcccacagctacaacttcaggccagcacttgcagaccccagctccagactgacactcacagtcgcaggatacggtcctgtcaaatcccaaaccctccccaagcctttaggtccatctgagcacaaagccctgatgctaggccagcctctgtggcctctgtcactaggccagcccccacagacacaagttctggattttcccagttccaggcgaggctctgtggactcggtactagtctggcctcatactccagcagacccaggatcaagcttcattacagtagaccttagcaccaggccagcccccccgactcaggctccagccttagccccatgaatccagtctccagacttaccccagaggcaagttgacattcatggtcccaggctacaggccacccccactaaccctggctccataccagcccctgtagtttcaggtaccagcccagtatgcacagactcaaactccagacctgtcctagagactcagatactacatctgtcctagtgcctggctaacccctgaagacatgggttcaaggcctgctttagagccagattggtctccaggaagtaggatttagtctggctcctgtgattagaggcttcgggcctgccctcatgaagtgactgcctaccctggtataccaagtcaataggtccacttgaggatgccagcagcaagcctgcccaaagaccaagccagatggcctgcccagaatctctggatgactgactggtgaagggctttgtctgctaaagccagtctgtaaaaactggaataagtgactacttgttcaaaaagtcaaacaccaaagacacatgaccacaagtatcataaacaatcaaggaaatatgatattaccaacagaacaaaataaaggactagtaactgaccttaaggggaaagaattttacaaactgctcaacaaataatttaaagcaattgtctaaaagaaactcagtgagctacaagagaatacagatagacaactaaatgaaatcagaaaaacaatatgtgaacaaaatcagaaggtcaagaaagagatttgttttaaagttaaaaaaaaacacatagtggctgaactgaagaaatgcatggagaatttcaacagcagacttgatcaagcagcagaaaaagtcagtgagtttgagacaagtcatttgaaattatccagtcagagaaacaaaaagaaaaaagaaacaaaaagagaaaataaagcttaaggaaactatggtacatgatcaactgagccaatatatatattatgggttttctagaaggagcagaggcagaaaatgggcagaaaacatatataaaaaataatgggtcatggggtttggcatccccatgcctgtcagtgcctcaccccagccaacgagcatgcacccagccatgctgccactgccgtggcatgagcacagatcccactgctatcaccctgacagagtactgtggtcactgccacttactggagtgttgtggccagcaatccaggaacacctttggacccccagcacagcaggttcctaacttcgaggggtgagagaacaaagctaggggcctgataatagcattccagaattggggaatgctgagctgaaccttggcccactgacatcttccagaaatgaagtgagtcaactgagcccaccttataccacaatcaaacccccaagggcatcaaaaaggataaacacacacacacacacacacacacacacacacacacaatccatccaaaaaacagcaacttcaaagattaaaggaacgccagcccacacagatgagaaagaaccagtgcaagaactctggcaactccaaaagccagcgtctatttttacctccaaacaattacactagttatccagcaatggttcctaaccagtctgaaatatctgaaatgacagaaatagatcttggaatatggataggaaccaagattattgagcttcaggcaaaagtgaaaatccatttccaggattctatacaataaaacgatacagaaaatgaaagatgaaatggtcattttaagaaagaaccaaactgatctgatagaggtgaaaaactcatttcaaaaatttcagaatacaatcacaagtattaacagcagaattgatcaagctgaggaaagaatctcagatctcaaagacagttctctgaaataacttagacacatattagaaattaaaaaaagattgaagaaaattaaacaaaacctctgaaaattatggtattatgtaaagagaccaaatttatgactcattgaaagcaagcaatttggaaaacatatttcaaaatatcatccatgaaaacttccccaacctccttggagagggcaaactttaaattcaggaaatgcagagaacccctgtgagactacacaagataaccatccccaagccacacagtcatcagactctccaaggctgaaatgaaagaaaaaaatgttaaaggtagctagagagaaggggtagatcacttacaaagggaacctcatcaggctaacagcagtgttgtcagcagaaatcctacaagccagaagagattggggccctatattcagcattcttaaggcaaagaaatcctaaacaagaatttcatatccaggaaaactaagcttcataagctaaggagaaataagatccttttcagataatcaaatgctaaaggaatttattacctccagacctgccttacaaaataacctaaaaagagtgctaaatacagaaaggagtgaccattactggctactacaaaaacatacttaagtacatagaccagtgacactataaagcaaccacacaaacaagtcttcataataactagctaacaacatgatgacaggatcaaatctgcatacatcaatactaaccttgaatgtaaatgggctaaatgccccaattaaaaggtacagagtggcaagttggaaaacaagcatgacataatggtatgcccctctcatatgcaatgacccatctcacatgcaatgacactactagactcaaagtaaagggatggagaaaaatctaccatgcaaacaaaaaacagaaaaaaaaagccaggtttgctataccaatttcagacaaaacagactgtaaaccaagagatttttgaaagacaagggcattatgcagtggtaaagggctccattcaaatgaagacctaactatcctaaatatatacatacccaatacaggagcacccagatttataaagcaagttcttagagacctacaaagagaattagataaccacacaatcagagtagagacttcaatactccactggcagtattagacagatcatcgaagcagaaaactaacgatgatattcaggacctgaactcaacacttgaccatatctagtagacatctacagaactcctcactctcaaacaatagaatacacatttttctcattggcacatagcacattctctaaaattgaccacacaattgagcataaaacaatcctcagcaagctcaaaaaaacaacaacataaaaacaaaaacagaaatcataccaaccacactctttgatcgaccacagtgcaataacaatagaaatccctactaaaaaatcacctgaaaccatacaattacatggaaattaaacagcctgctcctgaatgactttgaggtaaataatgaaattaaggtaggcataaagaaattctttgaaatgaatgagaacaaagatgcaacatatcagaacctcccacacacagctaaagcagtgttaagagggaagtttatagcactaaacacccacatcaagaagttagacagatctcaagttaacaatctaacatcacacttagaggaattagacaagtgagaacaaaccaactccaaagctagcagatacaagaaataaccaaaatccgacctgagctgaaggaaactgagatgtgaaaatcatacagaagatcaacaaatccatgaatatgtcatttaaaagaataaatatgactgatacaacactggctagactgacacagaaaaaagataagatccaaataaacacaatcagaaatgacaaaggggacattaccactgacaccacaggaaaaacaagcaaacaagcaaacaaacaaacaaaaaccctcgacgactactttgaacaccactgtgcatacaagttgaaagacctagaagaaacggtttaattcttggaagcatataacctcccaagattgaaccaggaagaaattgaatccctgaacagaccaataatgagttctgaaattaaatcattaataaaatacctaccaaccagagaaagcccagggcaggatagattttctgccaaattctgtgagatgtataaagaagagcagaagacaccattcttactaaaactattccaaaaaattgaggaggggagactccttcctaactcattctatgaggccaacattgtcctgatatgaaaatctgacaaagacacaacaacaacaaaaaatccaacttcaggccaatatccttgatgaacattgatgcaaaaatccttaacaaaatactagccaactaaatccagcaacacaccaaaaagccacaatcaactaggctttagaatgtgaggttggttcaacatatctaaatcaataaattgatttatcacataaacagaaccaaaaacaaaaaacacatcatcatatctatatatgcaggaaaggctttagacaaaattaaacatctctttgtgtttaaaccctaaacaaagtaggcattgaaggaatatcctttagaaccttaagcgccatctatgacaaacccatagaaaacatcgtactgaatggacaaaaactggatgcattccccttgaaaactgaaataagacaagaaagtcctctctccccatttctattctacatattactgaaagtcctggccaaaacaatcaggcaatagaaggaaataaatggcatccagatagggtgagagaaagtcaaactatccctgtttgcatatgatactattctatatctagaaaaccccattatctcagcccaaaagctccttcagctgatgaacaacttcagcaaagtttcaggatacaaaatcaatgaaagaaaatcactaggattcctatataacaacaatatcccagcagagagacaaatcaagaacacaatcccattcacaatagttataagaagaataaaatgcctaagaatacagataagcagggcgacaaaagaactctacaaggagaattatcaaacactgctcaaaaaaatcagagatgacacaaacaaatgaaaaaacattccaggctcattgataggaaaaatcaatattgttaaaatggccatactgcccaaggcaatttatagatttaatgttattcataagaaactaccggaaactttcttcacagaattagaaaaactattttaaactttatatggaacaaaaaagcccgaatagtcaaggcattcctaagcaaaaaggacaaagctgaaggcatcacattgcccaacttcaaattatactagaaggctacagtaacccaaactgcatggtactagtacaaaaagagacagatagaccaaaggaacagaatagaaatcccagaaataatgctacatacctacaaacatctgatcttcaacaaagttgacaaaaataagcagtgggaaaaggacttcctattcaataaatggtgctgggataactggatagtcatatgtagatgattgaaactggaccccttctttatactattttaaaaggtaaactcaagatggattaaagagtcaaatgtaaaactataaaatcctggaagataacctaggaaatgcccttctggacataggatcttgcaaagatttcatgatgaagatgccaaaagcaattgcaacaaaaacaaaaattgacaaatgggatctaattaaagaaaagagcttctaaacaacaaaagaaattatcaaaagagtaaacagacaacctacagaatgggagaaaacatttgcaaactatgcatctgacatagtttggtctaatatccagaatctacaaaaatcttaaattagcaagcaaaaactgaacaactgcattaaaacgtgtgcaaaggacatgaacagacacttttcgaaagaagatatacacacagccaagaagcatataaatatgctcaaaatcactaatcatcagataaatgaaaattaataccacagtgagatgccatctcacaccagtcagcatggctgtttttaaaaagtcaaaaaataacagatgctagcaaggttgcagagaataggctatgtttatacacttctggtaggaatgtaaattagttcagccactgtggaaagcagtttggaaatttatcagataagttaaaacagaactactatttgacccagcaatgctattatggggcatataccaaaaggaatataaatcattctaacataaagatatatgcatatatatgttcattacactgttattcacatagcaaagacatggaatcaacctaaatgcccatcaacagtaggctaaataaagcgaatgtggtacatatacacagtggaatactacatagccataaaaaacaataaaatcatgtttgcagcaacatggatggagctggaggccatgatcctccaccaactaacacaggaacagaaaaccaaatactgtatgttatcacttataagtgagagctaaagtttgactacagatggccaccaagaagaagaaaacacacactggaacctacttgaggatgaggggtgaaatgagagcaaggactggaaaagcacctattggatattaagcttattacctggatgaaaaaataatctatacaccaaaccactgtgacatacaatttacctatataacagactggcacatgtactcttgaacctgaaataaaagattttaaaaaaagaaagaaaaaaatggttgtgaaaaacttcccataactggtgagaaaaaggaacatctacatccatgaagtacaaaaaactccacatacattaaatataaagacatcttcactgagacacattacaatcaaattccaaaaagtcagggatgaaaagaaaattttcaatgcagcgaaagaaaaataacatattatgtgcaagcgaatgtctataagattatcagttgatttttcagaaggtacctttcagggcaggagagagtgggataatatattcaacatactcaatgaaaaaacaaaacaaaacaaaaccctgcaaaccaagaacactatacctggcaatcctatccttcagaaacgatgaaaagagaggaagtttaccagaaaaacaaaagctgagagagttcattaacactagaccttctttatgtaaaagactaaaagaatttcttcaagatggaagataaaaatgctagctgataccataaaaacacaggaaagtataaagtataaattgactatgttaagtacatagtaaaatttgaaatactctaacattgtagtgatggttggtaaatcacttaaatctttagcataaaagacaaaactattaaaaacaacagtaactacaataattgttaaggaatatgcaataaagaaacatgtaaattgtgacaccaataacaagaatgtgcaaacaacagcaaaagtgtaaaatatttttatgtgatcaagttatctttttaaaatagtctattataaatatatttttgtaagctttatggtaaccacaaagcaaagacctataatagataaataataagaagcaagcaaccaaagtataccacaagagaaaattatctagtcaaaaagaagagagaaagagaggaagaaagaaacaaaggacctacaaaacaaccagggaacaatgaacaaaatggcagtagtaagtaattacttattaatgattattcaaaaagtaaatgagtaaaattctccagtcaaatggtatagagtgatcaaatgaatttaaaaaaataccaacacacaacttaatgttcctacaagaaacttactttagctttaagaacacacataggctgcatgtgaaagaattaagatatttcatgcaaatgataccaaaataaaacagtggtagctatagttatattacataaaatagactttaagttaaaaactttaaagagaggcaaaggtcattatataataataaagaagtcaattcagcaagaggatataataattttaaatatgtgtgtacacatcattggagcccataaatatataaagcaaatatcaatagatctgaagagagagaaaaattgtaatacaatatttgttggataattcagtacccactttcaacaatgggcaggtcattcagacagaaaaaaattcaataaacagcggacttgaactacacttcagacaaatggacctgacagacatacagaacatttcttccaacaagagcataataaacattcttctcaagtgcacatgggacatgcttctggagagatcatatatttggccataaacataggctcaacaaattttaaacgactgaaatcatatcaagtataattttcacccaaaatagtacaatactagaaatcaataaaaagagaaagattggaaaatattcaaatatgtagaaattaaatgacattatcctaagcaaccagtggaccagagaagaaattaaaagtgagattagtggtgggatccagcagtcccactactgggtatccagccacatacaaaaatgattatatatcaaaaaaacaccagcatgcatgtgtttattgtagcataattcacaattgcaaagatatgtgcccatcaaccaaagatggataaagaaaatgtagcatacatatatatacatatacatatacagacacacacagacatataccatatatatatacacacacacacatatataccatggaataatggtaattgactagccataaaaaagaacaaaataatgtattttgcagaaacttggttggaactggaggctgtcactctaggtgaagtaactcaggaatgaaaaaccaaatattgcatgt

SEQ ID NO: 1401 - DNA, 807 bp, Homo sapiens
aaaccataccatatcccaccagagagtgactcctgattgcctcctcaagtcgcagacactatgctgcctcccatggccctgcccagtgtatcttggatgctgctttcctgcctcatgctgctgtctcaggttcaaggtgaagaaccccagagggaactgccctctgcacggatccgctgtcccaaaggctccaaggcctatggctcccactgctatgccttgtttttgtcaccaaaatcctggacagatgcagatctggcctgccagaagcggccctctggaaacctggtgtctgtgctcagtggggctgagggatccttcgtgtcctccctggtgaagagcattggtaacagctactcatacgtctggattgggctccatgaccccacacagggcaccgagcccaatggagaaggttgggagtggagtagcagtgatgtgatgaattactttgcatgggagagaaatccctccaccatctcaagccccggccactgtgcgagcctgtcgagaagcacagcatttctgaggtggaaagattataactgtaatgtgaggttaccctatgtctgcaagttcactgactagtgcaggagggaagtcagcagcctgtgtttggtgtgcaactcatcatgggcatgagaccagtgtgaggactcaccctggaagagaatattcgcttaattcccccaacctgaccacctcattcttatctttcttctgtttcttcctccccgctgtcatttcagtctcttcattttgtcatacggcctaaggctttaaagagcaataaaatttttagtctgc

SEQ ID NO: 1402 - DNA, 528 bp, Homo sapiens
atgctgcctcccatggccctgcccagtgtatcttggatgctgctttcctgcctcatgctgctgtctcaggttcaaggtgaagaaccccagagggaactgccctctgcacggatccgctgtcccaaaggctccaaggcctatggctcccactgctatgccttgtttttgtcaccaaaatcctggacagatgcagatctggcctgccagaagcggccctctggaaacctggtgtctgtgctcagtggggctgagggatccttcgtgtcctccctggtgaagagcattggtaacagctactcatacgtctggattgggctccatgaccccacacagggcaccgagcccaatggagaaggttgggagtggagtagcagtgatgtgatgaattactttgcatgggagagaaatccctccaccatctcaagccccggccactgtgcgagcctgtcgagaagcacagcatttctgaggtggaaagattataactgtaatgtgaggttaccctatgtctgcaagttcactgactag

SEQ ID NO: 1403 - DNA, 96593 bp, Mus musculus
  misc_feature (1)..(312): "n" at positions 1 thru 312 can be any base
  misc_feature (3886)..(4940): "n" at positions 3886 thru 4940 can be any base
  misc_feature (12981)..(13197): "n" at positions 12981 thru 13197 can be any base
  misc_feature (65121)..(65140): "n" at positions 65121 thru 65140 can be any base
  misc_feature (82761)..(82780): "n" at positions 82761 thru 82780 can be any base
  misc_feature (90594)..(90613): "n" at positions 90594 thru 90613 can be any base
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttggctctgtctggacaggtccagacgactgacaccattaacactttgtcagcctcagtgactacagtcatagataaacaggcctcagctaatgtcaagatacagggtggtctcatgctggttagtcaactcatagatcttgtccagaaacaactagatgtactatggcaaatagctcagctgggatgtgaacaaaagtttccgggattgtgtgttacttccattcagtatgagaaatttactagggcagctaatttgtcaaaaagtctttttcagtatatgttacagaattggacggctgaatttgaacagatccttcgggaattgagacttcaggtcaactccacgcgcttggacctgtccctgaccaaaggattacccaattggatctcctcagcatttcccttctttaaagaatgggtgggattgatattatttggagatacactttgctgtggattagtgttgcttctttggttggtctgtaagcttaaggcccaaactaggagagacaaggtggttattgcccaggcacttgcagctctagaacatggtgcttcccctgatatatctatgcttaggcaataggtcgctggccactcagctcttgcatcccacgaggctagtctcattgcacgggatagagtgagtgtgcttcagcagcccgagagagttgcacggctaagcactgcagtagaagggctctgcggcatatatgagcctattctagggagacatgtcatctttcaagaaggttgagtgtccaagtgtccttctctccaggcaaaacgacacgggagcaggtcagggttgctctgggtaaaagcctgtgagcctaagagctaatcctgtacatggctcctttacctgcacactggggatttgacctctatctccactctcattaatatgggtggcctattgctcttattaaaaggaaagggggagatgttgggagccgcccccacattcgccgtcacaagatggcgctgacatcctgtgttctaagtggtaaacaaataatctgcgcatgtgccaagggtatttctctaccccatgtactctgccttccccgtggcaacaactcggccatgggctgcagccaatcagggagtgatacgtcctaggcgaaggagaattctccttaaaggggacggggtttccgccattctctctcttgcttgcgctcttgcgcttttgctctctggctctggctcttgctcgcttgctcctaaagatgtaaacaatagagctcttgctctgcgctctggcgctctggcgcgctggcgctctggctcctaaagatgtaagcggggggctttttcgtttttggggcttggggcttgcgctcctgctcctgaagatgtaagcaataaagttttgccgcagaagattctggtttgttgtgttcttcctggccggtcgtgagaacgcgtttaagacctgttcaaggaaatgataacaatgccgttgtttcagaaagtacgacacctcgttacccctgttatgaccccttattatgactgccttgcaatcacgtctttgtttcaggttgttatgacaggcatgtcatgcttgttccacttctggggctccgtctacttgcctgccaaatcccccatttggaaccccctattgctgaactatagagacccctatgtcatccaagttcagtgcttatctcttgaaccccacctttagagagatataatttgtgtacacaaataaaaaggttttctataattaatttcttgctttaattaacttggtgttgatgttttaggattgtggtctttctcctcacatctgtgggattaaccgctgtagctccagataccacatcaaggcctaacaatgattagcaaaagaggaaggcttttcctatctctttttgggaaccaggaaactttccttgggcatcttcctgtgagatgtctcttcatgtctcattggtctagcattgctccgatgcggcaatgctagaccaatcaccatcaaggaatgaacctgtctaatcaggactcgttgtgtgtgaaggcaggaggttataacattaaaaccaaacccacaagacagttgtgaggtttttagtgttttggaattagcagtagaaaggctgtgtctatttagagacctgtgtaaagacaatgtgaccagtggagattagtaaggtgaaagtcaacgacttggatagctgaccagaactgcctttgggtattttatacattttatttattatatttcctttcttgttttttctttcaatacaggtatctgtgtatgatcttgaacttcacatcctcctgcctcagtactgaaagctccaggattaggaagtgcactctctgccacacttggccttctttgtatttgagttctttagacaggactggacctgaggtacacaacctactctaaagagggtcagggagaaaagggaagcagctcccccagggtaggggtgcctgcacatcagatgccacgcagctaggagggcatcgctaagcaatagacagttgctccatcactctgggtttgcaggatcacagttaactctttttttctttttttaatggtggaagagagcaaagtacttactgtaatgcggtactactaggacttgtttaaagagggaaaaagccttttaggttttgagatcaaggtaattatttaatggtgttagcttgggttagctgcaatagcagttttgtattgaagcatattttactatttcctgccagcaaaggccagacatggacaagaaggtatgcattaatggaatgacatggagctcgggcctcttgagagcagccgcttctccagaacagagagtgtctctatttcaccaacacactgtgtacacccaatgagctagggacaagcataattgtaatctattttagcagcctcatggctcttaaggacacagaagaaagggagattaagaaatctcttttgaggcccattaatgaggaggaggccaacagaaggctgctaacatattagataagaacacagtttctaggaaatgttatctaaatcatttttaagaaatagagggtatgggagtcccagctgacttgcagattaaatatgcacatctgagctcatgtcttccaagtccctgatatgctataggtaagctatgttttaactacaacaaatccacaaggataagaagaatagaatggataacagcagcagtgtgtagctgctcaaaaacagaagagtgtagagattgtaagcagagtcaagatacgcatgacagatctggggccagccatgggcaggacaagagaactaggttatgcaattgctgggctggtaaattcaaactctgtaaggtggccttgtggtacagaagacgctggagaagaagtggtgggtgtgtgtgtgtgtgtgtgtgtgtgtgtgtgtgtccgtgtatctgtgtttatgtgagcatgtgctgtatgaatttatgccgcagtgtgtgggtgccccctgaagttagaaagaacgtcagatcccctggagctggaggaacacttggacatgagctgcattactgggtgctggggatcaaactggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncactttcatatttatgaggtgaaagttctttaccatcacctaaagattgtctcctccaaggtaaaaaagttttgttgtataccggcccgcggcctacttgaaccgggtacacctgggaggcaggctggggctgaaaaagacttaggtggcaagagagattaatggagaccaaggcacgattctgttcaaggccacagtttactaagagagtgtgcttataagggggaaggcccatcccccgccagtccattcttggtgtctggagccagcctgtaggcgacatgcaggataggatgtttctcaggaacatatcaggggtctctcaacaggtagcagtgtattggagagagcagtgtctggtgacagaacaaaagagccatctaggtccgaaggctccaccctaggtaatctccttctaatggcagcaaggtcaaagtctggatcagcctgcttcaggctgggggagcctacaaagttttgcctcgtggatgcacaaaatgtaaatgactctcacagccggctttacatacaccactcataatgcaaggtttgacaaacactccccattccctttggagttcctgacaacagtagcattaaccaagatatccattttattacagggctctagaccttagcacaactgactccatgatggaagtaccactcaggctgtaacactcagcgtgcagccagcaccacctgcccaaatgaaaacaaagacctaatctatcaagtcatatagttctgaggaagtctcaaaatggactcagcttgctttttggtttctgtagttctgcttctggctaactgtttttgttaactgaaatatgtcaacccaggacatggttttttgtgctaaaaagctcactctgagaaagacttggggctacattgggattctgaatacccagtgtggctgccaactggctaataaagactgtctattggcaaaagcctatgactgagcatccttctctggtggatgtcccacaacatttcctcttgttagaatatacaatatgggtgtgcccatccccaatataggggattttgagcactcagggcaaatattctacctttgaactacactcccagccccacagtaaaattgaaatcatctctaaattgcaatacctaacacaagatggatggatggttagaggcttttctttttactttttctttttctttttcttttttttttttttttttttggttttttgagacagggtttctctgtgtagccctggctgtcctggaactcactctgtagaccaggctggcctcgaactcagaaatctgcctgcctctgcctcctgagtgctgggattaaaggtgtgcgccactacgcccggctagaggcttttctgtcctcaatttgttttgagacatggcctccactctgcagtccaagctggtctcatactcatggcaattctacctcagagttctgggagtacaagtatgaccagacatatccagctgtaagtattgcttaaaaaacaacacaacaagacaacattaaaaagaaaattcagtctggttttggtggtgcatgccttctcttccagcacctacaagacaaaggcaggcatatctctgtgggtttgaggccagccaggactacatagacaaaaaaaaatgaaaaaaaaaaaaagttcaaggttggttgaaaccaaggactatgtggatgtagaaccccgcccccctctttctctttctctctctctgagacacatgctgttgccaggcaaacctctcatcacccactcttactctcacaaagtccccccagatgtgatcctgcatatgcagatgtggagggtctgctgataccgtgacctgagatagcatgttcgtggcttcgattgctaccgttttgtgtagagacagagtctggctctgtagctccatcttcttgaatttcatcaaagctgccttgtagtctttctatcttgctgagctctgaggaaggctgtgctgaaggtggaatccagagccttctctgtgctaagctaagctcctgctctaccattgagctgtaacccttccccaatttcctggccttaccgttaagtctgaaaagtgtgaggagagagacccaacctacaaccatctaactgcagcatcatttattttagaggtgcacccgagactgatcagctggctgtcccaccctaagttggaattttagagatcagccctggatatgaggaagacaggcttttatagctcagggtagggggtttccaaatgaggggtttggtgggcaaaatactcagggttacaggagcagaacatacacatagcaagctagttataatgacctgaaacgaagatgtgattgccattcctagaacaggctgtacagaaccatgtgtacttataggtgggacacaggcaaatccttgagaaacagaggctgaatcataaacagaagtgaacctagtttgtttttactatatgatgacttttaagccttacatggaagcgtgctggtctttcacttaccctcagatcagggcaccttctctgcagtcttttctggtcctccacatctgcatttgcatccctgttgtgatagcataacttgagctagcatgttcatgacattgattggtactgttttgttttgggacagggtctggctacgtacctcaggctgacctcaaattggagatcttcctgcatctgcctcccgagtgtttcaattataagcatgcaacaccacagctaacttgtattgctactatgaatattgacttatgtattgtccctctcgacagactgagcccagatgtattgtagttcttcagggcccatctagcacaatgacttgactagggacagagaagtgaagataaacgaaaaaggagaatgtgacatgcaggcacatttagctaagtgttccttcaggaagttgtgagcatcacacttactgcctgggtgcgaccacttgagtcccagtgttgttggttctactctttttggtagattgttcatatcttcttcttacctctattctgtatgcttttccatttgctatttaaaaactgcttaattattggggtctggtgctgcaggcatgctccttggaaggcaagggcattaaaatttcaatgcatagctgggtagttgtgttaaccacctttaatgccaacacttgggaggcagaggtaagtggatctcagagttcaaagcgaggctgatctacagagtgagtttcaggacagccaagactacacaaagaaaccctgtctcagaaagaaagaacaaacaaaagagagaaagaagaaatgaggaggaaaggaaggaaaaagaaaagggaaaaagagaaaaaaaaaaggaaggaaggaaggaaggaaggaaggaaggaagaaatttcaaggcatgcctgcacttcctagcactcagaaggcagaggcaggcagatgtctctaagtttgaggccagcttagtctacacaattaagtaacaggctagctagggctacatagatgcagctttaaaaacattgtatcagtttgtcagcaggatgcctaaagatgcagacacatatagatagtaagaaatttacaataatgaaacacatgagtctagtcatcatctgcagctatacttccttggtttttgtaactcataatagtttagcacaaatgcaatatatagaacttgcatattgtattttggatctctgggtattttcactatatgtgtcctctaacccacaactctccaccagttttctctagatatgaatatttaaattttataaagatcccacgtataagatcatgcaataataatttactgtgtctggcttatttcacttagcataatgtccctaaatggaaagatctggttctttttaccaggctaattactattctgatgtgcatttcccgtctttctcctgacagcttattttcatatcttggctattgtggattatgcagcaatgaacaagggaaagctgatagctttaggaagttatttattaattttctttgggtatatgtcagaggagatgtttctgggtcatgaggtaacttttagtatctttcaaatcctttgtactgttttccatattgttgtaacagtttgaatttactccttaaaagagggaaagggtccggcagtggtggcacacgcctttgatcccagcacttgggaggcagaggcaggtggatttctgagttggaggccagcctggtctacagagtgagttccaggacagccaaggctatacagagaaaccctgtctcaaaaaaccaaaataataaataaataaataaaataaaaagagggtaaggacagatgacagggttggaagagaaaaaaattaacaagagcccactttggtggaatatgtaatcctagtatttgggaagtgtaagtaggtggatcgggagttcaaggtcagcttctcctacacaatttggtggaggtttgaggccaacctgggctatgtaaggtccggtctcaaaaaaactaaaagttacaaaaatagaagatcaggcatcaccgggctgcattcatggtggaagctacccactagaactgaagcttcaccctcggcatctgcatgccagctgaagtatctgagcttgcgaccgattaatgacagtcagcagtggaagaaccgccgaagtttcacaagaatagagggtgagatccaaaagaagaggcccacagacgcttcgcctgatttaccggaactagcaagcctcggctgtcttcaaacatcacaaaatctctaccatgccacagactgggcttcaggcgcctttccctacactaggaaaacaaaaaacaaaaaacaaaacaaagccttactacgccggaagccaggtagtttgccataatcacctgaccggtcagctgcattcggattgggctttagtagtacgtgctcgggggataccgccccagcagctctaggggcggggccaggagccagaggccacggtattggttagatccttcagggattacccaatcagaatcatccttcttgccgcgcagagcgtgcggcgcggggcgcaggagggccgtgtcggcgcgcggagtttggatggtggttccgcccggcgcgacgtaagcctgagtgaggtgagttcggcgcgcgctgggttgcggtggctccgccgactaacagagcccgaggccttggccatttcaccagtcatccgtcccaggttctccgagcctcgcttgtggcgagaagcccagaccggagtagagacctggtgacccagaaaaggccatgtcaggcggccgaggctcgagtctcactgtccacactttccttaaggccttgattgtcatacgcgagaaattagctcatctgcttcccgtagtttgtgtagtgctgcaacgacccctcgtagcaatgcatgctttcgagacgccagaagaggtggaggtgccctgtttttaatcggagaagcaggagctcagacctcgtttgccgaaagggcgcgcgggcttggatgccagatgaggtttgaataggacctgcccagctctgaagcctatctcactgccccaggcttcctcccagtccctcttaactgtcataggttacccgggtgagggtgactgagatgaacctgccatcttccggtgtcgcctttaaatacacagctctcctacctcagcaaggggtaggggtgggaaagactgatcgagagatgacaagatggaggagaaggagagaggcagacgcctggggagtaatacatttaattgagcttggaaggaacttgtctcagccatccagtgctgagttgacgtcacaccgtctcagccatccagtgctgagttgacgtcacaccggcttgagtcaacattttgttagcctgactgctattctgtttggatgtcactttaactttgcttggatgaagtgggatttttaggttcccaagatagggatttagtaccagtttgtttgttttggatcttgtagtccagtttggcctcaaacttgtagagctgagggtgactttggactccatgatcttttcagcctcaacctctcaagtgcttgagttacagacccatgtcaccatccctgttatttaaagtgtatatactgtgaaatatgtacttctgcaaaagagactcacagatttctctgtgtagcccactgtagaccaggctggcctcgaaccctgattccactgcctttccctcctgagtgctggaattaaaggcaatggctgccactgctggacagaatgtagcatcttaaacttggttgagggacatgctctattttctatatttttaccttttgccgggaatggagatgggagtatgttcttgtccatgtttgtgctcatgtgtgtgtatgtgtgtgttaatgtgcaagaagaccagaggtaccttctgcagttgtcttccatcttagtgtttggggcagtctcactgaacctggaacttactgattaaactagcaagcctcccaggactggcattatagatgcacattaccgctcctgactttctaagtgggttctggagatctgaaatcaggtccctatgttcatactacaagcactttactgactgagccatcttcccaggccttttctgtcttaccaggttcaaagtaattgaaaaattatctgtataattttgtgcctaaaagcctttgagtatcttgctttcctgtagaataagatcagttgccactgggaatttcggtggttcacacctatgaccccaattggcactttgaatgagacaggagaatggaaagttaagagcagctttataaagactatcttagaagcaagctacctcccagagcaagcctataatccacacacacatagaaggtggagacagaaggatcagaagttgaaagttttcctcgggtgtatagtgaatttgagaccggtctagactatatgagaccctgtctccaaaacccaaaacaaacattaaaatgctcattacatttataatgtctttctgtcactctggctattattatttttgttattattattaatattattttgggggtggttttgagtcagggtttctcagtgtagctccggctgtcctggaatttactcagtagatcaggctggccttgaactcagagatttgcctgcctctgcttcctgagtgttgagattaaaggtgtgcaccactactgcctgactcataacaaaactttaacagtattttttatttgtgtgtgagcttgatgggatcagagaacaacttgcagttctctgccatcgtgtggggccaggggattcgaatcaggttctcaggcttggccagcagtcttactgcctaagccaaccgaatggtcctgtttttgttttttcacaagttcttaacacattttagttataaaataggctatatagatttttcttaggtaattgtttacaatgtactcatacttgagtggttcacattttttagtttagtattctgtgtagcatacaagcactctaactgtgaactataccatcagctcttggtttttgagacaagattttattatatagctcaagttggctgtgacctggctatccttgcttcagcctcttgagtgctgggattatagttttatgttaccacaccagctctttgtatgttatgttgtttttttttttttttcttttttgcttttgtggtactgggatttgaacctacagtctggtacatgccaggcaagtgtttttccactactgagttacaacctagtagttgataatgtttctaagtttcatttggggctaaagagatggttcagttgtaaagtactttacttcacaggcatgaagaccaaagtttcagaacccacaaagaaaagccagttaagtgccacaaacctgtaatctcattagagatgagccaggagcccgctggccagccagtctagccaaattggtgaactccaggttcagtgagaggaatcctaatgttggtttctggcctccacagtaactcaaatgtatgcacgtgcatgttccctctccctctccctctccctctccctctccctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtgtgtgtgtgtgtgtgtgtgtgtgtgtgtgtgtgtgtgtgtatgtgcaccacattcatgcgtggtgcccacagaggtcagaaaagggtattgaatcacctgggactggagttctgaatggttgtgaaccaccttgttggggctgggactcaaacctaggtcctccaccaggtcaataagttctctttgcctctgaaccagctctctactcccctttatgtaattttctaaacaatgtattttacatttatgggcaatttgttagcatgtatgtctgtgtacctagagtgcgcctggtgtctttgggggtcagaacagggcgtcagattccctggaactagtgttacaaatggtagtgagctgtaatgttggtgctggggatcaaacctgtgtccactagaagaatagaaagtgctcttagccaccgtgttatctctttagctttgattttctaccttaaaaataaattttataataaattaaaatattgtgttatgtgaccatacccgtttttattttgttgtgataagcacacctgacatcttctctctgaatggactggttgtctatgtgctttgagacaggatctaactgcatagcccaggctggtcttgacctctgcatgctctccgatttctctggtgaataatatagtatagggggagtgctgcactgcagatctcagcctctcatcctccacacagaaagctaatcagataggatctgctcatttccttacacatggcagctgtactgctgtactgtggctgggcttatgtagtactgtccttcagtaagtggctattttacttagcagaatgtcttcagggttcgcctgtgttgcttgccgtaggactgccgtccttttaaaggctaatgtgccgtttcgtgtatgtaccactgtacagtacaggagctctcatttcttgcccccccccccacccatatcacacttcatttctgccttactattaggtcaggctgccctcatactctcagtgatcctactgcctcagcttctggagcactgggattacaggcatgcaccaccatgcctggccccacatcttcctttcctctgcttcagactctaaccacaaatagggaactccaatattcctcgcaactatcaaacccggctgcaaaccagatttgcatgatagggctttcttttgttttgttttttgagtagttcagtaatttgctaaggtaactcatagacctcagggaaaaccagacatctgctttctaggttctagtttgtttttaaaagggtacctttcaggaaagtggaagaactaacatagtgcaagggatgtgggaagaggtggagccttcataccccaactcgggaattcttcaagcctgtccttttcagggtttgtgcaggctttattgcttaagtgtggttgagtatatcattgtcactggtgactaagtcactcttcaccagtctccccccttggtagcaagagtgtactgatgtacaagtggttgaagtcaagagtatacatactttattttactgtagaatgctaatgttaaatggctactcttccatcactgtactgatctcttgctgcttcacatccttgctaatttatatacacatatctgtatattatatatacaaatattttaaaaatttttttggaggtgggggtctcatatagccagaggcagccttgactcttgcaagtacaggaggtatggacatgcaccactatgcccaactccttcattgttgtttgcatttcactgtgagggtacaatggtcaaggggaaaaaaacaaacaaacaaacaaacagagaaaattacgcccatctctttgttttttgttttgtttttttgtgacagggtttctctgtatagccttggctgtcctggacctcattttgtagaccaggctggcctcgaactcagaaatccacctgcctctgcctccggagtgctgggattaaaggtgtgcgccaccacacccggcccttctttgtttttgtttgtttgtttgtttgtttgtttgtttgtttttaagattgattgattgattgattgattatatgtaagtacactgtagctgtcttcagatgcaccagaagagggcatcagatctcattacagatggttgtgagccaccatgtggtggctgggatttgaacttcagaccttcggaagagcattcgggtgctcttacccactgagccatctcaccagcccccttctttgtttttttgatagaaggtcttactctatagcccaggctggcttgtcactcattatgggccaacaatcttcctaccttagcctcctaagtgctggggttacaggaatgtgccactatgcccagcttagaaggtgccattgttaattttgtttaagaaatctcttgaaggttttaaagttatttctgtaattatatcctagagactttattatttgtctttcatacttaggtgtttggttttttctttcatttagatgagttttacaaatttttagattttaattagtgtgtgtgtgtgaactcgcacatgcactgcaaatagggtattctatgtcctaggctttcctcaaattcgccagatagtcaagaataactgaactttttatcttcctgccttactttccaagtcctgaggtaggtgtgcactccattcaatagtggttgaacactgggctttgtgcatgctaggcaagcattctaccagcagagctacacccccagtgtcggtataaatagctcctgcctgaggaagctccaggtctaacaccaggaatcagaatgactgttctcacctagtgctcaacagtatcatcactatagatcatggatgggtttatgcttgtttgagccagagttttattgtgtagctattgtttttatgtctttctgtatcttgcagagcaaatctcacctagtattgtttttcatgactctgttggctgttttgctattttatatctattataattttacatccagggtgttgatgcaagtgcttgtcattcctaagcctgacatcctgagtttgggttcccagacccacaaaaccagatgcagtggtgcaagtgtcccacttcccagtgcaatcccgagaagtgggaggtggaaacaggagagtctctagaagcttgtaagccaactagccaacactgtggtggagaaaacctgtctcaagcaaggtggaaaggccaggtgccagtaactggggattgttctctacctccacacacatcccacattgatgcagcccagtgtgcacacagatccactatcaagttcccccagaaaaagaaaacagaattttgattggaattttattgtcatagatcagtttgcgatcttggcatcttgagaatattgcttccctatcacaaatgtggctcatttgtcccttatttaattttgtaaaaattacttaatagtttcttgaatatatgtggccatagtttgtcagatatttttggagggtacttaaatgttgataccactgaaatcgagtttttgttctttattttctagttgtccatcagtgacacataaaaaggatgttttgtgctgatgtcttttctagcagtctttcataaaactgctgtaccaaattactacaacttggttgcttaaatgacagctttgtcttacagttcagtacttcagaagtctggatgggcttacctggaataaggactaagttcagtacttcagaagtctggatgggcttacctggaataaggactaagttcagtacttcagaagtctggatgggcttacctggaataaggactaagttcagtacttcagaagtctggatgggcttacctggaataaggactaagttcagtactttagaagtctggatgggcttacctggaataaggactaagggcttttcagagcttcgtttgttcataccggctctagggaaaacatgctcattgcccttgtcagctgcttacaggtgaccatatccctgacttgagatttctttcattatcaaagccaacaatcttgggtagaatccttaaggtgtcagctatctggtctgccaccagatttttctctcccacttaaaaaagacacttgtggttacattggccccacttgtacagaccaggaaagtagttttgttttgttttgctttttcttctcactttaatttttcaccctaaagaccctatttaaaaagcattttaatacttcagatatgtttggaaaacttctttttgtttgtttatttggttggtttttcgagacagggtttctctgtgtagccctggctgactggcaaacttcttaaaataagatttcaaaattaagtcttgagtttggaaatgattttgggaccagatatggtcgggcacacctttagtcctacttcctgggacgcaggggcaggaaagtgtcagtgagtttgccatcagcctggttgacatgaagagttctagaccagccacggctatgtagtgagaccccacagcttccgacaccgatcactccagttcccggggctctgatgtcctcttctgacctccatgggcatccttcacgttgtgatgtgggcaaacactcatacacataaaacaagcaaatatttttttttaaaaagaaacaagttaaaacaaaaaaagagaaacttgtgagtttataaaaccactaaccaaaatcagaacaaaaattcactaacataaatgttgttttagtcattctgtttttttgttgttgttgttgtttgtttttatttctgggtttttttggttttttttttttttttttttggtttttcgagacagggtttctctgtatagtcttggctgtcctggaactcactttgtagaccaggctggccttggactcagaaatccgcctgcctctgcctcccaagtgctgggattaaaggcgtgcgccaccacctcccggctttatttctgttttgtttttgtttttgagacaagagtttctctgtgtagccctggctgtgctagaactcactctgtagagcaggctggtctcaaactcagattcacctgcctccactcctaagtactgaggttaaaggcgagttgctaccagccagtggctattctgttttaggatgatccaccagcagtagttctccattaccacacggccagacagtcacagcttgaaaagattaaggtgtagacctctgtggctaagtagagtatggggcattattctgggttaagcgttttcacagtttaacctgaagattgttttaggtgctgcacacacaaccatacaatttgcaaatgtctatggctttgcttctctctccccaggtacctttcatttgtctgcttctccaattggctcaagttgtaaagcatgtcctctgaaagcagagcgtgggggtggggccgcaactgttgtactgagaacaaacctttctaagcgcattgtagacctgtttgttttaattacatcccttctgtcaggacagggatttccttccattcattgttttttgaccattcattgtggatggatttttatatgtttattctgtggatcttgaggaagtgaccatagtgtttgttggtttgtttgttggtttggttttgtttgctatgatctagtgtgatgagttatcttagttgattgtctaatggtgaactagccttgcagtcctaaaacagcagatctggttttatatgtagctaaacttccttcacacctacatctatgaatgagaattagcctgtgtgtttacggttgcactggattgcagtgttcactgttgggatgaaggtgttgagcaggagaagctgatctgtactttggggttgtctgtatgaaactggagtgctttattgttataaatgctcagaacactctctttttcttccctctcttctttccttccttttttttttttttttttttttaaaaagacaggggcttacgtgataattcagactgcctagaactcactgtagccaaagtggaccttaaactgagcagcagccctcattcagctgccaaggcattggccacagtgcccagcacttttagtttttgtgagacaagatctcatagacccaggttgaccctgaattctttatatagctgaggcttgccatgagttcctgctctccctacctcagtcccccaccaactctacttatttaatcttttattgaagacttgagacagtgaaatcaggtaagagaaattattcacaaggcttggaaaatagaaaaagtactactgccctcaccttcagatgatatggaatttgtctagaacacataaaaataacctaaatagctaaaacgaaaaataatttagcccagcccaatgttacatgcctatagtctgagcactcagaggtgactgcctgagaactagattcaaggtcatctgtagtgacaattttggagttttggcttctttaaaaaacacagaaatataagaatatgtttttggttttgtcccagatgtaggaaggtggggctgcttcagattgtccacatcagctgagcctgattttccttacactgtgtcgggacatgattttgccagctgcaaatagtttctgtggttgtgtgatgtttggaattctggagacatttagagggtatataaatgttagggccctgagaggtgggatgggttgttggttgttagttacagtttattaagtggtcatctacaaagaagaaacaataagaagaaattagatataaggagagtgaagctcaaacttgcctcaagtaacttgatgccccaatcagcaggaagtagcctaatgataaagttgccccccttcctgacctctgactttgtttggggatctctttcctgtcctatcttttttttttttttttcttatctagtgttagggggttgaaagggtgggaaaaagaagaacccacaaagtagcaaacacccggctgcatcattctcagctacatggtgagttggaggccaatctggactgcctgagactgtctccacagcagcacatgcagaggaagagtttagtaagacaacagtatacatttaccacacaaaccaggtgtttaacaaataagactatataaggaaggggatggtctcatagtaaaaacaaaagggttaaaatgtttaggaattctaaaacataaatgaagaaatctttaaaactcagggctaaatgttacaaaagttgcaaggtacctttcccaggatagagtaacctaacacccagagagcatagggtttacagaacttaacacacactcagtatagtttcagtaaagatagctgcaagattttctttctgatgctagaaacgatgattctaaagttcacgtagaacaaacaaaaaacaaacccatgaaaccaggtctggtgtcatatacctgtcgttccagcacctgaatctataactggtagaaagaagtaagtaatagatcacatcagagaccaatgaaatataggaaataaagcagttaagaaatagacaagaccaagagtcgtttctttgaaaagatgtgaaggtcagaggacaacttgaagttcaaggctgctgcctcttgttgatggagtatgcagcctgtatgtgctgtcctaagggaccatggagacagtgtggctgtaaatgtatctgatctaattctgtcactgacataggcttcagacatgtttgcagaccgcccttgggcacagtgaccaggttttcaagtcaatcataaccaaggtgcaggcagaataagcacatttgattaagaacacatttgattgtatgaagttcaaacttcctggctgccaaaagatccacatctcataagtttaatacagattaatttgaggatatggtaactgaaattgcttatctttagtgactttggggtcaaaatgtcaccagtggtggtgccctagacaagtggtagaccctgtactcctaagggcctccactgtgttgagtccacaccctatgttttaattagtgttttcctgctgtgcacagacaccatgaccaaagcaactcttataagaacagtgtacagggtcagaggttctgtccgttatcatctaggcaggagcatgggagagcccaggcaggcatggtgcagaaggaaacaagagttcaacatcttgttccaaaggcaaacagaaagctggcttccaggcagctgggaggagggtctcaaaacccacgcccacagtgacacacttcctccaacaaggccacacctcctcatagtgccatttcctgggccatccatattcaaaccaccataccctaccaaatcatgttcactaataaatctcacatccagttaaaaaattaatactaaaatcatcttcaagctgtaccacaaatcatatatatgttaagaggtcaacatagaatatataaagaactatagcttagcaaattagaaatatccagtttgagccgggcagtggtggtgcacacctttaatcccagcaattgggaggcagagacaggaggatttctgagttcgaggccagcctgctctacagagtgagttccaggacgccagggctgcacagagaaaccctgtcttgagaaaacaaaaacgagagagagagagagagagagagagagagagagagagagagagatcaatcgatcgatcgatccagtttgaaagggcataggtgggttgagaatttcacttagtggttacactttgaaaggcccgaggtttccttctagtaccaaaacaaagcatagcaaaggatttgaatagacattttcccagagagaatacacagtagtcagtaaacacatgaaaaagtgatcatttttgtaaatcattagagaaaagcaagtaaaaaccaggtgagataacttcatatccattagaatggctatcatattacaagaggaggaagaggaagagagagaaaaagctaaaaagtagcaagggttgctaaggatgctgaaaacttggaagccttgttaattattggtagcagagtaaaactggcattccagaggacaggagacagtagtatgacagtatgatagttgctcaaatgataaagagagatttgccatatgctccagtaaatccatttctgggatgtatccaagacagttgaaatcaagacttcaaatgtaatggttaattaatttatttaaaaacctaatttatttattttctgtgtatgattgttttgtttgaatctatgtatgtgcaccatgtacatgcctggtgccaaagtatcagatcccttgagcctgtgttatgaatggttgtgagtcaccacatgggtcttaagaatcaaagtcaagtcctctgcagagctaccagtgctcttaccagctgagccatctctttagccctgtgatagttagttgttagtcacattggattggagagagccttggatactagtaaactctgagcatgtctgtaacagtgtttcctgagatcctaagggatttggcctagaatagattaaccaggctgacctcagactcacagagatccaccagcctctgcctcctgaggggtgtgattaaaggtgtgtgctacagtgcctggcccaggaagttttttcttaattaccgtatcacttgcagtgggaagacccacttttaatctcggtttttgaggtgggaagttaaaatttaaatctgggtcacaccttttgcaagcagcctatatatataaaggacagagaaggaggaagcttctgctctttacctgcttgcttgctggcaaggtcatcccccactggcgttagagcttgcttctcaggattctggtgtgcactgaagactagctgagacatccagccttgtggactgaacaactgctgttttttttggatcttctggtggtgggtaagagccatggttggattagcctttaaatcattacataaatcccttttatatgtacatatagaccatcacatacactcccattttttatacacatatacacatatcattacagatatgtatatcattacataaacattacatacatgtatgcatatatgtgtgtacatgtatataatgtatattatataactattatatataatgtatatacatatatgttacagatatacataagtcattacataaaccctctttatatatacatatagattcattttataaattctgttcctctagagaatcctaatacagtagccaaaaagtagaagcaatccaaatgtccatcaagagataaacataagcaaaatgtaatgtgtgtgtatatgtatatgtgtgtgtgtgtacattgctcagctttaaaggagaaggaaattcttacttatgttactgagtgaaccttgaagatgttatgttcagtaaaataacagcgacaaaaaatttcacttagatgaagaatctaaaagtcagactgtagacagtacttgatgttatctaaaaggaaggcgaaattagaaggcaatgttaattaatggataagtgcctgtgttatacaattaaaacctttctgtgtttgatggtgcaacagtgcaactctcttgaacactaaacatttcatttgtttgtttatttttggtgcatggtgcacatgtgaaggccagagaaccactgttggaagttggctttctcctgccttaggtttcagaggtttagttccagttatcaggctggattagcaagtgcttttacctgctggcctatcttgcctgccccacagagcattctataatgatagtgatagcttgaagcagtaccaatcccattggccaaatgtcaaataatttgcaggtcaaaatactgttatcccttgatatgtatgagagattggttttgagacactctggatatactttaaggattatgtaaaggccatatgtaaaatggcctcatttgctggtgacaagttactgaattttgatcatattaaaatgtacatatatatatatagccttaaatatactaaacacacacacacacacacacacacacacacacacagccttatttgctggattttctgtctcctgcgtgttcagattataggtgtacgccactgtgcctagtcttgtcttgtcttgtcttgtcttgtcttctcttctcttctcttctcttctcttctcttctcttctcttctcttctcttcgtgtgtgtgtgtgtgtgtgtgtgtgtgtgtgagagagagagagagagagagagagagagagagagacagagacagagacagagagacagagagagaaactgaacccaggatccttgtacatgtttggtaactcttgcctgtaacacattattgaaacataacctatttgtaaaaggctgagaattacttgactacatttttactgtagattttttttttaatgagacaaccctatttaaaaaaaaaaaaaaacaaaaaccagtaaatgagaagagtcttgtaaaaaatgggctaagactctgataagcataactaattcaggaatacattggacagctgttttgctactttaagttacagaatgttgcaagtcttgtcctagtttcttttgctgttgctatgctgaaattccttgacaaatgtaccttcagagagaagggcgcacagtccatcatttcagggaaatcaaggcagccacagtgagaaagcagagggatgagtgtgtgcagcttcccagctctctctccactctgggtctccagcccagggaatgtcccacacagagtcaagatgtatcttcccgtttcagttgctgtaatcaatgttttctcacagacacatctacaggctcatttcccaactgatactagattctgtcaagttgataattaactctcacatcactttttctagaagataaactacacacacacacacatgcacatacatacatatgcatttaaaagaacatataataagagtcctatctaaagactctgttcagaaatcgtttgcttagtgtttggtgtcaagagagcccttgtttctagggtctcagataagctttatgggtaatgttcatgtgtgaggctcactacttttgtcccagggaaggtcacctggtaagaggctcacagagcttggctgtgttttcaggaacaacttcctaaaacctctacttttagcagaaaactagagtagacatctgactgttacttggcaccaagtatcttagaatagtcattttggcagtccacctcttgatattctgaaatagctgtcttgttacaacaaaaagaatgaaaggaacatttgacctagaaagaggaggtagtcctaattttgatagatctaaaaattatttcatttatttgaaagaaaaggatcctctactccaccccaaacagcctagtctctctatgccatgtctctgtgttaataaaaggtatatttatttatcttttatttactgacttgatttgactttaagacaatctatgtaacctagcctggaactcactgtgtaggctgtccttaaagccacagagatctacctgtctctgttcccaagttctgttgtgccaccatgcttgacttatttattttgttgttttgttttatcaagacagggtttctctgtgtggttctggctgtcctggaactccctgtgtagaccaggctggcctcaaattcagagacccacctgcctctgcctcctgagtgctgagactaaaggcatgcaccaccactacctggccatacttattaaaatatggtgtacatgtatagtgtatggtcatatgtgtgcttagtgggtaaaagtgcctgctgccaaaattgacaacttgaatttgattcccagaacacatgtggaaagagagaactgatttttacaggtgtctttggagtgccacacagaacaactaaacaaataaatactaaaaagtcaaagggatatacgatagctcagactcagcattggggggtgggggagcagaggtaagccaatctctgtgagttcaaagacatagagaccttgtctcaaaaaaaaaaaaaaataataataagggtgaaaggggagacttaaaaagtatttccctttttatcaaatgtgagtgaaagttggtctgttgtttttcctaatattcctaaaaatgttcttttctatagttctcaaaaaaattggtattcttgtttgttgctttcatttcattgaccttctttcttctttcctccttcctttctttcttcctccttcttttctttcttccttccttccttccttccttccttccttcttttctttctttcttatccactcgaagaatttagactttctttttcaattggcctaattttataagattacctcttaggactctgactgaggaggccaaggctgcagaatcttgatattaaggtcaatttgaaaaatttagtgtgcccctgtctcaaaatcaaagttttaaaagggataagaatgtagcttagtgacagagcacttacctagagtatgtgaagccctacaaaattcagtgttacaggatatttgatcactctgtgaaccccaagattgtgttgtttactggaaaaaacctgtctctagtagtggtgtggctcagccttagcacacactttaatcacaaacaatgaaggtaacatatgctagtttgtaaaaggaagcaccatatttgaaagtgatgtctgagtggcagacaaagtgatgaaacagagaaagatttgacagaataagatatgctcaactctcatgaggacagagagaaaagagaggctacttaagagagcaacacagagagaaaggaggaaggaggcagttttacccggagagttttcagaggcaggtagaagagagaacaagcaaaacatagaccatagacgaagacagaatgcaccaaagaatgagaagtagccagaagattagaacagattgctagagttagtttgaggccgagcagagcaattcagtcagaggcagagaaaggtcagattaaatcagtcagtttagctgggcgcggtggcgcacgcctttaatcccagcactcggggaggcagaggcaggcagatttctgagttcgaggccagcctggtctacagagtgagttccaggaacagccagggctacacagcaaaccctgtctcggaaaaaaaaaaatcagtcagcttggagaggattttgagtcaagtcagctgatttgaaccagacatacagagttcagaaagaacaagaaagggtgagcttattcaacagtaagtctctcaaagaatgaaaacctggctagaagtttccaggactaggcctaggttagcagaaggagacagttcttggagtcaacaattaattcaggcaaataaaagataaatttacacctcagtaccatcaaaagtaaaaaactaccccagaatatcatgacctgataggctccctctgtttctgatttcaaaatctcagtgtcaagacatagttcaaataagatgcctttaatcatttattcttttctttttggagatagggtttccctgtgtagactatgctgattttgagctcactatatagctcaggctggcctcagacatcagtgatctccctgcctcagcctccccaagtgctggaattgcaagtgtgagctgccatgcctggcttgtacttgttcagtaaagttggatgaacaagtaatggattttcttgtaaatttggacagatattatactttagtgtaatctcatattctctgtaaaactgtatagttaaatgaccactctctacctgtctctgttcccaagttttccaatttgtttgattcactacttttactttttttctttttgagactgtgcctcattcggtagcataattttcttcacacatgagctgggttccacataccctgtgtttcattactttacatatgtgtgcatatatgctctgcactcaacttagcgtttgcttactcatgttcttttaaaatatcataacttttatttttccatataaaagatatttttaaccactccccaaattgtgcttgtgattgatacctcatttgtctgaaacaaattccattggccaagcatgaaacattcataagggttctgaaatgccatactgtcatggactgaaacatactgactgtgctttattttttggcttcatactagtacttggaaaaaagaggtcactcttagagataatgaatgattcattctttagactctccgtgtgcgtgtgtgtgtatacacgtatgtaccaccctgcacatgtgacagagaacagccttgggtgtgagtctttgctccttccttgtttgagacagagtctcttcattgttgtccgctctctatcctaggcttgctgactcgcaagcttccagagattctcctatctgcttactatagaagcaccaagattacagatacacactatacatgtattttagtttcagactcaggtcctcacactgagtttacctactgagctatctccccagacctgatttattattttgaaactaataagaaaattccagttactgaattaaaaaattatgactcaatttaaatatcaccgttttcagaaatggacttctagaacagtgtagtgtgacccatctaatattattaatccttcctccaaatatgtatatggtataaaacaaaagtgtattataaaagtaaagtgataaactgggtatggtagcgtttgcctgtaatcccagcactggacacaggaagttcatgagtctgaggtcagccaaggttatatagtgagaccttgtgtattagtcaggatttatgtgtatatatgtatatatgtctctgtgtgtgtgtgtgtgtgtgtgtgtgtgtgtgtgtgtgtatggatttattagaatgacttactgactgtggtccagctaatccaacaatggctctctaaccaacagaagctccaggaaacccagtagttctcagtccataaggctggctatctcagttgatctttttagtgcacactgaaatcctgaagacatacactctaatgccagtaaaggaactgactagccagtgagagcaagtaaggaaagaataagcttcccttttcatgtcctttatataggctgccagcagaagggttagctcagattcaaggtgtattttccaacctcaaagatccagattaaaagtagcttttcccatttcaaattacttaataaaagaatctcttacaggtgtgcccagccatttgagtttcagtgaattccagatgtagccatcacaagtccatcccttacccacttgacataattatatctccttgtgtcctgcttaatttccaaatgaaaacaacaaccagatcataattacacctaacacgatataatgatcctacacacaatcacaaaattcattatatatttaaccaagttataattacacctaaaatgataaaactacttcacatacaaccacaaacacttcttactcattcttctattgccatgaagagacaccagggaggcttgcttacagtctcagaggcttagtccactatcattatagtagggaacatagcagcgcacaggcagacatggtcctggagaaggagccaagagctctacattggatcctcaggcagcaggaacctgtatcctctaacaaggcctcaccccctaatccttctaattctatcagagtcccctccctggtgatatatatgagcctgtgggagccattcttagttaaaccaccacacctcgtatcaggagaaaacaggggcccataaagtggttgagtagaagggcttcctctacaagccaaggaccaggaaagatggacacagagttgccctatgacctccatatctgtgagtgacaggtgtactactccccagtgcacacacgcacatgcacactaatagtaaattttgttttaaatccaagttgagtgggaaagaggatttataattcatctgaaataactttttaaaaactctttatagatcacagctgtctgtctttagctcagtggtttcaaggtggcttgagctgcgctttatctgggtgaaagtgaaccagtgcagcaagtgttacacagggatataaatgtgtgtggcagactgccgtggactgggggcgactggagcatggctctggctggtcagcctttgcactcgcctgtgggaggcctgtctttactggacctttagttttgcacagagaattcacgtcctggctgtcccccgggttcctagtttgctttgatcattactccctctcattccctatgtgccctccaagcctaggccaggctgtgctgattttagcatctgttgaagaaaagaggaaaacaggccattttgctattcaagtaaatctctagttaaaaaatgtgtgttttaaatgccaccagatgtaaatgttaaagcaatctgttgacaggaggaggaggaggaaggggggcagcaaaagtgtgttactctgggcacatctggaatgatgtggcggtttaagtcttttacctcctcagtaaatatgctgaatgatactaaatgcctaactccattaatggttgccctcttcctttttaggatcatggctgctgttcctctgaacaatctacaagaacaactacagcgacactcagccagaaaacttaataatcaacccagcctttcaaaaccaaaatctttgtaagtatgttcattctcatgtagaagacagctcaggtgtcatacaatggagctctcgcctttcacctctgtggagtctgggatagggtcccatgcatagcccctgctgactttgatctcactccagtccacacttgcctcacacttgccacagtcctccctcagccgtgtctgtgctcagatcaccaccacaccaggcttcctccagctctctcatttcacagaggaaatgaggagcccagtggttttccccgttgcaagttaatagtagagcctgtgctagcagagctgagtgtgattgttctagctttacacaggtcctggcacgtacttgttcagtaaagttggatggacaagtaatggattttcttgtcaatttggacagatattatgctttagtgtaacctcatattctctgtaaaactgtatagttaaatgaccactctctagttctgtgtctcctgcaagctaagccccaagttgctaagatatctaataatacactgtacttaggttgtgccctcaccagatagcaagcactgctccatgcctgcagatttaaagttacttcaacttcagtcactaatgtcagcagacagcctctgcctcatgtgtccttcagatcttagcagcttttctaaaactcctttctcccttaaacattttttttgtcacagtagcaaattccactctgagtctgtctgtctgtctctcaacacatcctgtcttttgcttctgaagggactattaaggacctccagcctgagaaataaagtgtaggagtggcctgggaactctcagtgcccagtaactagcctctgaatggaaaggattagagcgaccaaatgtttttaagtacctggtgaattttcaaaaccacagagtgagacagattcaatgctcaatacaattaacgtgacttgcacttgaaatgttttataggagaatgaatttgttaaaatggaaatgagtccatcagggcctgggattataagttatgataaaatgcttgcttagcataaatgaggccctgggttcagtcctcagcatcagaaacaaatgaattcactaactgagtttttccattatttttcagaggttttacttttaaaaagaaaacatcagagggtgatgtgtctgtcactagtgtgtccgtagtaaaaacacctgcgttaagtgataaagatgtgaacgtgtctgaggccttttcattcactgagtctccactccacaaaccaaagcagcaggcaaagattgaaggcttctttaaacatttccctggaaggcagcaaagcaaggggacctgctctgagccgtcactgccggccacggtacagactgctcaggacactttgtgcactacccccaaaacccccactgcgaagaaaccgcccgtggctgttttcaagaaattagaatttagttcttctgcagactccctcagtgactgggctgatatggatgactttgatatgtcagcatcagatgcgtttgcttcactggctaaaaatcctgccacaagagtaagcaccgctcagaaaatgaaaaagactaagagaaacttctttaaaccaccacctcgtaaagccaatgcagtaaagactgacttgactcctccctcccccgaatgcctgcaagtggatttaacgaaggaatcggaggaggaggaggaggaggaggaggaggaggcggagggggcagactgcctgagcagggatgtgatctgcattgacaatgattctgcttctgaagagctcacggagaaagacacgcaggaaagccagtctttgaaagctcacttgggagctgaaagaggtagccatcatctcatcttcgtttcagtgctttctaatctaaagctgagcactgggagcagcggtacacaggacagttgtgtccttgagggtcttactctctgctctgctgggcttagttctgtgactttagacatgaagaaggtcggtccgcagaggttgaggtggaaagggagacaagccttcccatgtgtaatgtcttagtggcttgccaccacagtgcacatgcagtcctgacggtaacacccggtcatcctgttgactgcagtcgtgtgtcacttaataacaaggatgtgttctgagaacactacatcctgaggccctgtcaggcagacatagtgcacttgcttaaccagatggcagagctgaccacacacctcggctagatggcttgcctcctgcctggaggctccaaaccacacatctgcgagtactgtagttgtctgcagtacaatgaaatacatttgtgtccacatagctctagatatataaaaggtacagtaaatataaataatgattttttttttcaaaaattttgtgtactgactgaccaaagtacacgaatggagctggcacacctagaagcttctctgagtgagtgggaagtgacgggaggctcggggtgctgctagccatttcagtatggtatccatactgcgcttagcccagagcagtctcataataaggttaccttcctcaggaattacttttagttcattgtaatttttaatcctttaattcttttaacaacacttagcttaagccatagaaagcattggttgtacagtcatgtaaaatgttttatgttatactggttagttttatgtcaacttacacaaggtaaagttatttgtgaaaagggattctcaattgaaaaaattcccccaccagactggcttgtggtacgttttcttgattgttggctgacttaagagggcccagctcactaagcagtgccacacctgggctgatggtgctgggtgctataagaaaagaagatgagcaagctaataaacagtgctcagtggcctctgcaacaattcttgcctccaggttccttccctgagtctctgttctgacttacccggagggtgaactgcgagttagacgatgagaaaccttttctcactacgttgcttttgatcatagtgttccatcaaagtagtaaaatccctaagatgcatgtacatgatacatgtgcatatatgcacacacccccaccctaccccatgtgtgtgctttatgccttcaaaggccagaagtcatcagagtccttggaattggagttacagatagttgtaagccatcgtgttgttgctgggaattcagtccaggacctctacatgagtaacaggggatcttaaagtgctaagccatctgtctagccctggtcttaaattcttgattctcctgccttagtctcctgagtgcaaaaattaaggttataagctaccacacccagttcacccttttcttttcctttgtcccttccccttcttttcttccctcacccattcccttccctcctttcttttatctttcctttcttgttttttgtttttgtttttcgagacagggtttctctgtgtagccctggctgtcctagaactaactcactttgtagatcaggctggcctcgaactcagaaatccgcctgcctctgccttccgagtgctgggattaaaggcgtgcgccaccacgcccggctttcctttttttattaatgttctttaaaaatgaacattagcttaacacacagtcaagattttgagcatcactgtcttctataatcgcgtctcttcccccaagtaggcctttggggacaagagctgaaaataattcttcatcgtctgtgcattccttttgtttgattatttgtttcctttattttactttatacgcagtggtgctctgcctgtatgtatgtctgtgtgagggtgtcagaagctctgaaattagagttacagataggtgtgagctgccatatgggctcagggaattgaacctgggacatctggaagaacaaccacttaaccactgagccatctttccagcccattgtttgttttcttttttctttttgttttttcgagatagggtttctctgtgaaattctggctgtcctggaactcactctgtagatcaggctggccttaaactcagagatctgcctgcttctgctgagacttaaaggtgtggccctctactgctggctttaaaattttttttttaatttgttcagtggccctgatctggactcaaagccttaccccctctttccttgttttttagggattgaaccgtaggccatgcacattagacaaacactatcattgaattatagtttcagccttttagttattgtttattttgtgacaggatcttaccaaattgtccacatatactttaagcttgcagtttccctaccttagtcttctgggtagctgcttcagcctccttagttgctcagagtacagatacataccacatccagagtctataaagtttttgaacatccaggtctactaaaattgctacacaatgagagatgactgaaaaaaaaatgatgaaaagtgataacaataataataacaaaaacaataataacaaccagcaaataataaaccagcaaactgttgtttaatctattatgttgctgtttctcaagagaatagtaggcagatggtaaaaagtaaaaccagagagcaccaggagatatggtggtacagctaggacagttgtgtgatagaggagattgttggtctgtatagtagcagtgtgtatgccggctgtgtgacacatctgtgatcctggcatcaagaggcggaggcaggaagatagagttaaaagtctgtctcaaaccaaacagaaagaaaacagacccaccatgtttgtgctattaggcttccctgctgcatattactcttatttaaatgtgagtagaaaacaaaagaaccgaaacaggagtttcataatttaactacagctaggttgaattccctaagcaaatccttggctctagtccagcttcagctttctaacagttgtctcacttctttgtgaagaaatcagccaacactaacctgcacaagattcccataggaagtgttctgatggtttatggcttgcccacaaaccactcactcatagggactcatgcccattctgtctcattgattattaaaataatctgtgtttatcaactgtttttctgtaggtgacagtgaaaagaagagccatgaagacgaagctgtgttccattcagttcagaacactgaatactttgaacacaatgacaatgattatgatatagattttgttccaccttctccagaagaaatcatctccactgcttcttcctcgttgaaatgttccaggtaaaaataatcaataatcaatattcttgtttgtttctaaggtgctttatgtaatgtagcttagctagagaatatcatttctatataagtattctttgtggttctgtaatttgttttgtattcaaatgaaagcatcccccccaaaaaattgttacttatttatttggttgtttaagaactattcttagttgggtttggtggctcatgcctcgagttccagcaccggggaggcagatcagacagatctgaggccagcatggtcttccaagtgacaatatgtctttcaaaaacaaaaaacaaaaaactcttactatgtacctgaagctggccttcaattcaggatcctcctgccttagtctcccaagtgccaggattacttttgggaactaccacacttgggggaggggttactacttaagttttagtaatattttaaagcctattctagagacttcaggcagatccaaatctcagcccagttatgtggagagatcactactatatcgtttagccactaacttgagagaaacatccccatagtgtatcgtctggattaggaaaaagaaggaggggttttatatgcaacctgtgcagtccttgtgctttgtgccttaacatttttattattggatttattcatttatgatgtgttttgcctgtatttatgtatgtgaaccattattatatatgcttggtgcccaagaatgtcagaatgaggtatcagatcttctggaactggatttaggagaggttgtgcaccgtcatgtgggtgctgggaatgaatcgaggtcctctgcagggacaaggtacttaacctctgcgccatctctcccgccctggtttgtgctttaacagctgtattgtgctgtttggagaagtggtgggggtcgaagtgtgattcctgttttgataaatttatggaaggtaatatgtggctaagatccatgtggtgttctttccttagcctgatgttttcatgttgactacctagctttattctttttttttttagttttgtaatagatttatttttaaagggtaaaacactcagacaatttaaatacaagttgaacagagccgctgtcaggccacgataccatcatgtgtcctctggagtcctcacagtgaggaagaaggctctgatactttattcatacacatccttcttatctgcaatgtaatctacaatttcttgtggacacattaacttctctgcatctatatcaggaatttcaaacccaaattcgtcttccatggccataataatttccacttggtccaaactgtctaagcccaggtccttcataaaataagaatttacggagagcttttctggatcaatcttatcatagagtttcaagacatacagaactcggtccttgattccgtctaacgtcagtgggggccaaggcggactgcagagccccgggtctcctccggattccctcagggcatagggtggtgctgagcggccacgccaaggccaacgtgggaagccggggcagcggcgcgaaggccgcgggcaggcggcggacacaggcgcagaggacagagacgccatggctacgcccgcctagctttattctttattaaatatgtttgctgcacaaatgatgttgtagccaccttaactagaattttaaataagagggaagaagtatttttagttccaagattctaacaaactgttttcttgtccttgtttggtttccgtcttcctctccatctgcttgatctgactgttgtaattgatacagctgtaatttcagattctttctctaacattattctccatagtgttacatttaaaaattaataattttgccaggcagtgatggacaatacacatctttagtcccaatagttaggaggcagaggcaggcagatctctgtgaatttgaggccagcctggtctacagagtaagttccagggcagccagggctatatacagagagaccctgtgtcaacaaacaaacaaaacaacaacaaaattataatttcataactttttgaattcttataccatgagtaagttcacttagtatattacttttctcattgatgtggcaaacaacttgtgggagtaaggatatattttggctcacagtttcagaggctgctggccatgctgataggagtggcatgtggggtaggagcttaggactgttactgtcacaggttggtgggtcaggaaggtcaagctaaactctcaaggtccatgcctggtggcctctatatgccatctaggccctgtgtcccaaagatttctacaacccatcaaaacagcatcaccaggtgtccaaacatattaatctttcagatccaatgcataatatttagatttttcccaattagaaatgattatttacaaggttgatactttactttccagtacagcctaatgtgactgattgtacagattgtgtgctagttagtgttctgttgctgtgaagagatactgtgaccttataaaggaaaagcatttcattcggttcagatgtttagtccattattgtcatggcaggaagcattgtggtgcacaggctgagatggtgctagagtaactgagagttctacatcctgatcagtaggcagcagagagggcacactgggtctggcttgaacatttaaaaccttaaagcccaccacccagtgaattacttccctcaacaaggccacagctactcaaagaaggtcatgcctcctaatagttccactccttatgagcctatgggagccgttttcattcaaacactacatactgtaaagttgaagtttcttgaattcattatgtaatatatgcttaagttttatgcatattttattcattattatggctcttatttgttatattttattatttatttttgagacaggatctttgaccagtttggctaggctttctatccagcaaccccttatagacccacctgtctctgtctcttgggtttgtgaagtggatataaactcagctgcttatgtttgcagtgcaaggagctaagcagtcctgccagccctgtgtttgttttttagaagagatctcaacttcaactcctttcatagccaagaatgacaagagttgacagggtctcttgggaccagaagacggaaggcttcagggtcagttaaaaagagatacaaaaatgtttcccagctagatgtggacgagaatgtaatctcagcgcttgggaggggagacaggaagagccagtctaagtaagccttggccatatagcaagttccaggccatcctgtgctacttgatccagtctcaaacaacaacaacaataaaaaacaactgtcctttatctgttacatatctatagaaaaatagtgggaggccaagtttgcatttctgttgtccagagtatgactgtggtaactgttttctcttgcagtatgttaaaggatcttgatgactctgacaaagaaaagggcattcttagcacctcagaagagcttctgtcaaaaccagaggaaatgaccacacacaagtctgatgcaggaaccagtaaagactgtgatggtatgaaaacatacttcagttacttcaagttcacacacacacacacacacacacacacacacacacacacgcatctttcaagtcttctttacaattacagtgacgtttagatcattcaactccttcgttgtatatgtcctgatttgtgggggggggctggatggccattgcctgttaaatcactccttttcgtatctttaatgctgggattaaacccagggcctctgtgctctacagcttatctgtctacccagtcgtgcctcagttctttctgattcattcatattcattctctctcttttttcctcctttccaagtatctagtataaataagccaacttttatttattcagctcctggaaacacaggagctcttttctgttctctgagtatttctgtaggttgtgagactcttgacatactcttgagacactcataaaacacatccacactctcctgcagcgcgtgtgcctgtgtgtggatagtgtcatactctcctgcagcgcgtgtgcctgtgtgtggatagtgtcatactctcctgccgcgcgtttgcctgtgtgttctctgctgtttgttctccccaagtttattttttcattttgatctctgcttttcttactggaaatgtccctgaaaatcttcctcactcttctaagagccctacagtgcaaactgttgaatcctcttttcatccccttaaggtagttgctgttatctctcattggagataaagaaaaaagggaactaaggtacaggagaattaaataattaagtagctgcagaagtaaggctgcagcagagctgggatttgaaccagcagcctggaggctcttaaatttcattctggtaaccatggtactagcctgtttctccatctctaagtttccctattacattggctccaaggataaggatgtggtcagaggccttttgtgtcatgagagacttccctcttagctgacatcatataattatgaacctttcttcaagatatttctcttcttctctatggaattacaaaagaccaggacacaggactctagaaacagcaggtctgaggcaggaaaagtgaagggatgctgtgtcagctggtagtgcagccctgcagcagaagcctgactcctgctcccacgagtgggactgcactttaactgaccctccttggaccttactgagttttgggttttttagaataggggtctcacactgttgctgaagccgcttccaccttgtgagagctgggatcataggcaggcaatactgcacctctctcaggtgttcttgtagaaaacaaagaatacctgccttgctggatagttgttagatttcaagtgtactgtaggccttcagtaaacggcagctattattatatgccagtcaagtaatctttccaagaaggagcattaagatggctattgtgtttttatgaactctccctaattccataattgtttcctcttcttagagctacaaagcagcgttttgataacatgttctagaattttgccttgagtccacacgaagattactagtttgtagcttttggcaaccaccctttcttttcccttgaaaatcagaataatggttgtctgtcgtgtctttctcttaaggccttggtcaagggttttcctgttcgtctgagtgagatgtggcccgtcagcagggaaacttgagctccttgccattgtaggcactggtgtctttctgagcctgccttggctttatgtttcttcagacgactgtgcaccctccttcccagtctgagctccttacataggaaagcaacgtgccataggaactcagctgctcacagccatgccctccacacagctctcagcagacggtcgtacttcctggctctcctgcagaccgttgtcctcacagtttttgtatgcctgttttttcctcatgtcttcctcctgccccttaaacccatcagctgtttttctttttttcttttttgagacagggtttctttatgtagccctggctgtcttggagctccgtctgaagaccagactggcctagaactcagggatcacctgtctctgcctcccaggaactaagattaaaggcgtgtgccatgcccagcccccgatggctaattccatctgtagccatgtgctctcatttttcttctctgagcacttctgtcctttcttatttccttgcctccagagaatgctgtctccctggagcccatgtaaattgacttattttccctttgtattgtaaacccttgacgctgagtgggcactttcttggcttatgttgcttccagacctcatttgtttcctatccttcatctgaaacatcaactcctttgaaattacatctcttagttgtatgggttaataaagagaggggtggagaggccagtgaggtagcacactggtagagtgcttgcctggcatttcagggctctgggttccagcctacttgatgtttacttaccgagttacttatttataactgctttgtagcccagcagatacgcatacagcagcagcttattcatgtgatggagcacatctgtaagttagttgatactgttcctactgatgaactggaagctttgaattgtgggaccgaattgcttcaacaacgaaacataaggtatcttgattatcctcctggaacataattgattgcagttccactactccaagtaacaaaatgggcaaagtgtccaggttgtctggcctagacataaggatgatagtcacatcgctaaactttaaatttatcgaattttcaaaccattcatttcatttaagattcatattcacatttttgagacagaagagggggaatttctatagtttctgttggggttaaaaatgaaggtaaactttatggctgctatagcactgatcatatttattgtgctttctttcttcaggaggaagctcctagctgaagcaggttttaatggaaatgacgtcagacttctgggttctctgtggaggcacaggcctgattcacttgataacacagtgcagggcgactcctgccctgtggggcatcctaataaagagttaaattctccataccttctctcacattccccttccactgaggaatgtttacccaccaccactccaggaaagacaggattctcagccaccccgaagaatctctttgaaaggccgttattgaattcccatttacagaagtcctttgtaagtagcaactgggctgaaacaccaaggatggaaaacaggaacgaaagcactgacttcccaggggagtgttctcaccagcaccactgtgaaagctcagagtaaacaagctgcttcaggatggaacgtagagagacacggccaggcttcctatgatatcgataactttaatattgatgactttgatgatgatgatgatgatgatgatgactgggaaaacataatgcacaattttccagccagcaaatcttccacagccacctacccacccatcaagggaaggtgggccagttaaatctctctcagaaaggatttcttcagccaaggcaaagtttcttccagtggtatcaaccgctcaaaatacaaacctctcagagtcaattcagaattgctctggtaagtctaaagtaaattgaatgcttagatattataggaaaacaaaactgtccaaaatagaagttgtatagcatagcagcagtcattgcctgagcgctacattgtttccatgcaaatttctactgataatatgaattacaaatcacagtttcaaaagcacgttgctcttttgtctctgtagcagctgtaggtttataaatgtgtaattataacctattgtagtaaagctctaaagtcatcccaaatgcctttgcctttaaagtaacagcttttactccctaaaacaataaagttcaagggtgccaacattttactgatttggaggtaggcaaaataaaaaggtgaatttatatactcaagatatgtatatttttagaattctggctgttgtgaagtacttcatttataagtagaaaattgtcaaatgtctcacactattaaaatgtgaagaagcataaggttgtggaatcagaaattcaatacatattaagttagtcatggtggttcacatctgtaatcccagcatgtgggaggctgaggcaggaggatggattatagagtgagaccttgtctcaaaacaaacatttcctaactgctcagtaaaggctccatgagccatgtcctgaattgggcttgggaatttttcaaagaagcaatgctggagctcacagtttagtgaggagtgaactaagctactgcagaggcctcagaatgaagcctaaattaattttaaagccttacgtcagccctataaagttatctcaaagtggttttactgaaacaagaatacatgtgcaaagttttatgaagtacaaccctccctatttttgccattgatgacttaatagctctgagtttgttcttagagtgatgctgttgacctttaaaatagccactaatggatttattttggtatgttagaatgtgtcatacttgatgtctgcaattatctttgagacagttgagtgttggagtgagaggagctgccagagcggctgtgtgagagcctcttgttctctagaaccgacgctgccccagtaagaatgcaagcgggagagacgtgagagacagtgaaggaagcatctgagaagttcaggtgacactgaggtttcagactgcggtgactgtgacaccattcacagaaagggaagtcacaaggatgagtttgatttagaaagcagttgagaaaggctattttcagactgttgaacttaaacagttgggaaatcattcaaatagacgtgtctttagggtgtgtgtagagatggcttgtcagttaagagcactagctgttctgaggagcgggcttaggtttccagcactcccaactccagttctaggggagccaacactatctttttggcctcctcaggcaccaggcaaatatgtgatacatagatatacatgcaaacaaaaccctcatacccatagaataaaaataaaataaataaaaaaatatttataaaagaaagtgaggactggagagatgactcagcagttaagagcactgactcttccaaaggtcctgagttcaaatccccgcaaccacatggtggctcacaaccacctataataagatctgatgcgctcttctggagtgtctgaagacagctgtagtgtacttatatataataataaataaatatttaaaagaaaggaagaaggaaggagagagggagggaggaaggaaggaagaaagaaagggagagagagaaagaaaggaaggaagaaaggaaggaaaggaaagaaagagaaagaaagaaaagcaagcagtgtcttacaggcagttggatgtgtgggatggaaacttaggaggatgtcagacagccagtcattctctgtatacagatgatgtttaaaatcacaggactagaaaaattccaagtaagaatatatcaagaaaccagtccaaaatatttgaaagactgccaaagttgagagcagaagtggaactaagaaagggaattcaaaactggtagggtggctggtcacaactcactgtgtgctgctcactgctgtgtcctggtgatagggcactacagcccagcatggacaaaccctaggtttgctctgcagcacagcagaactaaaacaagtagaaagggtacagttatcttgaagaccaaaggagaaatggaaggaaggatgaacaaagtgtattgtaggtactacaaaacaggaaagacttgattagacccctaggaatgtctgagactaattggaaaggcagccatgtaaacagtttaaagtgtgccgttgggtcttcaggggaaaggtaaggctaaactatgtcactgtgttcatgtactgatgatttttaaacattgattgtgttgtagataagctggcccaaaatttatcatcaaaaaatccaaaacatgaacattttcaaagtcttaattttcctcatacaaaagaaatgatgaagattttccataagaaatttggcttgcataattttagaactaatcagctagaggcgatcaatgctgcgctgcttggtgaagactgctttatcctaatgcccactggtatgtatttttagataagacttggcaggagtccattggcagatgttaagtgaaagctttttaatagaaataaaaagaacacctcacattattcttactgtgtagggacccttcagaccccaaaaccacagtaagaaagtgtgttacctcagcctctgctctgattagtggcatggtaagcttcatagttgcttaaggttgttacctcaaagctcattggattgacctgatgtagaactttttcttgggaaattttttttttctaatctaaatagcctagaagggaacagaggatggctgtgagcgaccaaggccatttctgactggtgctttgttagtgctgccgggtggttctgatcttccactacagagtggagccctggagttccagtgtagctccgcccctttcgataagggtgtgcccacggacaagccacctctctctttgtggctacgttcaggacagtaaggagtagaatgcctacttctcagatgaggatcaaaggaaaaggatgcagcatggttcgttcttagcctaggctttgaggagactggggctgtgcgttgttataaaagcctgtaagctactcagtgatttcaaatcaaacacataaggacattatctgaagccttcagttccagcgctcgggaggcacaggcagtcagatctgtaagttcgaggccagcctggtctacagagtgagttccaggacagccagggctacatagagaaaccctgtctcaaaaaaacaaagaaggatgttagctaagcagttaggctaggaagcaggttcagttcttccatgtagattttctgtgtgttgtttctcctgttagagactttagcaagtcccagttggtgctgctgatattatcacatactattgactagacatctgaatttattcaaactgatttagatttttaaaaaattattatcacataattctatatgtgatggggtgtgagggagctgcatgcacaccaaggcatatatgtgaaggtcttgtcagacttgtgcagcaatcttttttttttttttttttaaagatttatttatttattatatgtaagtacactgtagctgtcttcagacactccagaaaagggcatcagatcttgttacagatggttgtgagccaccatgtggttgctgggatttgaactccggaccttcggaagagcagtcgggtgctcttacccactgagccatctcaccagcccttgtgcggcaatctttatccagcccctcaaactggtttatattggacagcgatatcttatccacatttcagactttattaacttagtgacactgtgcctccatttcaaccctagtttggtccttgaaagctctgaccttgggaaggactttggcagtcatctaatcagaggctttcaatggctcttcccagcttcaggagttattttcaagacctttccactctgatttcaacctcttgacagatataataaaaatattccaaataaagtttcccttggacagctctttagaccattgacctcatggatttttcaggataccagggcctaggcaggctaaatgtcatgtctgagttcatgcagctggcagagcaggtctctcttctcagcatcccactatttctttgacatgtctacatacatgccaaaatgaaacttattcactatgtggaaaaggaagagtgtagtatatattttaaaaataaattgaagtcctaaaaactacctagcccagcttttgccattagtagattggtgaaattgcaaattaactagaatataatcatgtagttattttaaaatatgttcttgggagctggaggcacagctcagtagtagagcacttgcccactgtgaacggagccctgggtttgagccccagcatggggcagggcaggcagggaaagggaatgcgtacatatgtagctttcccttttatttcaaaggaataattttgataataataataatggtagtcacagacttaggattttagagaccccttatattgctggaagcaaaagtttattcagatttctctggtagactttttaaacagttctgttgagagttcatttaattcattatggcagataggtagatagccctgtgggtaatactatttaatgccctgaaaattattttaaatattatattggttttctttgtaacttttaccttcacactcaaattcgaaactgacatgtttttcattatttgtctcttaggaggaggtaaaagtttgtgctaccagctccctgcctgtgtttctcctggggtcacaattgtcatttctcccttgagatcactaatagtagatcaagtccaaaagctgacttcctttgatgtaagttattacataaaactattaataaaaatgcaccttagaaacacatgccagtatgctaggaaatcttattaactattgtttaaattattaaaataattattctgggtatatagcttcatggcagagtgtttgcctaacatactgcaaaaaataaattaattaattaattaattaattaaataaagcatacagttaaattaagctgtagagttaagtacatgtgttaaaacattgtgattcaaatagccatctgtaattcaaagaatgtattttattaagaactcttagcctacattttcctgatgtgggttttggggtggtttgtttgttttactactataaagggatttctttttttggctagtgatcatcatagttctctttcctatgcacatgtgtgtgcctgtacacctgtctttttcctcattgctgagttgaggaattatgactgctgcactctataaggttaatcattgcaaagagttggctacagggttacgaatcataccatctcagtgtgacagctggtttgacttttcttctaaagaatgtcattgcagtgttgataaccattgcccagctgttcaccttgttctaaccaacagttaccatcacagcaatgagacctgtaaacgtagccaggccgaccattgtggtgcagacctttaagcctcagcactttcagaggcaaaaagaggttcctctctgtcagttagaagcaagcctggcatacaagcaaatttggggccagctccagttacacacacagacaacatggtcttttttacagatagaggagatgaaacatagaaaatggaacagtggagagccttttgtagtttttcttgacacagaagcatcttgccatagcacaggctagcttcagatttgccggatggcaaggctgccttgaattcctaaacctcctttctcatcctcctgccagctaggattcctcatatgtatgccaccacacctaagtgggaaagctattttgagttgcatttaatgttaatttttaaaaatatgtgtactagctagatgtgacacatgcctataattaccagtactttagaagctgagggtacaggagggtcacaagtttgagactcaaaagtgaaactcttgactcagaaaacaaaacttaaaaataaaaatggtgcattgattgttatggtgaggtatttgtttcttttggaaagtgtgatatatgacttataaaatatgaaacctaagcacgatcatatctgattaatgtataaataaaatgaaatttaaattattactcttaacttagattccagctacatatctgacaggggataagactgactcagaagctgcaaatatttacctccaattatccaaaaaagacccaatcatcaagcttttgtatgttactccagagaaggttcgtatttatctcactctcttcagtgtaatattgcaacgcactcaaatacatatatttgaagaatttggtgataatttttatatacattaatgaattcttgtataaccttcactccagaccacagatggtaaagtcttctctgcctcctgtgttgtttgttctttctccagtttgttgtgaaacacttaattgacagtgagttgcagatctgccattttacctctcctttacctcactctgcatttcctgactgtatagcactcccttaggaaccactgtaatttacccgtcaggaaatgtacagtgacacatactgttacttaagccattaacctttcagtaatgacctttgtaaaaaagggaaaaaaagaaaacccctatttcatctcctatctaaacagtttcattattttgacattttgaagcataagggccagttttggggactgtgcctcaatttgaatttgccttgtttcctgctgattaaatccctattcctcacgttggcagggatgccacagatgtgctgtgtgctatcagaagacagttggcagtgactcatcccattaccagtggtggtcactggccaatcactcgatcaaaatagcattgccaggctgctgctcgctgggcttaacgtttccttccccttccagctgcctagtgagcagttgctctgttgtaggaggtctcagactgtacagacaccgtggcagacatcagagcctccccacaagctttagcatcgttgatgatttgtttcttattattactatgatgagtgccaggttgagtttactgatacaatccatcctggctttatgaaagccttgcctgatgctgcgtatttatcagtgtgaacttgtgggttctttattagtttagtaaattataatcattttcactatgtattttgatgttctaattgcctatgttcaaccagtgaggacgcttcatcaacctgacttctgtgtcttatgtccctgttaagatatgcttgttattggcacatagctatctatatgtgtaatacatagagttcttccccaatagtatgcacataccaaacacacatctaaactcccgttatcaggctggcggttgctcatggggaatgtgcctaaggacctagaaccaaccaccttaactctgaattcacgcatatacatcattgtgtgcacagacccaccctacacatgcacaaacacaaaatgaatacatgtaaaaaaatgtaagtcctgtaaccagagtaaacatgtggtaactctcagagctactagcctgataagtaaagctgttggatgtggatgagggcattgaagtgtctggattgccctttgcttttctgctctcttcacagactgaggacagaatcactcgtgtgtgagtagttctaacagggagtgacgatattcattcagatgtgtttacatctctcgtgtatctctattctaggtctgtgcaagtaacaggctgatttctactctggagaatctgtatgagcggaagctcttggcacgttttgtcattgatgaagcgcattgtgtgagtcaggtaagtttctcttgggatatcagtgtgtttataccaccagtagtgctcagagccacagcactgaagaacaacccacagtggctgactgatcactctgctgcttcactggagaataaagtgcatcttatatatcgacccgagagatacaaataacctgaaagcaacattttttttccaattagtggggtcatgattttcgtcaagattacaaaaggatgaatatgcttcgccagaagtttccttctgttccagtgatggccctcacggccacagcgaaccccagggtccagaaggacatcctcactcagctgaagatcctcagacctcaggtgtaagtcggtgaaggttgtgggttccattttctgattctgtacattagcatcacctgtagggctttatcaagccaagtgtccagatgtgcccaaggacagctaaatcagaatatttgaaattggaagaattttttttttttttaattctcagtgcagtaaaatttgggaacaaaatctgggtttttttctttacttaataaaagaacaactctagagcactctagacggcagcacacataaaggcgcctgcagccagggctgaccgcctgaggtcagcccctggtatctttgagagagagagaactggcaccttctgcctgttgcccaagcaagccctgataaacaagcaaataaatagaaacaaaaggaaaatcatcccaccctctgctttagaagtgagataaatcaaattcggtcctgggtaaccctgttgtaatccttttaacagattacattttgcgtatcttactttggcttccacactccacgtgccttcatggaatgagcaggtaaccctgctttctcatcttaaagtctctagtccatgcacgatttgagagcagtctagaaccctcttagcacagcactttcacttgaatttcatctcagcacgtgcatcttgctacctccaaatccataactaattggtaacaaaggcactaaaaatatttgcctatatacatttaggtggtgctaggctgttgtacctccacctgagtttgtccatgctttctgtgttgttaatttgctcagcagatacttaacatgtttgtacagtgagtttttttctgaggttcagggagattgcctaagggagtaaaggctgaacagaatattgaggtgaatttgtataaatttaatgacttatttttattttatgtatatgagtgtttatctgggcaccacatgtgtccctgggacccacaaaagcccgaagacatcggatccctgttgatctgacttttatataccattaatgaccatacttgaatgcaagaattattgagttttcagaatttttttgtgtataatcacaaatttggaatggaatgttttaatttaatgccacttgtagtgaggaatatttatgtaaatttggggtgagagaatacattttgttctcatattatgtgcgctaatactatatttaagattaatgttatactttaggttctaataaatactgaatgctagaaatttgtttctagaaatgctatgcttcctataaaatgttgtatttcgattcttctatctgcacccctcatggtttttattgagatggggtacagagtcttagagtcttgctatgaagccccagttggcttgaacttagaatttagactaggctgtccttgaactcttggcaatctgcctgcctcatcttcccaaattgctgtgattacagataaatcccaccatgccggattctgtatattctctctgtctactgtgtgtgtgtgtgtgtgtgtgtgtgtgtgtgtgtgtgtgtgtgtgtgttcatgtaggtacttaggtttgtacctgcatgactttgaaagccagaaatcaacctgtcaacctcaggaattgttccttaggagacagccaaccttggttggtttttggaggcaggatttcattgttgtggatggagttcaccatgttgactaaactggctggccagaaagatccaggcatccacctgtttctacaatccagtgctgggattacacgtggtaagcaaatgctgtaccactgagctatctgtcagttagttatattaattggcaaaagcccaccgttaaaagaaattgtgtaaattcccttacatatgaatgatgtttttgaaaatataggacttatgttttatgtttgaatgaacagtgcacatatttatctagagacagacaccttgaatatcttttcctggaactgtgggaaagtgatgtttcagagaaagcaaaattatacatatccggatgctagctagcacatggcgccttgtgcatatctgatactcataagaatggataagtgaaacatatggaaggatttggtaaatgtgtataaaatgtaagtctgctgattctttaatatatttactatttctgctttagaaagttataaatcccttagtagaagtagattttaagaagcacttcctggtagtttcctgatctttttctgctagtagtcccttacttgaattaatctgccagctgttgctgtgttgtggtgttattggagtcaggtgctcgtagctttagagcggtggctccattctcctctcctagagctctatgataatattcctcctcttaagccggcaaagataaagtctacttgggaagtacaagagtgactaaaaacacaagatttcatgctgttcttttaggaccctagcagatgagctaggtgagcgcaaagagtcaagcacacaggtttaaccgttgtacagctccagaagagctaacacccctctctctcccccgtgtgcccgctgctgcgcctggcactttatattacatttattatattacattatattacatttattatattacattttatgcattcagcctcacaaaagccttaacatgatgtataatcctccatttcctcactctctagataaagaaactgagtcacagcacacatgatggcaaatgcctgagatcccagcacttggtttttacttgtgtttctgagacagggtcttactgtgtagccctgtttagcctggagttcactgtatagactggatcgtcctctacctcagagagctccactgttcctgcctcctgggcactgagataaaggcatttgctaccacacccaacattgcaaaggcaggaaggtcagatgttcaaggccatccctactgcaagcaagttagaaagcagcccgcagtgtagtagtagtagtagtagtagtgttgtgttcgggagacatggctcactggttaagagcactggccacccctccagaggatctgggtgtgattgccagcactcacatggtagctaacaagcatctgtaactctagttttaagagatctaatgccctctggctttagaggacactatatgtgtatggtgcatagctatatatgtaggtaaaacacacacttacacataaaaatataaaaataaaatttaaaagactgacaagatggctcagtgggtaaaggtgccatcaaccctgataatctggtctcagtacccaagaccctcatggtggagtgagccagctccctcaggctgtcctcggatctctccatgcctgccatagcacaccagtccatgcttatgcacaatatccagtaagtacataaggataatttaaattttttttttaaaaggtaaaagaaatagtcacagaaaattaagtagcttgcaaagttcataaccctagcaaatataggagtgagggttttgagcccagcaatctggttgcagaaccttaaatactgctctgaaatgcaaaacagaagtcaccactaaagataattgcagactaggatggccagaaagtcagcatcctaacagagtgtagcagctaacagcatggagaggtcaggtgattttaaaaggacgcagagctcataggaggagcagcttggtagacagtttctgtggctaggctgggatttgcctttcataccacaaaactcccctattgagattgcaggattcagtgcagtgtttggtttttcatggagttatacaatcatcaccgctgtctttttaggacatcttgtctctcttgagggatctgttctccgtaccagctaatctcttttcccctctgctccagacaactattcattgactttctggcttcacagatttttgctattctggacatttcacatacaggttaattatccccagtgtttgcaaccagaagtgttttagatttgaggttcttctagattttggaatgttttcataaacataatgagttttttagggatttgacttagggctaattaaacatgaaattcgtttgtttcatatatacctcatacatacggttggaaggtatttttaacttttttgtttcatttatttaaaatatttcggggggggggagggtggctcagcagtaaagagcactgactattcttccagaggtcctaagttcaattcccagcaaccacttggtgactcacaaccatctgtaatgggatctgatgccctcttcgggtgtgtctgaagagagtgacagtgtactcacatatatacaataaatctttttaaaattattatcactatgtgtttatttaagagcatgaatgttctgtgtgtggaagccagaaagtagaaagtggaggtagaaaatggttttctgctttgtaagtccctgggattgacttcaggttgtcaggctgagtgcaaacacctgtggctgcagatgcatctggtagctttcacttactcattttgagactgttactgtatagcccaggttggcctagagctcactaggtagcctagtctttactcagatttcctggcatgcagaatactaggagttcagacatccaccatcccacccagctcaggaaggcagttttattttatttttatcttctttttcttgttttatttcgtttttgagctgggtctcatgcatgtcagactcatgtcagcctcacattctgagtagcagatgatgaccttaaactcctgctcctgtttttacctccccagttctgagatcagagacaagtcatcctatcctcctggtgtggggatcctgcccagggctttgtgcattttgggcaggcactacaccatctgagctccagctcctttccaggaggtaaattcaaacagggtttttgaatgtctgtgctcttactgccacatgtctgtcaggcaaggtcaggtgtggatttcctagtcacgtgaataatatgcttttctcccatgatccagatctttagatttatcactccggtacccaacagcaacacaaaatgtcttttgtaaacagaaatatttaaaaaaatttttttagatttgtttattttatatgtatgagtgttttgtctatgtgtatatatctgtgctgtgttcgtgcctcgtatctgtggaagtcagaagtgggcatcagatccccaggtgctggagttacagatgattgtaagccaccgtaccatgtaagtgctgggacagaaactgggaccactacaagaacttttaactgctgagccacctctttagccccctgaaacaacatcattttaaaactattatgtatccctttaatgtttatgcagtagaacataaatactataaatatattttatgctcactacatgaaattcacaaattacattgtaaaagtataatttggagctggagaggtggctcagtggttacaagtgcttgctgcttttctaaagaaccctagtttatttcctaatacccactttgggaagttcacagctgcatctatccagctctcggtctcatggtactttctgaccttgatgtgcccacacacaaataaataaataaatacattttaaaatgtttatcacttaggctgcaaatatttcagtatctggtgtgagcctagaatacatttaaatcctggctaagttttctggcactgaaaaaaaaatggagggagaagaaaagtgttttaagtcttacaaaatttatatacagagaatttttatttattttgagagggggtttctccttgtagccctggctatctggacctcacttatatagaccaggctggcttcaacctctcgaagatccacctgcctctgcctcctgagtgctgggattaaaggcgtgtgccaccatacacagccatgaattttatagatttttatatgtgaaatattttgcttattattatatttacctataagtaaatggtgtaaacaaataaaagttggtttttaaatctcctataccaaaattttggtccagattgaattactaaaattattagttaggggctagggagacactcaaaggcacttgctaccaagcctaatgacctgagtttgatccccagagccaaaatgttggaggaagagaactgactcccacaagttgtcctctgacctctacacatgcactgtggcatgctgcattaatgcacgcgcacacacacacacacacacacacatgcacacgtaagtagatgttcaaaataagtaaattaaatcattagtcatcattactgtaggagtttcatacatgtctatgttactttctttaaagtgcatgcttcctttagtatagctaaacagagtcttactttatgtatgtgagtacactgtagctgtcttcagacacatcaggagagggcatcagatcccattacagagggttgtgagccaccatgtggttgctggaaattgaactcaggacctggaagagcaagcagtgctctttacctctgagccatctctccagccccaaacagagtcttactatggtaccaagactagtctcgagtgcatgggctcaagctgtcttcccacctcagcttctccataactgagcttcaggaacacaccaccacatacatcttaaagacgtttcaaaggtaattttaggcacaagctttttactgaggtatctgtttacgagataagaatttttgctttgctctgtgatatcggtggcacaggcctagaatcccagcactcaggaagcaggtggagatcagtctgatctacagactaagttccaggatagccagagctacacagaaaaactctgtcttgaaaaacaaaccaaaaataatttttgtttacagttcatatatctacagatgaattgactcagtccatacattttacttttatggatgtaagcctgagaaatgttactgacataatcatgtagatggtaataagaaactttttattacagcagtaacactcaattatttgaattctttatgaagcatatgccaaaattacatcatgatctgtcatcaaaaattatttttaatgatctgtcaactgacatctcagttaggtactctaaattttgtgggaggtaaaaaattggaaagtatttgactaacaaatctgactaacgaacaatattactatttagtcgtttttctgaaccatatgctgttaaaaatttttactaggtttatccaataaatatgaagtattcttttttacttttgcaagaggaacctctacagtgtacctggtacatttgaaatatcctgacaatacattgtttaccttcctaaaagcaattgcttttatacaggttcttgctatgtgctctggctttcctggaccccactatgtataccaggctagccttgaatttagagggctccacctgctctttctcctgagcttgtgtcttcctgagcaccaacacacctgccttggtttgttgctgttgttgttgttgttgttgttgttgttgttgcttgaggcttgtagcctagggtagcctcaaattcgatatataactaaggctgcctttgagctcctgattcccctgtctctgtttccctcgtacttggaattacaggcatgtatcaatgtggcctggtaaattttccatttaaaggcaacatttaatactcctatatttagctgggtggtggtggtgcacgcctttaattccagcacttgggaggcagaggcaggtggatttctgagttcgaggccagcctggtctacaaagtgagctccaggacagccagagctataaagagaaaccctgtctcgaaaaacaaaaataaaaaaaatactcctatatttagttagaagccagtgaaatctaatttgggttgtttgtttttttgtttgtttgttttaagtacttgttgagataattcgtgtaccttaaaactcagctattcataaggtacagttgggtgtggtttttacattttatcagaacttcctccctgttttcctcttggttccttcactaagcatgtttgcaagagtcatctaggttatattataatatgtgtgtgcatatgtgtctatctgtctgtctttctgtctgtgatggtttgatgggtatcatggtctaaccagtgctaagtaaggactttaccactgagctggacgcacaacctttattctccatttttatggttgaataatattcatttgtatagctgtcccaaattatcttttcttcccttcttcttcctcctctcccttctcctcctcctccttcctcctcttcttcttcctcttcctccccttctcttccttctcctcctcctcctcttcttcctccatttcttcctcctcctcttcctccccttctgctcctcccccttctcttcctcctcctcctcctccttcttccttttttggtaggcactgtgtcttgcttggtatctggtgatccctaacaccctgttttccaacaggcattggaggacgtgttaaaagcagtaaactctggtggtctgtctactttcccaccataacaaactgtgaatgttgctccattagtgcctcagatcttctgtggtagaatgagttctttgttttagttttaattggatttgtgatctgcaagtttctgttcaaagctcatattttattctttttagtaaaggtttatttgaccaaattaaatcgtaaatagttctattttcccaattaagtcacaaatcaaacaaatttcagattatgttccagatgtttttaatatgagctttgctgaatacatccacatcatccaactcacagtgttaacatgtgacacagtagtttacagtgttagacgtcgcacaccatcaccatagtctgagaacttagccaccctctaaaactttacctgttctcgctggtgtccttcccctttcctctcctcagcccaccagacaattttctgtgcataagtttgcccacactgggtgtctcatataaacattcattctatgtgtgtatgactccttcttatctcgtgtgtgtgtgtgtgtgtgtgtgtgtgtgtgtgtctactctagggcaagcacgtggaagtcagaaaacaactggatctacatgtggatcctgggaccaaatttaggtcattattagacttggcagcaaatgcttttacccactaagccatctcactgttctccttactacttggtagcaaaatattttcaagatttaatgctggaaaaaaatattccattgtgtagttttagttccttctttaactatcacctactattacgatcatttccattttgttggctgttacaaagaatgctcttataggtatttccatttctctttggtgtattgctagcagttggatcatcaggtcatgtgatagctcttcttcaccttaaaaaggttcatttatttttacttatacttatggggtgtttgtgtgccagcctgtttgtatgtgaagcacatgcattccggtgcttgtgaagtgagaagagggagttgcaggcagatgtaagctgtctgttgtaggatttttgctggagcttacatactcttaaccagccctgcttcaccctttaaagaattatcaggctgtcttccaaagagtctgcactgttttatgttcctagaatctatctgtgagggttatgactccctcaaatatatcccagtgtttgtttttgatctaaagcatttgtcattttaaatgaataaactctttaaaattaacatgtagttgacaagaagggtgaccctttagatcacaattaatctggactcccaaggtctctcaaacattggaccaccaaacagacagcatacaccagctgatatgaggcccccaacaaatatagagtagaggactgctgggtcagtgttcactcagagatgatgcatctaaccctcaagagactggaggccccagggagtttagaggttaggtggggtggagggtggggaggaagggatgggatgtggaacagtcaagggggggaataaaaaataggagtgtaaaaaattaaattaattaattaatttttaaaaaatgaaaaaaattaacatgtagtttaaagtgggaagtgggtaggcataaagccattcctacacacagtccttacagcattcctatcagcaggaagctcacagaattctgcagatttcttcatcatttatattgctaagcagttgttttagatagggtctcactagttaaccttgtctagctctgaaatccatatcttcttatctggtgggaaatgatattaaataatagtatcacaagaatcagagtcctgcatcctgtggcagtttcatctgaagtcagaacccccaaggctggaattctctgttcccagcaacactctttactgttaacaaaaataggtaaaacgactaaacacaggtagtcctgccaagggtttctggtgctgtgattgaagaaaattcacttatacccatgctataatttactttgttttgtttgctatcctggaacagtctgtggtgataacattcagaagggtggaaggtaagatttcattgtttatattagaaaggacaaggaggcatatgaagaggaaaatgcgaaaggcctgacctgcacatatgccatgagtgccccccattaataaagaaataattttaagctataggaaagaaagcgtaacagcagatatttggtagggtagtggcagaaacagaagagagtggtgaggagtaaaatgggatgtgtgactagttggtgtgagagcagagctggatgttctgagaagcctaccacagagggaaagagggaaaggagagaatatggcgccaggagaagccactaaagtgcctatggattgtagttctgtaagatcctgacacagaaggaaggaattcacagaagagtctataaggaaggcagaaggccatatagagaatgaactaaggaaacatgaagaattaatgggtgccaagagcagtcacccagaggagaaggacgcttgtgtcagagtcaccgcattccctttgcagcccagagcaaaagtacaggacccatgatctctccttttatttatttctgccatgtgtgtactgcccccttatctttttaaatatttaagttacatttatttattgtataattttctttaattgtttaaatcttttagccatgtttgtttttgtttgtgtttttgagacagagtctaactatattgccatttcttctgtgtgtgtgtgtgtgtgtgtgtttgtgtgtatgtgtgatatgctggtgtgtgcttatgccaggcgtaaacatctggtgtctttctctctcagttataattgagacagggtgtcttgaacttggagcttacccgttaggctagactatatgctaatcacctggctggccagatgagtccctaagatcctcatgtgttcacctgccgtgtcactggagcatgttgctgtacagagctcttggcatgggtggtagggatccaaattcaggccctcctgattatacagcaagcattttacccaccaagcgcccacctctgcttcttgtccacatcgcctctaagaccgtgctcttgcctggcctcgttgttttgttttaaacctacagtccagatctctgtcatctagtctgtagacattcctcttcatcaccgttggtttgtttgtttgtttgtttttgtttgtttgtttgtttgtttgtttgtttgggtttggggaggtcagtgttgggttttttttccagacagggtttctctgtgtagccctggctgtcctggaacttactctatagaccaagctggccttgaactcagagattctcctgcctctgcctcccaagtgctggatcaaaggcgtgcgccaccaccacctggcccatcaccgtttttttaaatctttaattcttaatgtaatgtccatttcagtatttcaatatgtcatctgccagggataatggtcaacataagacagcttattaatgaagtttgcatggtggaaaaaaaatcagtatttaatatttgaagatgctaccttcacttgagctgctgtaacagtatcatagactggatgactcaggcaaaagtttatttcttgtggccctggattctgaaaaaaaaaaaaaaaaaagatcaaaattccaattcatcctttgtctggtggggttcctctccctgttttatacttggtggtattcacattggagccatatgtactagggagggaagggtcagtgaggtctctgtttggatagttttatttttgatttttgatttttttctttaatattatttaattatgtctttgtatgcatacatccttgtatatgtgtgggtacccgtgaaggccagaagagaatgttgacttttttggagctagggttacaggtatctctgagatgtctaatgtgggtgttggatttcaattgccagtcctctgatagagcagtaacagccgactgtctctccagctcctccgtttttataaggaccctgacctccttagtgactctacctccccacctagttaccccccccccccgggccccacctcctaatgccatatcattggggcaagcattttgggtgaaaacattcagttgatgataatggatacaactgtattttctcatagtaattaaattttgtgtttggatcttcttttaggtttagcatgagctttaacagacacaatctgaagtactatgtattacccaagaagcccaaaaaagtagcatttgattgcctagagtggatcagaaagcatcacccttgtgagtacagttgtgtaattaattatgtttaaaagtaatagattttaaaagtcttttctgtattcactgtactacaatagaatatgtgaaattgcatgttaacattttctttttgcattatgatagtaccaacttgctaattgtagggaatattataattttgaaatctcattttgttagataacaataaatcctagcaaatatattaagtatacctcctacacgcttacattctcattcttggtgtcggtgtctttttctctggtgtatctcagtgtacgaataacacagccctgctttagtgacttctcccaagtgtgtttgcctttgccttatggtagctaaaatgagtctctgacattcgtaactgctttcatgtgacccatcttcaacgtcttcattgttttctcatggcttttgtaaatgtagaaagcaccttttaatagctataatatacttatttcatagttctttatcttaattatcctcgtatgtttgctattgagctccttttgtaccaaaacttgtactactccttgtaccattttatttcttaggttttttttcttggaaggaaactgagtcagagggtttttaccaggctcttgataatttttgccatatgtttctacaacattttttatcaaggtagctccccgttgttgaatcagcgtgagacagcccaggattcagtcctgggcaccctcacaagaacaggattacaaatccagtcttattttctgtgttcacaaattccttgcttgagctgttgtgtgatcatcctgtatcataaggatgctgtaaaggtctctttagggaccgtgtatctctaggaacatgtggaaatgtgttaatatttaagtgaaaaggcatgattcctcactactactctttgggcttcttggcagatgactcggggataatttactgcctctccaggagggaatgtgacacaatggctgacactttacagagagaaggcctggctgccctggcttaccatgcgggcctcagtgactctgccagagatgaggtgcagcacaagtggatcaaccaggacaactgccaggtgacgctcgcagaagtttgcagacctttcatgttatcagcagtctcgctgtatataatacaggctttgtttgaaatagggtcttgctatgtaattgaaaccagggctaccctcctgcttccacttcttacctggctttgctgnnnnnnnnnnnnnnnnnnnnggagggagagggaaactgggtggtggtggtgcacgcctttaatcccagcactcgggaggcagggcaaggcggctttttgagttcgaggccagccaggactacacagagaaaccatgtctcaaaaaaaaaacaaaaagaaaaagaaaaactaaaaaaaaaaaaaaaaaaaaagagggagagggaaaatgtgtgcacaccagggactatggcatgcacatgcatgtgttgtcaaaggacaacttgcaagagactgttttttcctcccaccatgtgggtctcaggtatgaaatgtatgtctcaggcttggcagctctctgagcttgttttatctgaatggtcataaacatccaagtaagctggtagtgaatccatgaggcagcgaataacttgagcatgttactcattcttaaggagacgacaggtgaagggagggctaaaatgttatttttagtaacagggaatggggattattatcctaagagtaataattgcatccaaggaagacttcagcagaatagtagacacagatgaaatagtcaaatgtattctacattaattcatgagatacctgtgccaaacacagaacagtcttcagaatcagaagggggaagactggacctgaaaagtgtcccagccattcattgtcattgtgttgaaaataacaaaggcagaaccccgtgtggtggccaattcctgcagtccccacactcaggtggctaagacaggaagttttcaagagttccaggccagcctaggctatcatgcgagactctacattaaaagaaaaaaaaggggctggagagatggttcaatggttaagagcactgactgctcttcctaaggtcctgagttcaaatcctagcaaccacatggtggctcacaaccatccgtaatgagatctgtcgtcctcttctggtacatctgaagacagctacagtgtacttagatataatagtaaataaatctttttttaaaaaaaagaaatctgtccttttacttcagttaaaataaaccaaaaaaactactttatttgattttttttttctttttttttttttggtttttttggttttttgttttttcgagacagggtttctctgtgtagccctggctgtcctcgaactcactttgtagaccagactacaaccgcctccctctgccttctgagtgctgggattaaaggcacgcgccaccacgtccagctgtaaggacagatttcaatttgtatatttaatcaaaattccaatatttttctttgaagaacttttataaaatttttctagatgaatattcaagtgaagttatgagtttggcaataaaatcaataacatgactgggtggaggtggtggtgacatgcacctctaatccaagcactttggaggcagaggcaggcagatctctgagttcaaggccagtctggtctacagaatgagttccaggacagccagggttttgaaaaacaaaacaaaaataatagcatgagtactgtttgcagtttattacatgtaaaaacaataaatgataaagtttaatatttatgagaaatggagtttgaaatgtagcttgtgcataggaccctgggttcagtcctcatcaccacctagaactgtacacgccactgtacaaccataacctcctcatcacccctaaagctgtacacgccactatatacaagccactgtacgaccgtaacctccatgctcatcgtcctcagctacatgctggctttgaggctagcctggcctgcatgagacccaatctccggggtgggggtgggggtggggggatgaaggggttgcttaatggttaaaaacatacactgctcttctaaaggacccaagtttggttcccagcacccacataggtactcacagccactgtaactgcagcacgaggagatcttataccggagttccagcatactgtgggcacacgtttgcaacacatgcacacaacatgcatttgtctgtctgactgtctgtctgtctgtctgtttgtttgttttgaaacagggtctttctatgtagtcttgactcctagaacttgccatgtagaccagcctagtctggaactcacagagatctgccttcttggcctctcaagttctgggattcaaggcatgtgccaccattgtaatttttagaggtaaaaagttactcaatcatggcattggttacctaatttaaaaagtcatattatgggctggtgagatggtttagtggttaagagcactgattgctcttctggaggttcaaatcccagcaaccacatggtggctcacaaccatccttaatgagaaacaaaaaaatcctatgagccagagcaagtgggaaggggggaaaagggggaaaaatattttacattctattttggttggttttgttagttttttgagtcagggtctcactgtgtagccatggctgtcccagaactcactctgtagaccaggctggcctcaaactcagaaatccatctgcctctgcctcctgagtgctgggattaaaggtctacaccaccactgccaaactcaatttagattcttataccaaaataaaatatacaggactggagagatggctcagtgggtaaaggagcttattccctaaagtaaccaactgagctggaccaaggacccacatggtggagggacggcatcaattcccacaagttacacttggacctcatacatgtagtgtgtgtggtacatgcacatatatgcacacacacacacacacacacacacatatacactaaataggtgtggtaaaatagagctaggtacaatatagagctaggtctagtggtatatgattataagccaggaaacgtgccatgagttccagaccagcctgatgtgtagtaaatacctgaccaatcaagggcctggaaatatgtttccatggttaaactactcactgttcaagcataaagattggagttcagatctctagaaccttatcaatggcccacctctaattatagagctggaaggtggacctgggctcacaggacaagaggtctaatcagattaactctatggatatattctgggaccctgcctcagcaaagaaggtaaagactgacaacaaagactgtacacgcacagagagggagaaaataacagccatgcatgggtgtgcatgcccatagcagcactgggagtagagacaggtagattcccagagttcactggccatccagcctagccagcttcctgatgagcaaaagacagtgtctcaagccaggaaatcaaagagtagtagaaaaagccccattgttcttctctggtctctgtatgcacaaacatgggcacccagacctacatactcacgtgcaggcactacacatgtatagcacacagggacatagacatgtgcactcatgggcatgcaccacatacatacaatacacacaatacaacgtcatctgcatacacacaatacattttattttaaatagaggttaagtgaaaagtactgattgtgattgatgttttattatttatacactcttgagcagtggaaaaactaagcttaaaaaaatacccaaaaagaaaagaattgctgacaatgtctcagaagctaagcatgtgcacatgggtaaatagatggtgaacagcagcccagattgtatcttcagcatacaaaatgggccatatgagactttttttggagatatatatatacacacacacacacacacacacacacacacacacacacgtatacatatatacacatacatatatatatatgtatgaactaggtgtagtaggcacatcttttaatctctgctcttctgtgagtttaagggccgtctggtctgcatagcaagttctaggacagccaggactacagagatagagaccctgtctcaataaaacaatttaaagtaaattaaaaaaagcaacacagaaataaagatgttagaattcacgaaatccgttttcctctagttatttaagtgttgataagtgagcatggtagcttgtgcctgtggtcccctcacttgggaagctgaggccagacgctcgtgagtttgaaaccaaactgggccgtatgagagcctgtgataaatacaaacaaaaggaagaactttcagaaatgattgggatagcctgtaccatgtgcctcacagccatgaacttacttaagtaacactggggctgagcttgcctgtgtgactctagagctactgtgggccagcatctctcttttccgcagcctttgccagctctctagcattagtctgcagtgcgctttcttttacatggaatactccccccccccttttttttcaatttaatacattggtgctttgactatacacataactatgtgaggatgtcagattgcttggaacaggagttagagagttgtaagctggcatgtgggtgctggaactgaacctatgtcctctgggagagcagcctgtgctcttaactgccaagctgtctctgcagcaagccagtcagtgcctcctgtgctgatggtatgctgatctgctgaccctgggtctcttttactcctagtggcaaaattgtgtcatttaatgtgactgaccactagatatttctttcatctttgtaatgctatttttgcaatagcaagttatgttttaagtgcttaaaaagtcaactttatttgtataatgtaattttgcctgaatatacagtattttggccttgatcaaattaagtcctagattttcaactgaaatactcttattttttttttattgtgtatttggggatgggggaaatctgcatgtgaatgcaggtgccctcagtctgaagacatgttggattttcccccaggactagagttacaggcagttgtagagctgcttacaaagcccagctcattttgtttttaatcttacatatgtgttttcgggtacccacagaagcaggaagaggtcattgcgtcacctggagtttataggcaattgtgagctgctcaccttggttctggaaactttgcttgggttctctacaagagcagtttaccctcttaacaactgctccatctcttcaggccttaaaatagatactcttgaaacaaatttgtcaagctcctaaagattgactgttgcctagctcccaccgaatgattctaattcatatggaccgagaagaacagtccttggcctttctgtttgttctgttttgttctttttttttttttttttttagatttatttatttatttatttatttatttacttatttaatgtaagtacactgtagctgtcttcagatactccagaagagggcatcagatttcattacggatggttgtgagccaccatgtggttgctgggatttgaactcgggaccttcggaagagcagtcggcactcttaaccactgagccatctcaccagcccctctgttttgttcttatggtttttgtcattttgttttctttctgtataagcaactcaggcttatctacagttaaaattgcataagtttttactttgaaatcagtggttgaataacatgagttagcatacgatcactcggttgcatcttgaagattgatggtaaatactagagcagataatatcgttgtttctgagcctgggaagaaccagcagcaattaccttagggctagagaccaccctggagcccaggctattgcttacgcaccttaacatgaatgccatggctctgtaaacaaccccaccacacatgcctgtcagggacaatcagcacagaaaggtctgcttgcagttgatgcagaatccttctgatggcgataccaagtccacagaaagatcctgccaccctgagcaggatcctctacctccttggatctgaatagaatcataggttaccaatatgaaaatctcaccttggtcatgctaagtactgttgtacacagttcttttaaattgttagttaatgcattatgagtctaataggcttctattttcatatcaggttatctgtgcgacaattgcgtttggaatgggaattgacaaacctgacgtgcgatttgtgattcatgcatctcttcctaaatctatggagggttattatcaagaatccggccgagctggaagagatggggaaatatctcactgcgtgcttttctatacatatcatgatgtgaccagactgaagagacttataatgagtaagccacataccacatcctgtctgtcatggtccatctcatgagtacagtctgcccctgctgttgtagtacttgggtcctattctcattagtcatagaaaaatgaaggcatttaatatatattgtaaagtttatttaggtttattataaagatatacattcttgtttagtgaagtcatgtgatgctgacatgtacaaagtgtgttccagactaggcaggctaaccctccagatcgtgggttcctctatacccttccagacccagtcttacgcacccttacatattacaccccttccagggaaataatgaactcttgaagaactataagaaccatccaggttagtggagagttggggagagccaggaatagaggtgtatgactgagtctcgcttgcttgaacctaggaattgaactgaatgaggctggcccaggcaacaaaatgaaaccctgtctcagaaaaaatgagaggatagtgagaaccagtcttagaggaaggaggaaaggaaaaaggacaggacgggcaataaagccaaattcccctgtgaatccatcttctactttacccttttccattagaggcaggcagcaccttgtgttcagtgttcgcctttcccaagtgcaagtgtcttagaatgtaaatgggtggtctgtgagatgtctcagtggttagatgcttgtcaccaagcctgataacctgagctcagtacccccaagagatgttttctgtccacacatatatgagctagcatatgtacatacatgcatatattggtgtgcatttgtgcacataagtaaaatgtaaatgtaattatgttatagaatcctaagctttttactgacttcacggtcatcaccgtgtgtcatcacagccttgtacagatgcctttcagcgtgggtatacttaaatatgtcaccttaatgtcaactggcttaggaggctgattttatcatgtgtgctctcttcctttttttttttttttttttttttttggtttttcgagacagggtttctctttatagccctggctgtcctggaactcactttgtagaccaggctggcctcgaactcagaaatccgcctgcctctacctccccagtgctgggattaaaggcgtgcgccaccacgcccggtgcgtgtgctcccttaaatatgttttgtaatcctatgtttttgagactctggtctcctttatgctggcacaggtactgatcatgggaaatggcactagccacagtaactcctgtgaaaaagtgagctacaaagagattttgtaacttgccctagggaacgtgaaggaccatttatgggaggaacagcctgatgcactggcatcattggtgcagtgtgggtcatcctcacttcccatgttagggcagttttttcagttgggttggttgttttgtttttgttttttaaaacaaggttgctagtttcttattgttgtttgttgggctttttgtttgtttagttggttttcttttgagatacagtctcacttggtatagcccaggttggccttgaacttgtgatcccctgcctcagtcttaagtgctggtactgcagcagtgaaccaccaagccacctcttgctgtcttaaatgctttactacctgtcagctcattttatctttaccacagttctaaatgatgagacaattgcttaccttattgtcaaggagaggatgagctggagaagtggtgaggcgcaggtccctaatctccaagttcatctaactgtaaagcctgagcgtgatctttactgcaccaaggatactcagcacaaagcaatgagttgttcatatgtggatggctggtttgtgttcttaaacagaacctggacaagcagccttccatgtatggtgccttgattgatttcagctttatgatagcttaatttgttcaattaagccatactttaaattttaaatttggtagggggaggcttgggaggaaggctctaattttttttttttaacatttatttatttatttatttaatgtacttgagtgccctgttgcttacttcagacacaccagaagagggcgtcagatcccattacagatggttgtgagccaccatgtggttgctgggaattgaactcatagcctctggaagagcagctagtggtcttaaccgctgagccatctcttcaaccccatctaaaatttattttatatgtatatgtaaatgcccgaatgtacatgtcaaccacatgtgtgcctggtgcctgtgaaaactagaagagggcatcagattccttgatagctgaatatggtctgccatgtgggccctgagaaccaaacctatatcctctacatgaacagcaagtgctttcaaccactgagctatctctccacccctatacttttatgagctagtgaaatacagtttgattttatcttgtgatgtgtggtgctggcagcctcaacttgcagtcagccgtacaatcgccagggtcagtgaccagcagtttacacctgctatgttacccagcatcttcagggacattaagtgcatgacccatgtatattttcaactcaaaacaggcttgtcaaaaatatggtcttttgccaggcagtgttggctcatgcctttaatcccagcacttgggaggcagaggcaggcgaacttctgagttccaggacagcctggtctacaaagtgagttccaggacagccagggctacacagagaaaccctgtttcaaaaaaccaaaaataaataaataaataatggtctttcataactcttaaaaaaatttgtgttattaagtctaagtattcaaatcacgataacctagcaaccatttgaaaaaataatactcagaaaatggaagtacaatagtaatttgattctttaataataatgattgcctattaatggaaagtatacaccagtggtttttattgcattttaatttatttcctgtgtgtacatgcacaggtgcatgccacagtgcatgtgtcgtggtcagagaacaacttacgtgagttggttctcgccttttaccgtataggttccaagaattaagcccaggtcatcgggcatagcagaaagcacctaccctgctcagcgcctcaccagcctcatttcttgatcttaaacttcggactcaaatagcttatgtgcactcctagcttctgttttgtgtaagcaaatgtgggggttggtagggatcaaaccagggccttgcatgtacatgctaggcaagctttgttccactgaacgacatccccaggccttggggcttttgttgggtggttgtggtagttgtttgagactagctctcaattattaagccctggctggcctagaacgcactgtgtagaccagggcctggccttaaactttcagaaatatacctgcctctgctgcctcagtgctggaattaaaggtgtgtgccaccatgcctggccagtcctgtctgtttgtttgtttgtctgttttgagacagggttctcactatgtaacccaagcttttatcagactcatgatcctcttgcctcattactgggctgggattacagacatgtaccaccagccttgtcatatttgctttacgggactacaccacagcaactttaaagttctaacttcacaagcctgtgactccaacacaaatatattatatttaatatcatgaactacctcaaatgaccagtttggacaatgtgcaacagatgagggcattgctatttcccttaaatctaggacaccctgtctctgagttcccccagaaatcccctggattcttgaccacagtttcagaagtcctagtgcactaggacttcaactatggattctgcctgcttcctctagatatccagctcagcacatctgcttagagagagagaattaactccatcattgggggtaataaaaacgtaaagaaattttcaattaaaaaaaaaataaacattttaggatgaaatagcttatgaaaatcccaatattttggagcctggggcaggaggatttcacaatttcaaggccatcttgtgagactttacctggaagaaaaagaagatgaagaggaggtggaagtacaacattcctataaaattaaacccacgagaggcgaacctgaacatctcgtaacttgcagcataaagatgtcattggcactgcattgctaacagcaatgttcttatttatgaatttactttaaatactggtttcatattcttttggttttctactataaaatttaattttgttctgctcttcatcttttttagtggaaaaagatggaaactatcatacgaaggaaactcacgtcaataatctatatagcatggtacattactgtgaaaacataacggaatgcagaagaatacagcttttagcttactttggtgaaaaaggattcaaccctgatttttgtaagaaatacccagatgtttcttgtgacaattgctgtaaaacaaaggtaattacttaagtggtgatgcaggcctttaatcccagcacttagaaggcagaggaaggtggatctctgagattaaggccagcctggtctacacagtgagttccaagacagccaaggctacattatgaaacccaatctcaaaaaaaaaaaagtaaaatagtaaaataataaataaaggtaggccggcatagtggtgcatgtttgcaacccagtgcttagggggcaggagcaagaaggtcagaaattcaccatggtcttttactctatggtgtgtttcaggccaacctggactacatgaaaccttaattcaaaaagtaacaaaaaataaaaaagtaaaaatccaacatgggcaagcatggtattttaaacttaactatagtctatatttagagatctcagtctcagaacagtagtaatagtagtagtctttttgaaaatcacttgtttaactgtaaaagcagtgagaacaccatgatgatgtcatgccagcagtccagagactgagacaggaggatagagaatgtaaggccaacccgggaccacaaagtgagatcatgtctcaaaataacaacaacatggtgtctggataagcttaatattgtcaggcctaaaataaccttggagactgttaaactcattcattacgtacttaaattatggcaatttctctctcacatacaaacaatctccccagtactggattgatcctaaatcctcaagccatactaggcaagtgaactatatactcacgccccacctctttattttatttttaaaagacgagatctttatagctggcctagttagcttcactgtcaacttggcacagcctctagtcgtctgagaagagagttagttgagggattgattgcccagatcaaattagcctgttatcatgtcccatagctgtagggtttttttattattatcattattattattattatcaatgtatatgggagggcccagcccattgtgggctgcatcattgcctgggcagatgatcctggtctataagaaagctggctgagggtctgaagataaggctcagcagttaagagcactgactgctcttcagaggacctgggtttgattcccagtacccatatggcagctcaccactgtctgtagttgcagctccaagacttctaatgccttcacacaaatacacatgcaggcaaaacagcaatgcatacaaaataaaaaataataaacatttaaaaagaaagagagagagagaaacagagaaacaaagaaagctagctagctagctacatataagctagcaagcagtgttcctccattgtttctgcttccagttcttgccctgacttccctcagtgatagaaatacctgtaaactggaataaatcctgttccccactaagttgcctttggtcagaatgttttatcacagcaacagaaatcaacctaaaatagtagcccagtctgtcctagaaatcagagtgtagcccaggcagagtgtggcccaggtagagtgtagcccaggcagagtgtggcctcaaatccacaggggtccttctgcttcagacgcccaagtattgatgctacaggcactgagccactacacctggcttacagtttcaagtcttaatatttatggtgcctcactgtttatagacttttgcacacttgctatgttatttaaactaactttagtgtgctagaaatacccagtgaagggaggcagacatgtaatacagcatactatgaagtgttacagaaatatatagagctaggcagagcagagagtgatttactctgtggaatctgtacagccattgccattatacctgctcaccctagaaatgctgctatccgttcacttatttgccacgcagttgctctgtggcaggctctgttgtaggagtttagggtacatgcaatatggacaattagggtaggtgaaggcagaagcatcatctagtaaggaggacagacactgaggaaatgcaaagaggaactaaaaggaaaagtcatggtggcagcccatgtagttaacccagtactcagagatagatctgtgagataaaactagcctggcctacacagcagggaaattacagtagcaccaaggactgaggagagacagagaatctgtgacctgcacagatggtagtgtctgtcttcctaaagactcatctcacaagggacagagtactgctcctggagctgtgaaggggaggaacttaagttcttctatgtacagtgctggtaggtcgttgaaagacacgatacatgtctgaagcaacagaaatatggctactgtagagtcctaattgtattctattctagaatgtaagagtgtgagcatttaacactcaagaggcacaggcaagtggatctctgtgagttccaggccagactgctctgcatattaagttccaagataaaactaggattattgcacagagagatcctgtctcagaaagaaagagagggggggagggagggagagaaacagagagagagacagagagagagaagaaaaaataacaaatatttgaaactgccttagttttttttagcgtggaaacgaattctaagttttaccataccattaagctccagtgacctgggtctagttatcttagttatagcagaaagtaatttttttattcataggattataaaacaaaagatgtgactgatgacgtgaaaaatattataagatttgttcaagaacacagttcatcaccaggaacaagaaatataggacctgctggaagatttactctgaacatgctggtcgacattttcttgggtaagttatttactgtgttgtttgaattatatcacttcaaattaaacatatagggctagagagatggctcagaggttaagagcactgactgctctttcagaggtcttgagttcaaatcccagcaaccacatggtggcttacaacaatctgtaacaggatctgataccctcttcttgtgtgtctgacagctacagtgtattcacatacataatataaataaataaaaaaattttaaaataataaacatctaaggaagtggttataagtgcatttaaaaagtcactaaggtgactttttacattaacaaataatgatgatgataggactggcaagacagtgaaaggcctgagtctgatcctagaacgtacataaagaaatccagacggcctgccagcacatggctttaatcccagcactcaggaggcagaggcaggcagatctctaagttcaaggccagcttggtctacagagcaggttccaggtcagccagggctacacagagaaacccaaagaatttaaggaaggaaggaggaggaaaagaagtagaggaagaggagaagttcagacatgggctgggggtggctcagtggataatgtgcttgctactacagtaagcatggggacctagggtctggatcccagcacccatgtaaaatctgcctataaccctcgtgatgggcagatcccaggagcttgccccctagccagtctagtcaaagtggagagcttcagacagaggcctaactttaacctctcctacacatctacatacactcatgcatgcatacaccacacacacaaagccagatgtgggtaacaaatgcttgaaattgcagagaaaggggcaagacttctacctccacctcctttgagacttgatgagatgctgttttgcttgtggaatttgtatattctttatcagagtgtaattgaacatacagacttaaatatttgcttaatagatacttaaataactaaaaccagagatggtatttagaaggctcagtggtagaggtcttgtgtgtgagatccttgatttagcctcactcagcactggaaaaaattccaaaagtcctcggagggccagcaagacagttcagcaagtaacgatgcctgctgcccggcctgacaacctgagttcagtccctgggtcccatgtggttgagagagagaaccaactactgcaaggttgtcctcacctccacaacgaatgctgtggcacatgtgtgtacccaatgaataaatgggtaaaaaataatttttaaaaattctgtgagatgggtatacacacctgtaactctcagcacttggaaggtggaaatgggaagatcgggagttgaagtaactttcacggcatcctgggctgcccgagaccctgtctcagaaaatataaagcacaagagaatagtataaagctatcagcagttatgtgaattctttattttttttgctagtttttctagtattattttataagctgtgaatgcaacagtttgaaataacaagtttaattttgctgtagtttttggttaacatgtgtagtaagaacaaggaaaagtaggagcaatcagggactggggtagagttcaagcccagtgcacacggtgtggacttctaccccagcactaagagaagacatggcgaccacagagccttggagctctcctcagatatgcttgtaactcagaaatgagggtagggtctgtttgtgctgtggggtttcctgtggaacagatgatctcttgtttgtccacagatgtccttgaatggctttttagcctcctgtctgaatgacgctgagcctgtattactcatctaaccttttgaaccttattagggagcaagagtgcaaaagttaagtctggaatatttggaaaggggactacatattcacgacataatgccgaaagactttttaaaaagctgattctagacaaaatcctggatgaagacttatatatcaatgccaatgaccaaccaattgcctatgtgatgctaggaacaaaagcccacagtgtgctgagtggccacttgaaggtaaggtatttaaacatgcgtcttactgtcgcacagtatctatcataatatatcataacagagtttgttatccttccaaagtcacatttcctctggagcatattaggattttaattagaaagagatcttgaaattgatccaattaatatgctgtttgtcaaaatgaatttaatagatattcaagctactaaatcttcccatattccctgaaaaagcatgtatggtctggcaagtgggtacgggtacttgctactaagcttcagatctgagttaaagctctgggacctacattgaaaaaggagagaacagacacctataaattatcctttacagatacaccatgccgtgtgtatatataaagtgcatgtacacacagaaaagagaaacgaataaataagtaagcatttatcaagaggtgctctcatgcgccaggccctggaaatagaaagagggaatgcacagccttgttctgggaaagaaatgcaagggcaggcagtgcggctccacaggtaaaggcactgccgttcaagcctggcaatcagcattctgaccccagaacccagggagaaggaaagaaccgactccgcaaagctgttctctgacctctacaccttgacacacatacaggcacgctcatgtacacacacaaagtattaataaataggattttttaaagtaaaatttaaaaagtaaattaaaaacaaactgggaaaagctttctgggtacagtgtgcctctgctcactctgctgaatgttttctttatcaccaaggtggacttcatggaaacggaaaattccagcagtattaaaaaacaaaaagctttagtggccaaagtatcccagagagaagaggtagttaagaaatgtcttggagaacttacagaggtctgcaaattgctggggaaagtctttggtgtccattacttcaatatttttaatacagccacactcaaaaagcttgcaggtaggtaggtacctgtaggccttgctcttctgacgcaggttagtggccagttcatctactaaaggatctgtgttttgtctttattgtttctcagacaagatcttttaattaatttgttgttgttgagacatggtttctctatgtcacccttcctggtctctatctcactatgtagaacaagctgaccttgaactcacagaggtctgccttcctttgcccctacctcccaagtgttgggactaaaggcgtgtgccaccatgacatgatgagacaggggcttattatttagttcaggatggctgcaaactaatcctcgagcctcaagctgcctgagtgttgggcttagaagcatgagctaagggactttgtaagtcttggtctattttaaattttggtttaatctctgggttttcaacccagagacacatttaagctctttcttgaggtaaaaatatatacggttcagatatatgctataattttaatttcatgcctttctgtaaagctgaatgctagaatgtgaataattgccttctataaagccagatgtcaagtatttgtgcggtctgccttccgtcctgatgctcagctatttccgtgcaagtgctttgcagtgagaagctaaacaggaaaggaactgctttaggcttctttgactctggatctataacactgctgtgtctttagttaagaaatatttgctgatctgagttatttgcatggactgagataacctagaatgtcggtggtaagatctctggaaagtaagttgccataattgcctctgtgtcccctgctgctgctccttcgtgaacccacatagccatctactctccctgcactcccgcccacgcagtcaccttttgttcaggccttgctttccctgcatcatcacggcagtcccggcctgggtttggtttggggttttggttttgttgtatggcactttcgtactaggaatttaaccctggaccgcacctgtgctgagcactgacttagcagggctaagcttcagccccacctaaccattctgttcaatatcagtgccttctccatgacaccagaagatgtcaacagaatactgcacatctcagggacaaaaatggaatactgttttatcgaacctaaacatcttttttaggtcatcaaaatatctgtcacttgcaagaaaactatgaaataggtcatttctcaaagacaatactttattaatgccaaatttattacctactacttggtctcaccacctgtctacttttnnnnnnnnnnnnnnnnnnnntgtgtctagcctaggagccactgaatgtatgcaagtgaatgtgggtgagtgagtgtgggaatgtgtgtggccaatgtgagatatgatgggtcatagtgtacgagtgtgtgtgagacccagtcgtgtgtgattgtgtgcatgattttccatgtaggggtgttggtatatgagaaaaaggtgtgagagagtattgtgtgaattcacatgtacagaagtgtgagagtgtggttgtgtgagggtgcatgagtgtgtcagagtacatcagtagtaagcgtgatgtgagtgtgtaagattgtgtaagtgtgaatgactgtgtgattttatgtagttctgttgagtgtgcttgttggagagactgcatatatttgagtgtgagaacgtgtgtcactgtgtatgtataaattatgtcactgtgtgtgtgtaagtgtatgagactatgtgtgtatacattgaaaagagtgtgtatgaatgtgtgttgatgtgaatttgtgtgtgaatttgagcatataaaattatctgtatgtcactgtggccgtgtgttggcttttgactgtgtgtgtgtgtgtgtgtgtgatcttatgcacctgtgaaaatttcgtgtgttagtgtgactatgatcacatgtgagcccctgtgtgagtcagagagtctgagagtgggatgtgtgagtctgtatgagtgtgattataagtgtgtgattgtgtttggtggtgtgtgtgcatgtgtgtcaatgtgaatatgtgtatatgaatatgcatgcatttgagggtatttacctgaatatggatatgaatttgtgagtgtgtatgaaggtgagtgtgtgtgtgtacacgtacactctcacacatgtgctagtgtgaatgttgaatgcttgtgtgagagatgtttgtatgtatgagtgtataagtatgtaagcatgtgagtttaagccttaacatgtgtgaatggtgtgtggctgagtgtgagtttgtgtgtgtgcaaatgtttgactgtatgagggtgtgagaatatggttgcatgcctgtgttctgagacagcctcaccatgtaacctaggctggctttgaactcacttgattctgtccccttagtgctaggattcctagagtgaatccccaaacctggtccatttcagcatctcaagacccaggtagggcaactgggtgcaaggctctgggttcagttaccagtcctcaaaactgaccaatgaggaaacatgctgggcaggccaggctgagtcctgcagttggggagccattctggaacacagagtacccacggcccagcccatggccagatgagcttgtccccaagacacaccccgtgtacgtgtggaaaccaaaaccacgatagatgtggctgggcatcttcctagtgaggaggaggctccagcccagcctgcccagcctgaatttcagcgcctgctgacagagcagactacactctctaggcttcagtctccccaacagtcaaaccaggagaaactcatttctgatctttgtgtaccttccctcatggataccggtacaccaaggcacacttttgagcagtaagaaggcacagtctgccacatggaagcatttgtgcgttaaaggggcacaagttttccttgtctctccagtgttccccctccttgctctctacaaccaccctcctcagccttgggctctctattcaacctctcggtctcttgtggttgtcaccatgggtagaaaccctactttgggatgctgatctaggtctagcgagggtccctccagatgcaaatctgaccacccagcatgggcctgatgatctgcatggcatccatctagggctctgccttcctctgggaccaccacgagaattctccatttatcctgcctgagcacgcaggagaccagattggtgtcgggcaggcacattcaacagacgcccaatatagacattcaattatcttttaattttgtttctatcttcatttgtttatttcagtttcatttaaacagagacttttcaaaagaacctgtaatttatggcatgtaggtagcatttgttcacctgcagatgtaatgagacctgggctggagcctaagctagaatcctaatactctgccatggagacactgcctgcccccagggaccccagagcctgcagtctgccttctgcgcttctctgtatgaatcctgacttctgatcttccagctttgcaatggttagcttccccttccccctccatgctctgaccttcctggaaaccccccagagtagacactccccctccacttgaggaccacaaactcccttcccttggctgcattctctgctctggtggcctccctgtaacagaggaaggataaagccacatttcaaacattaacacgcagactcttgagaggtggggacctccgttttagggttcccagaggggtctgtgagcatccgctgtgcccagcagcccacctgactcagctgacatcccctcccttaccggctccagcccatattatccaggtcggctaggagtcagtcctgcagttcttgcccagggcctttggttataagcaagtagtaaggattgggagaggggctgaaagaagagactggagaaggagaagctggtttggaagggcaaggaactcaggaaggcggccatggaaggggcctgtcttagtcagggtttctattcctgcacaaacatcatgaccaagaagtaagttggggaggaaagggtttattcggcttacacttccatgttgctgttcatcaccaaaggaagtcaggactggaactcaagcaggtcaggaagcaggagctgatgcagaggccatggagggatgttccttactggcttgcctcccctggcttgctcagcctgctttcttatagaacccaagactaccagcccagagatggtcccacccacaaggggacctccccccttgatcactaattgagaaaatgccttacagctggatctcatggaggcatttcctcaactgaagctccttcctttctctgtgataactccagcctgtgtcaagttgacacaaaactagccagtacagggcccagggaggtttggagtttgactggacctagacggctggaaagatccccaccggcaaagataaggaggcctggcctgcaggagtcaacaaagtagggcacactagactgccacatgcagaagggtaaactgaggctgttgggtggaggctcacacacataaggacctcctaaggggatcccaggaggccagcaagatgacactccagtcaagcaaggcgacctgagttcaaccctcaggatttgcacggcagaaggagaacagaatccttgggctgtcctctgatgtcacatgtgcctatgtgtatgtacccacacatgcacttgcacacacacacaaatataacaaaaaagtttagagttttcccaaggccagaaccctcagaaccaagttcctgggccttcaaattggatcgttctttcactttgcaacctgaagacaacctttaaaaagtggagcgtgtgtgttgggcatctcggcagctgaggacctgaatcctgggcacagatggaggcttacccagagcaggcctgggcccccactcttgctcagtgactttacctcccttaaaactgtgacctcagcacccacccttgagaaccagtaaaaaacctgcacatgggggagataaaaatagccaagccttgctgagctttagcaacaacatggggcttcatgcatgttgactactctacctgatgagctaattattcggtcaccctctgtctcttgccacttttcaggcaggcacagagaagtaaaggtacttgcccaaggtcacacagctggtgaatggcagatttgagtctggggtccacagtgctgatgtgggttgggggttgtgaggagtcactcctccacaggcctcttttcctatgaggttggctcatcatgaagaggaggcagggtctctaaggtctcattttgtctgggtgctaaggtcttgtatttcctggctgcttcagcaaagctagtttctcttcaacttgttgagtagaggaggagggcagaggcagccaagggcccagtcaggtggcttggccgccagcccaggcccagcgtcctcactgtttcattgcttggctggttaaaagctgacccctcagttagggccaaggccatccccatacgcctgttaactgtggctccacctgctccgggaaccaaggcaaaagctgccccaagcttccaacctaaggatttgcaaaagagaaaataaacaccctcacacacagaccaacagtgtggcttctaggcatctggtgacagttctgctcagagattccttcctctttgaatccctgttggacactccctcccaccaggggctgcaggtgactgatctgaagctcgggcccctccagtcgggaccctccctcctttcaggcaaggatccaaagaggccagctgcaaccttagccatcccctgccccattgccgactcagtggactcaaagtcacctctgctccagcaaccgctggccagatccggctagggactccctcccactccacagcaggatccaggaactggtccctattgggcaatcattaatcggattcttggcattcctctgtccctggccagcatgctccccactggagaaggagcagagggccaggactggcatttggacatgcagctgcccagcaaggtggtgctgtccgcagctgcgctgctcctggtaactgcggcttacaaactctacaagtccagacctgccccagtcgggcaggcagggagaaacaacaaggaccacaaagcagaaaatgaaacagaggccttgggacaacttgccttccaggaggctccaccggggaccctgccaaggggtcgaagacgcaggaaggccagcaagggggctgggacctcactggactacagcttggtggatccagaagacccctgcatcctggacatttccaggtctgaagaggccacaagaaaaggctctgatgaaagtcagggcaggcagtgtccagactctcagcaggtgcctcctccctgtggtggccaggaagccggaacagatgttagaggtaagcccaaccctccccacctccctcattcaggctgtgaacctacgagctcctcaggcagacttatcccaggagtgggtggcagctgtgtgggtgacaagctctctccatggccagacagcagacccccagaggaaacaggatctggggacctggaagcccccaacggttggactgatcttacactggtcaatggtgacatgaaccagagttggatcttcacccacatgacaggggtcagcaggggagaggccggggtcctccaggctgctgcagacatgggcttggccacgcagcagcaggaaggagccaccaacgcctcccatactttctcatctgtggcccggatccggatggaggagaatattatacaaaaggcagagggaccagggctgaagggcagagtatatgactatttcgtggagtccacgtcgaaggctgactccaggccagtcccctgcccagcagctctggctgatgctccatcccctgggcctggaccagagccccttgtcactggagcagcctccagagacgaagccgctaacacagccggtggtggtgcatctgaagcagcatccccacagcctgtggcatccccatctgcaccgggcttcagcagaaaggtgagcctcctgcagatcgctgagaacccagagctccaactgcagcctgaaggcttcaggatgccccttcctgcccacctggaccagagagcccaactcagctcagcctgcagccacggggagccccacgtgcagcttgtagctgggaccaatttcttccacatcccgctcaccccggcttcagctctggatgtccgcctggacctgggcaactgctatgagatgctgaccttggccaagaggcagggcctagagaccctgaaggaggcagcctacaaggtattgagtgataactaccttcaggtcctccgcagcccagacatctatgggggcctgagcggagcagagcgggagctgattctccagcgcaggttccgtggccacaagcgcctggtggtggcagacatgtgtccccaggatgatagtggccgcctctgttgctatgacaatgtgcaggatgcttggcaccctctggcccagctgcccccggaagccatgtcccggggttgtgcactctgtaccctattcaattatctgtttgtggtgtctggctgccaggaacctgggggccaaccctccaaccgcgtcttctgctacaaccccctgacggcaatctggagtgaggtgtgcccactgaaccaggctcggcctcactgccggctggtggccctggaggggcacctctatgccattggaggtgagtgtttgaatacagtggagcgttatgaccctcgcctggaccgctggacctttgccccgcctctcccaaacgatacatttgccctggcacacacagccacggtgtgcgccaatgagatctttgtcaccgggggcagcctgcgctacttgctgctccgattctcgacccaggaacagcgttggtgggccggccccaccgggggcagcaaggaccgcacggccgagatggtggctgtgaatggctttctctaccgttttgacctcaaccgcagcctgggcatcagcgtgtaccgctgcagtgccagcacccggctctggtatgagtgtgccacataccgcttaccttaccctgatgccttccagtgcgccgttgtggatgatcatatctattgtgtgggacgcaggcgcatgctctgcttcctggcggaccacatctcacccaggtttgtgtctaaggaattaaagggtttcccttctgcacggggcacccttctgcctgccgtcttgaccttgcctgtcccggatgtgcctcagacccctgtctagcagtccctcagctgggctccatcaggattcagaaaaacccctttgcctatcactctgggtaagaagcaggcaggaacatgacaggccgtggagtggaaagttctctctcctgtaccacaggctatggggccttggaggattcttgaaaagccacattacaggtctgccacaacattgaagccagagcctagcattccacgacagctggaatctcacaacttcgtgagtgactgacccagcactgtgattcaagtcagaattcctggtaggggcggtttcaggatcccacagaaatgaagggacacagtcttctcccaatcacagttccaggggccagggtacctccagaggatttctcaagctggttggttttctgtgtgctaccatagaccaccttcttaagcaatggtctcaccaattcctaagcattgaggcccactttagaagcttctagaagcacctggaacacaggtggaaagaactgaaggagggtttgggcaggagcaggaagcagctcaggatagccctgaggtttggccagcaggacaggcacagctgaagctgaaggcatccacagtaacactgtttgagagcatattgaccaaggcccacttttgttgttgttgttacctcaggttctgtgtgctggaaggagaaaggcatccatcttgacaggagttctatttgcatattaatcattgcacaattgaggtcttaggaggcagatgtggttccaggctcccttttccgggcccctgccacgcccacaaccacctgacctcaatagaccgccccccccccccccagagttcagaatcctctctgcctgggcagggcagccaccattcttcagnnnnnnnnnnnnnnnnnnnnatatttgctgatctgagttatttgcatggactgagataacttaacctagaatgtcggtggtaagatctctggaaagtaagttgccataattgcctctgtgtcccctgctgctgctccttcgtgaacccacatagccatctactctccctgcactcccgcccacgcagtcaccttttgttcaggccttgctttccctgcatcatcacggcagtcccggcctgggtttggtttggggttttggttttgttgtatggcactttcgtactaggaatttaaccctggaccgcacctgtgctgagcactgacttagcagggctaagcttcagccccacctaaccattctgttcaatatcagtgccttctccatgacaccagaagatgtcaacagaatactgcacatctcagggacaaaaatggaatactgttttatcgaacctaaacatcttttttaggtcatcaaaatatctgtcacttgcaagaaaactatgaaataggtcatttctcaaagacaatactttattaatgccaaatttattacctactacttggtctcaccacctgtctacttttacatttttgtgttactatgtcttgtgtgtgtttggggagggagtggtgtgtgtgtgtgtgcgcgtatagaaaccagaagactgagtaatatgttgttcttcaagcaccatctacttcttttttcagcaggggtcgttcactagcgcctggggctagacagcttgctaggctaactgtccagtgagccccaggatctcctgtctttacacccgaggcactggctcggcttttacacgggtgcgagcaaccagacttgggtgcctgtccctttgcagcactgtactgactcagccatctcctcaggcccagtcgtctttctgaagacattccactctgtaatgtgacctgcagcagcactaattattaatagctgtacttaaggcctcccatgctcgggaagcagtgcgtgcaggacagctgcagaacgtccagcaggattcataagatactgcttgctttccaaagtgcagaggggttttggatttttggttttggttttggttttttgagacaggatttctctttaatcccaacatgggaggcagaggcaggtgcatctctgagttggaggccagcctggtctgcagaatgaattccaggacagtcagggctctgttttacagagaaaccttgtctcaaaaaagacaaaagaaagaagttaaaacagtatgtgagttagaatccataaaaaatggtaggtttttggctattaatgtagtttcctaactggtctccttaatgtcctatgtgagcatgttgtgcttttacttttatgttttcccaggccactaacactagaacagctcactagacacaatacagagtctgtcaagggggtcatagggtctgcatctgctttcttcttccattttgtctcccactagccctcttgaacctgctctatcccatagtctatcactttcctccaagcataagagtgactggaaaggatctgaaatctaccctctgctcaaggcagagatatgggattagcaccctttcactccaaagccaacgctcttggctcagagcaaacccaagccttggtttctaccactgcatccagcttgctccattcttcctccttcagagccaataagcatccctttctactctttcccaaacagcagccagcgtgacctttgagccataagaaggtgtactgtccctgcttcacctgcatgggactaaccagatgaggactcagtcagtgtcggggcagattcagtgtagtgtgtctcttgagatggagtgtgtatgtctgcagagctagacatagaatgtcagtgttgtttacaaatacggggacatttgtcctgcagctagacaagccttggcagtggggacagtgtgctggaagcctgaacacttagcacagggcccaccctagctttccacaggcacttggctggctcccaccccctacgttgacatctgtgcctttgttgctgagactggacagtgggccctgcctcctggcctgtgtgctgcatttccaatctaacttcaccttttagaaaactccccatggatccggtcccagcaatagttggctcttaacaagcatgagtgaaatgagcagatgcacatgaattcagtggtttttccatgagtggtgatttaaattcttaattttatatccacacacagaatctttatcttctgatcctgaggttttgcttcagattgatggtgttaccgaagacaagctggaaaaatatggtgcagaagtgattccagtattacagaagtactcagaatggacattgccaggttccgtatcctccaaacctgtttacttgtgagcccctctcagaactgtgttactgttaagcagtgcgtctccctgagctggcaccaggtagttaatgcatcctacacctgttacactgaagttccaatcctaagaacagtcccagtgtgtgaggcacctctcaggtagttaggaagcccggcattaaagctgctgatggagcacaggtgggagggagcctctgtgcctgcccgagggcctacacgctgttgttttggtaaggcaaagtgagtggccaaggagtcatgatccctggcacccattccagatggactatcacctcactatgtgatcctggcaggacaccagcatccccagtgtgcttcactgttcgttctcatgtaaggaagggacatgttatctagcaagcttgtcaagataacatgttagagtagctcttacgtgctttgggaaaatggatgtgtcactggaacactcttgccattggaagaatctgactttgtgaggacatcaaagcagaggttgccagaggctgcattaggtctgtcctgtggtgcctcgttacaagccatggcactggtatagagatcactggatgagggaaactgagaaaaaggagtagtttgctgtaggggatgaaggggcacagtgtgctgtccacttacacgccagcattaagttgtcatccccagtggacctgctgtcttagtcaggtttctattgctgtgattaataccgtgatcaaaagcaacttggggagcagagggtttgtttgtattatgtatcctgagctgtagtccattgaagcaagacaagtccagggctgaagcagagactatgaaggaacactgcttactcgcttgttccctctcagcttctcagcctctgcctccatttacctcaggaccacctcaaggacagcatgaccaagggtgggctgtgttcctccttcccatcaatcaagaaaattcaagtcatgcaatgttagcacacacctttaatctcagcaatcaggaggcagaggcagatggatctctgaagtaaggctagcctggtctacagagcaagttccaggacagtcagggctgcacagagaaacccgtctcagaaaaaaacacaaaagaaaagaaaatgccctagcatccctaacaggccagtctggtgggagaactctctcagttaaagttccttctccaataactctaggcaaatgtatgttttcactcaggccaaattcctgcttgatatgccacgtgttcataacaattatgcagagaaatggcttaggagtaaaatacagtactgaattttctggtgtgtttattaagaggctgttggttaaagatgaagaacagaatttgttggtttttttatattggacttattttctcaacatgtttaaaatgataaataaaatcagctaacacttatggcagcctttacttcagttcgcaagggttagctgcacaatgtaaaataacataggcctcatgcagtaaagtgtgaactaaacctgacatctccagttgagttgaaaattatcacaaaaatctgtaagtaatgagttttgattctctctcattaaatataaattgccattgaacatacttaagcttttcaaaataaaatgtttaattcctgctgaggtgttgaatccattcagcaggaaagcagctggtattgggctccaaacccagggtcacctgtaaatgtctgcatttcctgtttgtagctgaggatggttccccaggcgccagaggcgccccagaggacactgaggaggaggaggaggaagcgcctgtatcttctcactactttgcaaatcaaactagaaatgaaagaaagagaaagaaaatgtcagccacccataagcccaagaggagaagaactagttacggtggcttcagagcaaaggggtatgtatggtctttatgtctttgtagcatccgggggacggggaggatggggtgcatatagctgctctaacagtcaatagttaatagattgatggctagcccctaaaccaaagtaaaagcaggactttggatttttaagtaatctaatttgcaaaaacttctcaaactttgactttaccttggaatttttgtttcttttgaggtaattattcttcttaaagtattttccaccaaaaacaccctgagtaaataacacggccgtgtccttcaggcttttgggagtctataagtgtttgctgcactccctctgctgcaggattctctgggtctctctgctattttttgagacagggtctcctctatcacagtctgcccttgaacttagtttaaagccaaggttgaccctgactttatactcttcctgcatccacctcccaacttctgagattacatgtgggccatcacacctggtttatgcaatgctgaggtccagcccatagcttcctacaatctaactgagcactgctagcccagcgcattccccaccctccctgctacttttaatgcccgggagactgggtctcctagtcttggcaggatagctgagaggagaccacttggggaaatccaaaggccagacaagccaagtttccttgggggctgtgtaagtggtttctgtcttctcctccctttgcttggctgcagcatgtctgcacaggagaagcgaagtcagagtggccaggtcttggcagcaggcatgttttccaccattggactgtatccaagagtccctccctccccctcttcctccttctcccctgctagatgcccatcacctcctgccctcaatccagagatggtggtccccagagaagtgtatactgtaacagaactgcttagaacaggaaccaaagctgcatggctctgagctgttgtttgcagttttccaccttttctccttctaagtgagaaaaacaagattgagtgggggaagagaaaggcagacaatgtcaccaaattgtcatttcttgttaaatccataaacagacttcttacatgtgctaaccttcctccagagtacacaattaaagacatttgtaaatggtggtttaactttgtggttttgagtgcgcaagtgaccatcagatattcctcagtgaggacattttctcatttccttcatttattcctccccttgggaagcactcatttgcttagttgctcacagagcatgagaccttaaaaagcttctggtccaacccccttgggtttaggatggggaaactggcctggcctgtgttgtgtgggagggaagggcttgcctgaggccagtctcgcctactccgtttcagaggtaggattggacactggcctggcctgacggctcagagcactttcacttctgcgagtctgtggacactccttgaaaccgtgggcgatctgacatctggcttctacttgttgggagggaagagaccaacactgttctttgctgctggctccttcacttcatttgcacagcagctgtttgtgagaaaggagctctttgccatgttgcctgtaatctgatttaataaggagtaaaactcaaatttgcacgaggcataaaggtttactgtagcactcgggagctaggaggcaggaagatcagagtgcaaggtaatctgtggttcagtgccacacatggtcatgcgtgcctcagtgtcagcagttgagaggc

SEQ ID NO: 1404 - DNA, 4498 bp, Mus musculus
cggcgcgccgagtttggatggtggttccgcccggcgcgacgtaagcctgagtgaggatcatggctgctgttcctctgaacaatctacaagaacaactacagcgacactcagccagaaaacttaataatcaacccagcctttcaaaaccaaaatctttaggttttacttttaaaaagaaaacatcagagggtgatgtgtctgtcactagtgtgtccgtagtaaaaacacctgcgttaagtgataaagatgtgaacgtgtctgaggccttttcattcactgagtctccactccacaaaccaaagcagcaggcaaagattgaaggcttctttaaacatttccctggaaggcagcaaagcaaggggacctgctctgagccgtcactgccggccacggtacagactgctcaggacactttgtgcactacccccaaaacccccactgcgaagaaactgcccgtggctgttttcaagaaattagaatttagttcttctgcagactccctcagtgactgggctgatatggatgactttgatatgtcagcatcagatgcgtttgcttcactggctaaaaatcctgccacaagagtaagcaccgctcagaaaatgaaaaagactaagagaaacttctttaaaccaccacctcgtaaagccaatgcagtaaagactgacttgactcctccctcccccgaatgcctgcaagtggatttaacgaaggaatcggaggaggaggaggaggaggaggaggaggcggagggggcggactgcctgagcagggatgtgatctgcattgacaatgattctgcttctgaagagctcacggagaaagacacgcaggaaagccagtctttgaaagctcacttgggagctgaaagaggtgacagtgaaaagaagagccatgaagacgaagctgtgttccattcagttcagaacactgaatactttgaacacaatgacaatgattatgatatagattttgttccaccttctccagaagaaatcatctccactgcttcttcctcgttgaaatgttccagtatgttaaaggatcttgatgactctgacaaagaaaagggcattcttagcacctcagaagagcttctgtcaaaaccagaggaaatgaccacacacaagtctgatgcaggaaccagtaaagactgtgatgcccagcagatacgcatacagcagcagcttattcatgtgatggagcacatctgtaagttagttgatactgttcctactgatgaactggaagctttgaattgtgggaccgaattgcttcaacaacgaaacataaggaggaagctcctagctgaagcaggttttaatggaaatgacgtcagacttctgggttctctgtggaggcacaggcctgattcacttgataacacagtgcagggcgactcctgccctgtggggcatcctaataaagagttaaattctccataccttctctcacattccccttccactgaggaatgtttacccaccaccactccaggaaagacaggattctcagccaccccgaagaatctctttgaaaggccgttattgaattcccatttacagaagtcctttgtaagtagcaactgggctgaaacaccaaggatggaaaacaggaacgaaagcactgacttcccagggagtgttctcaccagcaccactgtgaaagctcagagtaaacaagctgcttcaggatggaacgtagagagacacggccaggcttcctatgatatcgataactttaatattgatgactttgatgatgatgatgatgatgatgactgggaaaacataatgcacaattttccagccagcaaatcttccacagccacctacccacccatcaaggaaggtgggccagttaaatctctctcagaaaggatttcttcagccaaggcaaagtttcttccagtggtatcaaccgctcaaaatacaaacctctcagagtcaattcagaattgctctgataagctggcccaaaatttatcatcaaaaaatccaaaacatgaacattttcaaagtcttaattttcctcatacaaaagaaatgatgaagattttccataagaaatttggcttgcataattttagaactaatcagctagaggcgatcaatgctgcgctgcttggtgaagactgctttatcctaatgcccactggaggaggtaaaagtttgtgctaccagctccctgcctgtgtttctcctggggtcacaattgtcatttctcccttgagatcactaatagtagatcaagtccaaaagctgacttcctttgatattccagctacatatctgacaggggataagactgactcagaagctgcaaatatttacctccaattatccaaaaaagacccaatcatcaagcttttgtatgttactccagagaaggtctgtgcaagtaacaggctgatttctactctggagaatctgtatgagcggaagctcttggcacgttttgtcattgatgaagcgcattgtgtgagtcagtggggtcatgattttcgtcaagattacaaaaggatgaatatgcttcgccagaagtttccttctgttccagtgatggccctcacggccacagcgaaccccagggtccagaaggacatcctcactcagctgaagatcctcagacctcaggtgtttagcatgagctttaacagacacaatctgaagtactatgtattacccaagaagcccaaaaaagtagcatttgattgcctagagtggatcagaaagcatcacccttatgactcggggataatttactgcctctccaggagggaatgtgacacaatggctgacactttacagagagaaggcctggctgccctggcttaccatgcgggcctcagtgactctgccagagatgaggtgcagcacaagtggatcaaccaggacaactgccaggttatctgtgcgacaattgcgtttggaatgggaattgacaaacctgacgtgcgatttgtgattcatgcatctcttcctaaatctatggagggttattatcaagaatccggccgagctggaagagatggggaaatatctcactgcgtgcttttctatacatatcatgatgtgaccagactgaagagacttataatgatggaaaaagatggaaactatcatacgaaggaaactcacgtcaataatctatatagcatggtacattactgtgaaaacataacggaatgcagaagaatacagcttttagcttactttggtgaaaaaggattcaaccctgatttttgtaagaaatacccagatgtttcttgtgacaattgctgtaaaacaaaggattataaaacaaaagatgtgactgatgacgtgaaaaatattataagatttgttcaagaacacagttcatcaccaggaacaagaaatataggacctgctggaagatttactctgaacatgctggtcgacattttcttggggagcaagagtgcaaaagttaagtctggaatatttggaaaggggactacatattcacgacataatgccgaaagactttttaaaaagctgattctagacaaaatcctggatgaagacttatatatcaatgccaatgaccaaccaattgcctatgtgatgctaggaacaaaagcccacagtgtgctgagtggccacttgaaggtggacttcatggaaacggaaaattccagcagtattaaaaaacaaaaagctttagtggccaaagtatcccagagagaagaggtagttaagaaatgtcttggagaacttacagaggtctgcaaattgctggggaaagtctttggtgtccattacttcaatatttttaatacagccacactcaaaaagcttgcagaatctttatcttctgatcctgaggttttgcttcagattgatggtgttaccgaagacaagctggaaaaatatggtgcagaagtgattccagtattacagaagtactcagaatggacagtgccagctgaggatggttccccaggcgccagaggcgccccagaggacactgaggaggaggaggaggaagcgcctgtatcttctcactactttgcaaatcaaactagaaatgaaagaaagagaaagaaaatgtcagccacccataagcccaagaggagaagaactagttacggtggcttcagagcaaaggggggctctactacatgcagaaaaacgacttctaaaagtaaattctatggtgtaactggatcccgctcggcctcatgtgcttctcaggcaacatcatcagccagtagaaaactggggattatggctcctccaaagcctgtaaatagaacgttcctcaggccttcatatgccttctcctaacagttctctgcgcatagatcttgtttgtcagcatctgaccatctgtgaatagaaagctgttagtcttgttacagcatttgaagttttcacttctatctattaatatttaaatgtatctcatgtgatagttcttatttttaaataaacattttctttggtgctactgcaaaaaaaaaaaaaaaaaaaaa

SEQ ID NO: 1405 - DNA, 4251 bp, Mus musculus
atggctgctgttcctctgaacaatctacaagaacaactacagcgacactcagccagaaaacttaataatcaacccagcctttcaaaaccaaaatctttaggttttacttttaaaaagaaaacatcagagggtgatgtgtctgtcactagtgtgtccgtagtaaaaacacctgcgttaagtgataaagatgtgaacgtgtctgaggccttttcattcactgagtctccactccacaaaccaaagcagcaggcaaagattgaaggcttctttaaacatttccctggaaggcagcaaagcaaggggacctgctctgagccgtcactgccggccacggtacagactgctcaggacactttgtgcactacccccaaaacccccactgcgaagaaactgcccgtggctgttttcaagaaattagaatttagttcttctgcagactccctcagtgactgggctgatatggatgactttgatatgtcagcatcagatgcgtttgcttcactggctaaaaatcctgccacaagagtaagcaccgctcagaaaatgaaaaagactaagagaaacttctttaaaccaccacctcgtaaagccaatgcagtaaagactgacttgactcctccctcccccgaatgcctgcaagtggatttaacgaaggaatcggaggaggaggaggaggaggaggaggaggcggagggggcggactgcctgagcagggatgtgatctgcattgacaatgattctgcttctgaagagctcacggagaaagacacgcaggaaagccagtctttgaaagctcacttgggagctgaaagaggtgacagtgaaaagaagagccatgaagacgaagctgtgttccattcagttcagaacactgaatactttgaacacaatgacaatgattatgatatagattttgttccaccttctccagaagaaatcatctccactgcttcttcctcgttgaaatgttccagtatgttaaaggatcttgatgactctgacaaagaaaagggcattcttagcacctcagaagagcttctgtcaaaaccagaggaaatgaccacacacaagtctgatgcaggaaccagtaaagactgtgatgcccagcagatacgcatacagcagcagcttattcatgtgatggagcacatctgtaagttagttgatactgttcctactgatgaactggaagctttgaattgtgggaccgaattgcttcaacaacgaaacataaggaggaagctcctagctgaagcaggttttaatggaaatgacgtcagacttctgggttctctgtggaggcacaggcctgattcacttgataacacagtgcagggcgactcctgccctgtggggcatcctaataaagagttaaattctccataccttctctcacattccccttccactgaggaatgtttacccaccaccactccaggaaagacaggattctcagccaccccgaagaatctctttgaaaggccgttattgaattcccatttacagaagtcctttgtaagtagcaactgggctgaaacaccaaggatggaaaacaggaacgaaagcactgacttcccagggagtgttctcaccagcaccactgtgaaagctcagagtaaacaagctgcttcaggatggaacgtagagagacacggccaggcttcctatgatatcgataactttaatattgatgactttgatgatgatgatgatgatgatgactgggaaaacataatgcacaattttccagccagcaaatcttccacagccacctacccacccatcaaggaaggtgggccagttaaatctctctcagaaaggatttcttcagccaaggcaaagtttcttccagtggtatcaaccgctcaaaatacaaacctctcagagtcaattcagaattgctctgataagctggcccaaaatttatcatcaaaaaatccaaaacatgaacattttcaaagtcttaattttcctcatacaaaagaaatgatgaagattttccataagaaatttggcttgcataattttagaactaatcagctagaggcgatcaatgctgcgctgcttggtgaagactgctttatcctaatgcccactggaggaggtaaaagtttgtgctaccagctccctgcctgtgtttctcctggggtcacaattgtcatttctcccttgagatcactaatagtagatcaagtccaaaagctgacttcctttgatattccagctacatatctgacaggggataagactgactcagaagctgcaaatatttacctccaattatccaaaaaagacccaatcatcaagcttttgtatgttactccagagaaggtctgtgcaagtaacaggctgatttctactctggagaatctgtatgagcggaagctcttggcacgttttgtcattgatgaagcgcattgtgtgagtcagtggggtcatgattttcgtcaagattacaaaaggatgaatatgcttcgccagaagtttccttctgttccagtgatggccctcacggccacagcgaaccccagggtccagaaggacatcctcactcagctgaagatcctcagacctcaggtgtttagcatgagctttaacagacacaatctgaagtactatgtattacccaagaagcccaaaaaagtagcatttgattgcctagagtggatcagaaagcatcacccttatgactcggggataatttactgcctctccaggagggaatgtgacacaatggctgacactttacagagagaaggcctggctgccctggcttaccatgcgggcctcagtgactctgccagagatgaggtgcagcacaagtggatcaaccaggacaactgccaggttatctgtgcgacaattgcgtttggaatgggaattgacaaacctgacgtgcgatttgtgattcatgcatctcttcctaaatctatggagggttattatcaagaatccggccgagctggaagagatggggaaatatctcactgcgtgcttttctatacatatcatgatgtgaccagactgaagagacttataatgatggaaaaagatggaaactatcatacgaaggaaactcacgtcaataatctatatagcatggtacattactgtgaaaacataacggaatgcagaagaatacagcttttagcttactttggtgaaaaaggattcaaccctgatttttgtaagaaatacccagatgtttcttgtgacaattgctgtaaaacaaaggattataaaacaaaagatgtgactgatgacgtgaaaaatattataagatttgttcaagaacacagttcatcaccaggaacaagaaatataggacctgctggaagatttactctgaacatgctggtcgacattttcttggggagcaagagtgcaaaagttaagtctggaatatttggaaaggggactacatattcacgacataatgccgaaagactttttaaaaagctgattctagacaaaatcctggatgaagacttatatatcaatgccaatgaccaaccaattgcctatgtgatgctaggaacaaaagcccacagtgtgctgagtggccacttgaaggtggacttcatggaaacggaaaattccagcagtattaaaaaacaaaaagctttagtggccaaagtatcccagagagaagaggtagttaagaaatgtcttggagaacttacagaggtctgcaaattgctggggaaagtctttggtgtccattacttcaatatttttaatacagccacactcaaaaagcttgcagaatctttatcttctgatcctgaggttttgcttcagattgatggtgttaccgaagacaagctggaaaaatatggtgcagaagtgattccagtattacagaagtactcagaatggacagtgccagctgaggatggttccccaggcgccagaggcgccccagaggacactgaggaggaggaggaggaagcgcctgtatcttctcactactttgcaaatcaaactagaaatgaaagaaagagaaagaaaatgtcagccacccataagcccaagaggagaagaactagttacggtggcttcagagcaaaggggggctctactacatgcagaaaaacgacttctaaaagtaaattctatggtgtaactggatcccgctcggcctcatgtgcttctcaggcaacatcatcagccagtagaaaactggggattatggctcctccaaagcctgtaaatagaacgttcctcaggccttcatatgccttctcctaa

SEQ ID NO: 1406 - DNA, 96594 bp, Homo sapiens
aggccaggagttcaagaccagccctggcaacatagcgagaacctgtctctggaaaaacaatttttttaaattagctggacatggtggcatgtgcttgtactcccagctaaacaagaggctgaggcaggaggatcacttgagcctaggagttcaagactactgtgagccatgaatgtaccactgcactccagcctgggtgacagaatgagaccctgtctccaaaagtaataacagcaataataatgtatatttactctataccaggcattataccgagggccttacgtcacttaatcttcatactaaacttatgagacatgtattactatttctattttacaaatgtagaaaccaaaattcagaattgtaaagtgagtgtggtatttagattcaaatctggtggaagctttattttatgttacttgcaatctgtgaagaaaaaactagatccaagattctaacaggaatttatataatatgattacaaaatgagtttatttataatttaaataaacaaaattcccttttattttctacaacaaacatgctaagattatgtgagtaaacttctcggctaaatattgtattctagggagacattaaacaagaactttgtagttaacattgttctttctgttttatctttctgtacttacagacattttctttcttttttttgagacaagagtctcgctctgtcacccaggctggagtgcggtagtgcgatctccgctcactgcaaactccacctcctgggttcaagcgattcttttgcctcagcctcctgagtagctgggaatataggcatgcgccaccacacctgactaattcttgtatttttattagagatggggtttcactatgtttcccaggctggtctcgaactcctgacctcaagtgatccacctgcctcagcctcccaaagtgctgggattacaggtatgagccactgtgccctgccgactaatacttttttattgtatgccaaatactgtgtataaaataaccttaaaggtcgaagttaataatatttttctctgaatggttgactctattttctgttggcccatgtacctcaaaagaatgataattctatccaatcagaaattgagctgattttggaagagttacggctttacttagatgtggtccacctctgtttttaattatcttgagagagtgagacctgtcatgtattttttgcaggcccctcccttcagagggactccacattccaaactaagagactgcagatcttactctgcctttccagcctaggtctcgagcttagcagctcttggcccccagtctaccccagcactcagcaaatatcccatgggaaaaaaagcctcttatctaggctcctttagactctaatctgttaacaatagcctgagaggccatcaaaagttcagtgtaaaccacactcaatcttcagctttgacaaatgcacccagggagaaaaatgaccagcaatcccagttcacctagcaatgggctcttctttctctgatcccactgctctctgatgttcttatgtctttaaaaataggacttgggccaggcgcagtggctcacacctgaatcccagaactttgggaggccaaggcagttcaagaccagcctggccaacatggtgaaaccccatctctactaaaaatacaaaatttagctgggcatggtggcacacacctgtagtcccagctagtcgggagggtgaggtgggagagtcacttgaactcaggaggcagaggttgcagtgagctgagatggcgccactgcactccagcctaggtgacaagagtgagattgtctataaatatatacacatgtgtgtgtgatttgtataatttatcctttttttgtatgtgtgcgtttttgtttttctggttgttgtagcaggagtgacaacctactgatacctactacatccttccttgtgaataacaacgtatattctcagaagagcgttgttcttaccactgaatatctcagactgcttctaacatattcttagaaaacataacaaaaggcagactatgtataactttaagtttaattgagatctttctccacctacctggtctcttaacagtgttctttgtttactttgctcctgagtggttaggagtgtaaatatcttactagcacagtacattgaaaattcaatgtatttgctataataggatttgttcttcctaagggctttataaaataaacctcgagttttttgtatttttaaaagtctgagctgggcacagtggctcacacttgtaatcccagcacttggggaggctgagtcaggaggattgcttgaggccaggagttcaagaccaacctggacaacagcaggactgtctctacaaaaaataaaaataaaatgtctgtatttaatattattgataggtaacattctcacatgttcaaatgtcaaaaaatatgaaagggtatacagtgaagtatttctttttttttgagacagagtctcactgtcacccagggtggagtgcaatgacaccatcttggctcactgcaacctctgcctcctgggttcaagcaactctcccacctcagccttggactagaggcgcatgccaccatgcccagctaaattttgtatttttagtagagatggggttttgtcatgttggccagactgctctcgaactcctggccccaagtgatccgccggcctcggcctcccaaaatgttgggattacaggtgtgagccatcacgcctggccacagtgaagtatttctatgactcattcctccatctacccagttcccactcccaacaggtattcatgattattagcttcttatttattagaaaagtttaaatgaatatgctagctgacacatatccgaatcattttcccccattctctaaataaacatagcatcctatggctactgttttgcagttcgcctttttttttttaagtataaacgggaattaattggcttatatgactgcaaagtccaggacgtggctgccagtacagcaggatccagggcctcagacaattaattccaccaaaacccagcttctctccttctcttgcctgcactctcctctccggtggctgcatcctcaggcaggctcccctcctagtcccacatccaggatgacaccttaacagtttgggaactccaacagaaagggcacacctattaccacattcccggtagattctagccaaagtcctgtggagggctctcattggcccagctggagtcatcaggccaagccagtaggatatactgattggccaggctgacgtggcagggccacccctggtgttccaggcttgagaagtcagtcccacattggcatgagtttcctggctgaattgagaaaagtggctctccaaagccgtgtcaggctgctgtaagtggatgattttccccaggcaaagattacagatgtctactgcaaaaggcagtgtttttgatgtctttttttttggctctttcatgccaggaagctgctattatgccaaacgcatctgtggctcaggccatacaggaccaaacgaaaagccaaagttgtttacatctttcctatgatcttgtttttgtgggcgcccaaaaaattatattacaaaccctccaactagtcccaagtccatacctctaactaccccctttttctaacacaaagccaatatttcccctgccctaaattaacccaaggctaggtactacagaacccctagagataccgctaatctccaaaacccaccagaattattcagaccacccagtcccaaactttccctgcactgccttgccttccctgctgaaacgctaataaaggttctcgtttaagctttcccttcactcccttctgcctcctgaccaaacctggtgcttcttctccatgtggccctgcatggcgtggtgtgtccctcctctcaggaaatgtggataaattattccttcaaagccactagtctctctgtcatcagtcagtcgcttctataaattaaaatcctacaggtacaactgagagaggggctgctgcgactgagttttcagtcctggaaaaccacactttttttttctgtctctgcaaggctttggcagtctctcctctccacccccttattaatgctggcctctgtttcacaggtacctctctacacgagcaggtgcaaattgtcactgatgggggaaacatgaaacaaactcagatgcctccagggacacgtgagaagccacacttgtttcagcctattgttctcttgagggaatgtgggccctgtgatgatgctagatctttcttttctttctgtaccttcctctcttcttccctctctccttccttccctccttctctccttccctcacaccctccctccctttcttctttcctcttttttaagaaaaactgaaaatctatttctgttttgattggagcttttgtgtgtgtgtaaaatatgttgtgtgtgtgttttttttttccacagcaactgctttttgtgtgtgtggtaaaatatgtatgaaataaactgccattttaacctttttatgagtagaactcaatggcattaattacattcaaaatgctgtacagccattgccacaatttctaaactttttcatccccccaaatggaaactatgaacccagtaagcaataattcctcattcttccctccttcctactctcagttcctgaaacctctaatctactttctgtctctatgaatttgcctattcaaaatctttcatataaatggagtcagatcgtatttgtttttttgtgttggcatatttgactcagaatgttgtagcatgtgtcagagcttcactccttttcatggccgaatgatactccactgtatggatatactactttttttttttttttttttgagatggagcctcgctctgttgcccaggctggagtgcagtggcacgatcttggctcactacaacctccacctgccaggttcaagcaattctcctgcctcagcctcccgagtagctggggttacaggaacacgccaccatgcccggctaacttttttgtatttttagtagagacagggtttcactatgttggccaggctggtctggaactcctgacttcaagtgatccacccacctcagcctcccaaactgctgggattacaggtgtgggccactgtgcccagcttattagatataccacattttgtttattcattcatctgttaatgaacatgtgggtgaaatatgtcaatttttacttgttgcaaaaacaaaacacaccttttttttttttttttttttttgagacggagtctcgctctgtgccccaggctggagtgcagtggcgcgatctcggctcactgcaagctccacctcccaggttcatgccattctcctgcctcagcctcccgagtagctgggactacaggcgtgtgccatgacacctggctaatttttgtatttttagtagagacggcgtttcaccatgttagccacgatggtctcaatgtcctgacctcgtgatctgcctgcctcggcctcccaaagtgctgggattacaggcatgagccaccgcgcctggccaaaacacatcattgttaaataactcctcaggctacccttctctatgggaaaatgcagagtaaatcaacagatttttaatagcaaaatggccaaggaaaaagcaggatagagacaacgcaaagatacaaacaatctaccaaatgaataaagccactaatgttacttaggctcaaacagtatcccccaaagtgagaggctggatactcacaactcgataaagggtgacattcacctgatattgttgctgtctcacatggccttaatcatcttattgcttttgtcttcactgttcttcaattttgtgcccttctctagtgccagccattgtggtaggccctgaagaacaccctcatggagagcatattctgtagaggaagacaggcacactaatagtatcaacacaaccaatacaaatgctgactgctgttatgggaaaacctaggagggatacacaggcagatttggaggattaggtaaggctttccaacttcccaacttctccaacaacttgcagagaagttgtcctgagacctgagagatgaatgagaggtatgatttggaggcaaaggccaggaaactggaaagactataaaacaccttgaggaaatgacaggaaaatggggatgagggacagatgacatatgagaggaagcagggactcaatcggagtttggtattcaccttgaaggcaaatgggagctgctggaaggattctgtgttttttttttttttgagacagattctcactgctgcccagggtggagtgcagtggtgtgatctcagctcactgcaacctttacctcccacctggaaggtagatgttagcgtagggtggtgaaaggcttgtgcactcatcttaatcttaaatatataccttggccaggcaaggaggctcacggctgtaatcccagcacttttggaggctgaggctggcagatcgcctaaggccaggagtttgagaccagcctgggcaacatggcaaaaccccatttctactaaaaatacaaaaattacccaggcgtggtggcatgtgcctgtggtcctagctactcaggaggctgaggtgggtgaattacttgagcctgggaggtggaggttgcactgagccaagatggcaccactgcattccagtctgggcaacagaggcagaccctgtctcaaaaaataaaaataaattttaaaaaattgaaaaaatacatatctcaatgattgtatgtatataatgattttatatataaatgatttatatattactttatctatattaaatgtctatataagacagatatgtaatttccagcactccataagatttccttgggagcttcctcatctacctctgcctccaggggtaacctggtatgcactatatactctttttctcttttttttttgagatggagtcttgctctgtcgcccaggctggagtgcagtggcgtgatctcggctcactgcaagctccgcctcccaggttcacaccattctcctgcctcagcctcctgagtagctgggactacaggcgtccgccaccatgcctgactgatttttttgtattttttagtagagacagggtttcaccgtgttagccaggatggtctcaaatctcctgacctcgtgatccacccacctcggcctcccaaagtgctgggattacaggcgtgagccactgcgcccggccctatatactcttttatctacctctttttgtgctcagcatagtgtctgagcttcatctatattgtatgtaccagtagttcatcctcctattactttgtaatacagaaaaaaactgagaaaagctttgaaatggtctaaaacagattactggggccaggcatggtggctcaagcctgtaatcccagtactttgggaggccaaggcaggcagatcacctgaggtcagaagttcatgaccagcctggaccacatggtgaaaccccatctctactaaaaatacaataaattagccaggcgtggtggcacgtacctgtagtcccagctgctcgggaagctggggcaggaaaatcgcttgaacctgggaagtggaggttgcagtgagctgagatcacaccactgtactccagtctgggtgacagagcaagactccatctaagacaaacaacaaaaaaatgattactgggtgtcattgaaaaacaaggtgcccagctgtccagcttacttttctaggatgtctgattctatgaagactctaaacctttcactgtctttgagctacagaacaactatacaaactatagacacttcttgtctatagaaatgcaaattgtggccgggcacggtggctcatgcctgtaatcctaacactttgggaggccaagacaggcggatcacctgaggtcaggagttcgagaccagcctggccaacacggtgaaaccctgtctctactaaaatacaaaaagctagctgggcatgatggcgggtgcctgtaatcccagctactcgggaggctgagacgggagactctattgaacctgggagatggtggttgcggtgagccgagcttgcgccactgcactccagcctgggcggctgagtgagactccgtctcaaaaaaaaaaaaaaaaaaagaaatgcaaattgttttcagtagaatgcaattgattactaagctgtggatttcatcagttctgccagtttttgtatatatttgtagttatttcattattcctcatttgactatgtgtgtggtactttgaattttccattgaagcagttgtaatctttctggatatctcattcattaatgagttaaataaaatctctaacatttattttatatctgtattatatttgatattaaaattattcttcaacagtagtatacagttatatgaataagctgcaatttatctattcatctattggtggacatctgggttttttccctttggctattatgaataaagctgctatgagtcttttggtgaataaaggcattcattttttggggtaaatatctagaaatgggatttctggggtatagggtaggggtaaatttgatttcagtagagactgatgtttccaaagtggttgtaccattttacactcccatcaacactgtatgagagtcccatttctgcatctttgcaactaagggaattgtcagtcttttcatttcagctattctatggagtgtttaatagtatcatattttggtttcaatttaccatagaagattttcaggagggaggtaacttgaacagatttttacattttagaaaactctttctgcgtattatgtggagaatgattatttgtataccaaagttcatagcagcattattcacaatagccaaaaggtgggaataaccaagcatccatttatatggatgaatggataaacaaaatgtagtatacatgtataatggaatattatttagcctcaagaaggaagaaattctgatacatgctacaacatagatgctccttgaagacattatgctaagtgaaataagccaatcagaaaagagcaattattgtatgattcaatttatatgcggtacctcgcacttacagacagaaagtgcaatatcggctataaggggttgtgagaaacgggtaacggggagttactgtgtaacaggcagattttctatttgggataatgaaaaagttctggagatggatagtggtgatggtttcacaacaatgtgaatgtacttaatgccagtgaactgtacacttaaaaatggtgaattttatgttagatagattttatcacacacacaaagaggagggagggcgggagggaaggagagagggaaggaagtagagaggggagaagagaggaagaaaggaaagaaagtaagatctggcatcacagggcccacattcccgcgtgtcagcaataggctgaaacagaagcatggtttctcacgtgtccatggaggcatctgagtgtgtgcccactttcccggttcaatgacaatttgcacctgctcgtgtagaggggtacgggtgaaacagagaccagtattattaaggggatggagaggagagaccgccaaaacatcgcagagacacaccgtcggagccaagagaatggggtgcagacgcctggcttggcctgtgggaactggcaagtctcagctctcaaacgcccgggcttttcaacccgccacagccgggttccagctgcctacttcctttaaagccttcaccgactctaaaacaccaaaaacaaagacccaactagctccggaagcccgagatgtaaccgtagtcatctgaccctcccgtccggactctgattgggctttggagatacgcgtccctcccggcgctgtacggcgaccccgccccagcagcctgagggggcgggaacagatgtccgagtgcgacagtattggtcggcttccccaggaagcagccaatcggaataggcaagcttccggcgggaagtgagccagggcttggcgcggcggccgtggttgcggcgcgggaagtttggatcctggttccgtccgctaggagtctgcgtgcgaggtgagtaccgcgcgcgtaactacgggtcggtccgcattgatctagccctgctctggcggcccggcccggagctggaggccgctcgggttcttccgtttcctgcactggttcgcctcggcccgctgagtcctctagtctggccaacatcctgggaggacagcagatacataaatacgttcccaaatggggaaacagaggcccggggcgggggcgaactctgccaaggtctcccggggcgtcggaggccgagcatgggctaggacctggcatgttgttgcccatatactccagtgcgtaacatgatgccctgcacagagtaatcccagcccagacctctggcactactacctccgtgtccctcctgaggaacaacgaaaacactttgtactttttctgtggccttccataatcacgagctgggctactcttgtttttgagtgtctactgtgtgccatgttcctggcacccttgatcttacaactgtagctttacgatatcccagcaaagcgaagtgcttaagaatactgcatcagattgcttgggttcgaattctggctccttcacatttagctctgtgtctactgcacgttactgaaacactaagtgtcttggttttcgtctgtcatatgggggaaatggtctcttctacttcctggcgtttttgttaggattaaacgacttaatatatgcaataataaatgcttcgaaggctacctgttacatagtacacagtaagggttctgttatcattacccagagaagcggatgaaattgtccccattttagacatggagaatctgaagtacaaagaggttgtctccgtacagaaagagcatttggtgattaagtgctagagatacaggatttgaactaagcgcctgattttaaagtatgtcccacaacattaggctttctcctatagccctcacctgtccttaggtcacacagaactttaggtacctcatggcgtgagatggagcaggtgactgacagctccttgtgccacccatgcagataaataacactggtgtgtcactgtcaagattaagggacaggaattcgagagactgcatgagagatcagaagatgaagaagcgggtaggcaaaagtattctgtttggggaatagtaaatagaattaattaaatcaacattttgttagctgggctgcttatactgtcagacagtagcttataatctactgggaagaaatgaaatttctgggtcctgtgtcactttcaatgccactcaccatgacaggtaccttataagtatagtttacagtcctatcagtaacctggagaagtagttatttccttcgttttactgaggaaaccaagagttaaaaaatcaggaaaagtgttagatgtgcagtagaacatcatcatgctgggaagttctacacatccgcttcaggacaggtggtattacctatgagcaggaagggaagggaaaaaggtaaggggaatgagtgatagtttattgttttgatttttaaatttttatctgttttttcctttttcatagtcattcctggaatgagtgagtttgtttttgtttttgtttttgggggatggagtctcgctctgtcgcccaggctggagtgcagtggcgcgatcttggctcactgcaagctccgcctcccgggttcatgccattctcctgcctcagcctcccaaatagctgggactacaggcacccaccaccacgcccagctaattttttgtatttttagtagagacggggtttcactgtgttagccaggatggtctcgatctcctgacctcgtgatccgcctgcctccgcctcccaaggtgctgggattacaggcgagccaccgcgcccggccatgagtgagattttaaatatatctgaaatgaggccaggcacagtggctcacacccataatcccagcactttgggaggatgaggcgggcgaatcacctgaggccaggagttcgagacttgcctcaccaacatggcgaaactccctctctatagtaaatacaaaattatctgggcgtggtggtgtgcgcctgtggttctagctactggggaggctgaggcacgagaatcgcttgaacccaggaggctgcagttagtcaagattgcaccactgcactccagcctgggtgacagagtgagagtccgtcagtcaatctacctgaaatgttttatgcctttaaaagagagagaatagggccgagtttaactttttaaatttggttggtgggtacatgggtgtaattctattttctgtatctttatgtaagaaatattaaaaattaaaagatatacatatatattttaatttacatatatatgtgtttttttctaagagaaaaatggatagaataaagaggtccaagataatcgtagaataatcctaggacttcagtgctgaaagcccctaagggtctccactacctgtaggataaaatctaaactccttggcatgataccagaggcttttgagcattctgtatcgctaacacatactattctacctcagcctttgtaccactagttcatagactactcttcttcacaacctcagtcctgtctgtaaagttccacttgtccttcaatatccaattcagtgttctttgaaaagcttctctatcatttgcctgtttttccttaatctgggaagccatagtcttttaagaaaagacttgattgtcagacttatctcgttgcattgtaattatttgttgacatgtctattttctgctagtctataagctccttgaaggcagtaataatgtctttcccatctctgtacttcagtgcctaccatgatgcctggcacagagtagtcactgtagatattagctgaatgaaaaatacaagttgaagacagagagtgaaagttcttggagttatgacatatggactttgttctctggaatgacagggaactattgagtttactttctttaaaaattcccgtattttattgaaacatattctcaatgtcaagaaaaatattccagtcataatcctatctttcaaacacttgaactatttttattttccatgagtcctttccaaatttcagctataaaattagttatacagatttagctatacagatttcttaggtagctgtagccttaatgtattcataacttagtgtttttcttttttctttctttttaaacctgacacttgaggaattttttttttcttttctttttttttgagatagggctcactgcagctccagcctcccgggctcaagtgatcctcccacctcagctgggagtacaggggtgtaccaccatgcctggctaattcttgtatttgttgtagagatgggcttttgattttttgtagagatagggtctcgccgtgttgttcaggctgatctcgaactcgtaggctcaagcagtttgcccacggagtgctgggactacaggtttgagcccaccgcacctggcctgcttttttcaatattaaattatttcctggctgggcgcggtagcacatgcctatgatcccagcactttgggaagccaaggttggggattgcttgagcctgggagttcaagaccagcctgggcaacatggcaaaaccccgtctctaccaaaaaataaaataaaaatctaaataaattatttattttagtgaatcagtctttatgcttgtcatttgtcttataaattttcgcaatattcctctctctttggtttaataggtatgaaatgatgctccatgttattattagaaaaatttcacaattttttcataaatttacttagtgtctgtatattctggtgagctgttgtgtttatattccctgaacatttgttcactggaactggatgttctttatgtgtttttaatattaatcatttatctgttatttgttgctaatttttcttttcttttttctttttttgagatggagtctcatcctgttgctgaggctgaagtgcagtggcgtgatctcagctcactgtaacctccgtctcccgagttcaatccattctcctgcctcagcctcctgggtagctgggattacaggcacccgccaccacgcccggctaatttttgtatttttggtacagatggggtttcaccatgtcaggctggtctcaaactcctgaccttaggtgatctacccactttggcttcccaaagtgctgggattacaggtgtgagccactgcatccagcctaatttttcttttaaaaatatttttattggccgggcacagtggctcgcgcctgtaatcccagcactttgggaggcctaggtgggcggatcatgaggtcaggagttcgagaccagtgtggccaacatgatgaaaccctgtgtctactaaaaatacaaaaatcagctgagcatggtggcacatgcctgtaatcccagctacttgggaggctgaggcaggagaatcacttgaacccaggaggcagagattgcagtgagccgagatcacaccactccactccagcctggcgacagagcaagactgcatctcaaaaaaaaaaaaattttctttattatgacaaccaagatacatttgtaaaaatatacataatttcgctggaaaccaagagttaaagtggctcacgcctgtaatcccagcactttaggaggctgaggcaggtggatcacttaagggcaggagttcgagaccagcctggccaacagggtgaaaccccatctctttttttttgagacagagtctcactctctctcccagtctggagtgcagtggcgcaatcttggctcactgaaagctccgcctcccagcttcatgccattctcctgcctcagcctcccaagtagctgggactacaggcacctgccaccaggcccggctaattttttgtatttttagtagagaccgggtttcactgtgttagccaggatggtctcgatctcctgacctcatgatccacccacctcggcctcccaaagtgctgggattacaggcatgagccgccgtgcccagcaaaaagcccatctctactaaaatacaaaaattagctggccatggtggcccatgtctgtaatcccagctacttgtgaagctgaggcaggagaatcacttgaacctgggcagcggaggttgcagtgagcctagatcaggatcacgccattgcactccagcctgggcaacagaatgagactctgtctcaaaaaaataaaataatttaaaaaaagttacataatttaaagaatagttacaaagaaattacaaagtttagttatgcataaaaattatattgtattcatggtaaattgaagactcattataaaattatagttacacataactatcatctagatcaagaaagaaatagaatattaccaggatcccaggaccccagaagtgtatctttctgatacctcctccctatgttagggataactattgtcccaattatgtatttatttattttgagacggagttttgctcttgttgcccattctggagtgcagtggcgcgatctcggctcactgcaacctctgcttcctgggttcaagcaattctcctgcctcagcctcccaagtagcttggattacaggcgcctgccaccatggctggctaattttttctatttttagtagagacggggttacatcatgttggccaggctggtcttaaactcctgacctcaggtaatctgcctgcctcggcctcccaaagtgctgggattacaggcatgagccaccgctcctggccctattgtcccaatttttgtgataatgcttttcttgtcttcatagtttgccctgatctatacatctataaataatatagctcagttttgcctggttttgagctctgtaaatgggataatactatatgcattctactgagtctttctagtttgcgttattatgtttgtgagattcttccacgttgtagatatagtttttcttttctttttttttttttttaatagtaattttggctgggcatggtagctcacttctgtaatcccagcactttgggaggctgaggaagcaagatctcttgaggccaggagttcaagaccagtctggcaacaatgggagacttgtctctataaaaaatttaaaaaattagttgagcatgatgtcatgcacctgtagttccagattctccagaggctgaggcaggaggatcacttgagcttaggagtctgaggctgcagtgaactatgattgtgccactgcgctctagcctgagtgacagagcaagaccttgtctctaaaaaaaaatttttttaaattgtttttcttaacctcttaacagagttttacatgtatagtaccacacagccacaatgttgtatggcagatctctagaatgcgttcattttgcattactgaaactttatactttttgattaacaactccccatttcctgaaagcccctaccctggcaaccactgtgcccctctttgcttctatgagtttgcctattttagatacctcgttgcagtggaatcatgtagtatttgtcctgtgactggcttacttcactttgcttaatggcttcaaggttcatctgtgtcatctcatgttgcaggattttttttttaattttttattatttaacttaattgtattgtattttattatttttcagacagggtcttgctcagctatccaggctggagtgcagtagaatgatcgttgctcactgcagcctctaactcctgggctcagatgatccttctgcctcagcctcccgagaaggtgagactacaggagtgtaccaccatgcttggctaacttttttattttttgtagatactgggtcttgctttgttgcctaggctggtctcaaactcctgggctcaagcgatactcctgccttggcctcccaaagtgctgggattacaagcatgagccacttcatctagtcaatttttttctttttaaaggctgaatatttcattctatgcgtataccactgtaaagaaaactccatttcctctctactctgtacccatataataattcctcacttctgtcaccaaatgtgtggtgttttttttccccacaatagttcagttctttagcagacactgggtgtcctacatttagctcaggtctgacactaactgccaggtgttagtgcagaccccaaatgttaagtcctccctgtccacccgcattccagaccccccacttcagactacaagcacaagtggtaagtcctccacattcagtcacagaacagtttccttactagattatcagcttattataaacaactcagaagcagccagctggaagaaatacacaggacaaggtatgtgggaaggggtgtggcacttccatgccctctccaggcacaccagcctcccaccatctctacatgttctcaccaacctagaagctccctgagccctatccttctgggtttttacgtaggcctccttacctagacatgattgattaaataattggccattggtgattaagtcactccccagcccctttgtcctacccagaggaagttttgttttgttttttgagaaggagtctcactctgtcgcccaggctggagtgcagtggtatgatcttggctcactgcaacctctaccagctgggttcaagagattctcatgtctcagcctactgaatagctggggttataggtgtgcaccatcatgcctggctaatttttgtatttttagtagagagagcgttttgccatgttgtccaggatggtctcaaactcctgacctcaggtgatctgcccgtctcggcctcccaaagtgctgggattacaggcataagccaccacgcccggcccccagaggaaggttttattgaattaattacaaactgataggtcaaagagtgtgtatgttttaccttactatgtaatactaaattgttttcaaaagtgcttgcactcccaccaatgtattagattttccgttgctctgcatgctggctaatactttatatttacatttttattttccaatctggtatattcatgtatagtagtattttctggtagcattcatttctctgattattagtgaagatgagtaccctgatgtgtttatgggctatttcctcttttttacagtccctttttttttttttgaggcggagtctcactctgttgcccaggctggagtgcagtggcaccatctcggctcactgcaagctccgcctcccgggttcacgccattcacctgcctcagcctcccaagtcccaagtagctgggactacaggcgcccgccaccatgcccggctaatttttttttttttttggattgttttagtagagacggggtttcactgtgttagccagggtggtctcaatctcctgacctcgtgatccacccgcctcggcctcccaaagtgctgggattacaggcgtgagccaccgcgcccagcctacagtccctttttttctgtcttctctattaagttgtctctgttttatgtacatataaacatatttatatatagttatctacatttttatatatacgtacatacacatttacataggtgtagcagatatcttctactttggctttttaagtggatttaacataattttagtcaatgactttttttatttttacatttctttaaagtgacataattgtaccccaacaatttatggggtacatagtgatattttgatacatatactgtataatgatcagatcagggtaattagcatatctatcatcttaaaacatttatcatttctttgtgttgggagcattcaatatcctccttctagctatttgaaactgtatagtacattattgttaactgtagtcatcctgtagtgctacagaacaccagaacttattcttcccatctagctgtaattttatattcttttctttcctttttttgagatgaagtttcactcttgttgcccaggctggagtgcaatggcacaatcttggctcactgcaacctctgcctcctgggttcaagcaattctcctgcctcagcctcccaagtagctaggattacaggcatgcgccaccatgcctggctaattttgcatttttagtagagacggggtttctccatgttggtcaggctgatctcaaactcctgacctcaggtgatccacccacctcggcctcccaaagtgctgggattacaggcatgagccaccacacccagccaattttgtattctttaacaaatctgcccctacccttcccagcctccagtgtcctctgttctagattttacttctatgagagcaacgatttttaggttccacatatgagtgagaacatatggtgtttaactttctgttctttattccacttaacacaatgtcctcaggttccatgttgctgtgaataacaggattttattcttttttatggctgaatagtattctgttgtataaatgtactataatttttttattcattcatcgcttgttgaacaccttggttgattccgtatcttggctattgtgaatagtgctgcagtaagcatgggggtgcagatgtctctttgatatactgacatcttttcctttggataagtgttcagtagtgggtttgctgaatcatatggtaggtctatttgtagttatttgaggaacttccatactgttctccatagtggctgtactagtttatattctcaccatcagtggaagtgtaagagttctcttttctctgcatcctcaccagcatttgttattttctgtctttttgataatagctttcttaactggggtaggatgatacttcattgtgtttttgtttttgtttttttaatttttaaaattttttgtagagacggagtcttgctgtgttgcccaagctggtcctgaactcctagcctcaagcaatcctcccgcctcagcctcctaaagtgctaggattcaaggcatgagccactgtgcctggccctaattgtggttttgatttgcactattttttttaacatcttttattgtgaattattgtatgttatatttcatagatataacttgtacgtgaatgagctaatatagtaggcctgaaactgttaccttcagaaaagcctgcttgcaaaattggtccctggctgtgtctgagaacttggcttttgaaacctttcctacactgatcaggttgttttactaatacctgttttccttctgagagtctgaaattttggtgggaggaaggtgcctaagtgaccagccctcaataaaacccctagattcagagtctctaaccagcttcttttgggcagaaacattgcacacacatagctgcattttcactgagagaacatgcactttctcaggggttagagagcattggaagcctgcacgtgaattcctacagacactacctgatgtgtttttttttcccttgctgatctggttgtgtatccttaaagtgttgatgatataataaatgttagctgtgagtacaactgtacactgagtcccatgagttcttccagcaaaatattgaacttagctgttaagttcctccagaaaaaaaaaaagctggaattttgattagaaatgcatcaagttatagatgaatttgaggagaattagcatctccatatcgtcttccaatgtgaatgtggttcatatgattgtttcctccctccttgacttctcttaacgactttcaattttcttttctttttttgagacagggtcttgctctctcacccaggctagagcaagtggtgcaatcacagcttactgcagcctcaacctcctgggctcaggtgatcctcccacctcagcctcctaagtagctgggaccataggcacatgccaccatgaccaacaaatatttgtatttttgtagagacagggttttgctgtgttgcccaggctgctctcaaactcctgggctcaagtgatctgcccaccttggcctcccaaagtgctgggattataggcatgagccactgtgcccagcccaattttctgaatagatatcaaggacataatttgttagatgtatttttaggtatatattattttctttaaattttttttgagacagggtctcactctgtcacccagactgaagtgcagtggcgtgatctcagctcaccgcaaccaccgccttccaggctcaagcaatattcctgcctcagcctcccgggtagctgggattataggcacgtgccactactgccaccacgttcagctaatttttatatatttagtagagacggggtttcaccatgttggccaggctggtctcgaactcctgacctcaaatgatccacccaccttggcctcccaaagtgctgagattacaggcatgagccactgcacccggccgggtatttaaatttttgatgtcatcttaaaaagttttctgacattttattttttgtttattgatgatatagaaaaacaatttatttttgtatattgaccttgtctccagcagtcttcctaaacacactgtcttagttttctatagctgctgtaataaattaccataaacttagtggcttaaaacaacatagaggccgggaacattggctcatgcctgtaatctcagcagtttgggaggccaaggtgggagtatcgcgggagcccagaaattcgagaccagtctgggcaacacggtgagtccctgtctctgtttaaaaataacaataacacacggtagctcacacctgtaatcccagcactttgagaggccgaggcgggcaggtcacctgaggtcgggagtttgagactagcctggccaacgtggcgaaactccatctctactaaaaatacaaaaattagccaggcatggtggtacgcgcttgtaatcccagctactcaggaggctgaggtaggagaattgcttgagcccaggagacagaggttgcagtttgccgagatcgcgccactgtactccagcctgggcaacaagagagaaactcagtttcaaaataaataaataaaataaataaaaacaacaacaacatagatttattatcttatagttctgtagttcagaagtctgaatgggtttcattgggctaaagtcaaggtgttggcaggctgagttcccttctggaggctcaagggcagaatccatttccttccccttttcagcttttagagactattcgtattccttgactcttggctttcctcctccattatcaaagccagcaactttgagtcctcctgaagttgccatctttctggtctgtcatcttatttcctcttccacttaaaaagacacttgtgattgcattgggtccatctggttagtccaggataatcttcctattttaaggtcagcttattagcagtcttaattccgtatgacagtaattcacctttgtcatgtaaccaagcatattcacaacatccaaggatcaggatatagacatctttggatgggtatgggagatggggatagtggtggtggtcacattattttgcctcctgcattcacttaagatttttatttttatttttatttttatttttgagacgaagtctcgctctatcgcccaggctggagtgcagtggcgtgatctcggctcactgcaacctccgcctcccgggttcaagcgattctcctgcctcaacctcccaagtagctgggattacaggtacgcgccaccatgaccacctaatttttttcttattttttatttttagtagagacagggtttcactatgttggccaggctgatctcgaactcctgacctcgtgatccacccacctcggcctcccaaagtgctgggattacaggcttgagccactgcatccagccaagaattttaataatttaatctgaagattcttttagatgttccacacacaaaattatagcctttgtgaatattaatgattttacatctttccagttaacacgccttttatttattgttcatgatctactgctctggcttggacttccagtatatatctgataaaagtattgatagtgggcattctggaattgttcctgatctaaaaagaaaagtttcctaaacttcaccttactgtattctctctgtcaggttatagaagttcctttctattcctgtttgataagagttgtgtttttttttgttgtttatttttgaggtggagtcttgctctgccacccaggctggagtgcagtggcgcaatcttggcccactgcaacttccgcctcccggttcaagtgattctcctgtctcagcctcccaagtagctgagactagaggctgcgtcactgcgcccagctaatttttgtattttaggtagagacagggtttcaccatattggccagactggtctcgaactcctgaccttgtgatctgcccgtctcagcctcccaaagtgctgggattacaggtatgagccaccatgcccggcgtgataagagttttcattatgaatggatttcactgtgaatggatgtttgattttatcatatgcttattctagaagtcttgagacgatatggttgttcagctttaatgttgtggtgaattatattaattgatttttaaatgttgaaccacttctgagtcattttttagacaacacaacttggtctcggtattttttattttatttatttatttatccttttagacagggtctcactctgttacccaggctggagtgcagtggtgtgacttcagctcactgcagccttgatctcccaagtcatcctcccatctcagcttcccaagtagctgggactataggcaagtgtcaccatgcccagttaatttttataaatttttgtggagatgagatttaatcacactgcccaggctggtctcaatcctgggctcaagcaatcctcctgccttggcctccaaaagcgctgggattataggtgtgagtcatcatgcccgtggctcttggtgtattttatacatggctagatttactttgctaacatattgtttgggacttttgcatctacatttatgaaaaagaattagcctggagtttttcactgaggagttgcccttacaggacttagtatcagagttatgctagcctcacagaatgagctggggagttggttctttctatattttggaatcgtttatgtaaaactggaatattttactgccataagtgcttagaagaactcacctgcgccactctggtcttgatgctatctttgtgggtagatttttgaccatcaataggacttctttaatggttataaggctattaggttttctgtttatttttgagtgagttttgataagttaatttttaaggaatgtgtccatctcatctaaattttaaaatttattgatgcaaagttgttcataacagcctaatgttatcttttaatgtctatagcatatgtaattaaatctcgtctttcaatctcttcttttttgtctttttacagaacaaacttggtttattgatcctctctattatatatctattattttttactcttaaaaatttttttaaaaatctatttatttatttattttgagaccggtttatgaaactggctaatttttgtatttttggtagagatgaggtttcaccatgttgccaaggctggtcttgaactcctggcctcaagtgatccacctgccttggcttcccaaagtgctgggattacaggcatgagccaatgcgtctgaccctcttctctttaaaactgcctcccttctattttcatcaggcttattttttcagtttcttttctaataattagggtcatccattttcttgtaactacttctttagttgcatattagatatttttatgtgtagatttccattattcagtttaaagtatatttgaatactcactatgatatcttacttgactgatggcttattcacaagtatatttcttgattttcaatacaaagggattttctagatctcattttctttattttgaaattttaaaaatctacagaaaagaaaacctacagaaaagttgaagaattagtgcagtatatcatcttcccaagtaaacaatttacattcataaaaatagttcatatattaggtaacaaggaaaacattagtaatttcataaagtagaaatattataattctgatcaccatgcaacaaaactagaaattaaaaatgaaatttataaaaaagcagaaaggcccttccatctggaaaattgaaaacaactattggatgtaaggaaaacagaaactgaaataaaggatttctgaaaattaacgaaatgaaaacacagcatatcagattcttaaaaaaaaaaaaaaggtaaggcactagtcaggggaaaatttataatcttcagtacatattataaatgaagaaagggaaataatgaaataaattccaaacttagaaagttaggaaaagaaaaacaagtaaatcgaaagcacaagagaataaataataaagataaaaagagaaattagtaagagaacaggaaaacatctgattcaaaaattaagatttttatcttggctgggcgcagtggctcatgccagtaatcccagcactttgggaggccgaagcaggcagatcacgaggtcaggagatcaagactatcctgtccaacacggtgaaaccccgtctctactaaatacaaaaacttagccaggcgtggtggcatgcacctgtaatcccagctactcgggatgctgaggcaggagaattgcttgaacctggaaggcagagtttgcagtgagccgagatcgtgccactgcactgcagcctgggtgacagagtgagactatgtctcaaaaaaattaaaaaaaaaagatgtgtatcttgaattgtttaatgaagcaaataaattagcctaatagaaattacaaatatacagaataagaaatggtaagtggtaagtaaccactgacacaggatagtttttataacaggattaatttatgtacctttacgtaaacaaatttgaaaactaaaatgaaatggataattatgtgtgaaaatctagtttaccaaaattgactcaagtagatgttggaagttaaatagctcaatttccattgaataagtttttaaagttatgaaataactgtctcactgaaaaataaaaaacatgaggtccaaatggtttaacaggaaaattctactacatttatggagtccaaataatcctaatgctaaataaattgttttagaacgtagaaaagaaggaaaacttccaaattctttattttccaaatggcttggtattgtaaatgctgatttagttgtctgtctccagttgttgaagggctgaagtgaaataaagtaaaacatcttaaaacactttttagttcttagaccctcttttttaaagtagctttattgatatagactgcacgtatttaaagtatacaatttgttcagttttgacatacacacatcatcaccataattcagttaatgaacatatccatcactctcaaaagtttcctcatcccccttaattctgccttcttgctctcttcttgccggtcaaccacttatctggtttctgtcactgtagaataattagcatgttctaggacttttaataaatgttataatacagtgtgtattcttttgtatctcacttcttttacacagcataattattttatatcggtttttatgaagcaagtataaaacaaatatttaacataaaaattaaaggtagcacaaagaaaattacagatgaatattatgtataaaaattatgtaaaagttctaaataaaatactaccaaacagaacagaatccagcactctattacaaaactattagctcatcaccaagatgtataccaggaatgcaaagatggtttaacattagaatcatcaatgtaattcaccatattaattaacctaaggagaacagtcatatatttacttttatatatgctgaaaaagcctttgacaagattcaacaccaatatatagtaaaaactcttaagaaattatattgtaatcaatacttctttttttttttttgagatggagtctcaccctgtcgcccaggctgaagtacagtagcatgacctcagctcactgcaacctccacctcccaggttcaagccattctcctgcctcagcctcccaagtcgctgggattacaggcgcccaccaccacacctggctaatttttgtatttttagtagagatgcggtttcaccatcttggccaggctggtctcaaagtcctgacctcaggtgatctgcccacctcggcctcccaaaatgctgggattacagatgtgagccaccatgcctggccaatcaatacttcttaatgatggtattctctctctctctctctgtctctgtctctcacgcacacatacacacacacgcgcgcacgcacgcacacacacacacacacacgcagagagagagagagagagagagagagagagagagagactttattcctaaatcctgtattttatctaataggaaaatactagaggcatttttactaagattgagaaaaatatagagatactcaccaactccacttgtatttaacattgtactgggggcttagccaatgcagttagataaatcaattagaggcacaagatttggaaaataaaaagtaatattgtccctacttgcaggtgatatggtagtgtgtctggaatactgcagaaaatcaataatgaaactaactaaacagaaaaggaattttataagaatatgcaaaaatcagtagtcttcatatacacaacaagtttgaatatataatgaagggtaaaatcccatttacagcaacaagcaaaagagaacatatttaggaatttaaaaactatgtaaaacctaggtgaagaaatctttaaaacacttctgaataacaaaaatagccttaaacaaatgaaatcttttgttctaggacaggacaacaacatcataaaagtgcctaagttaatatatatatatatatatatatatatatatatatatatatatatatatatttaagttaatacatatacctaagttaatatataaatttaatgcaatctcaatataaatatcaacagagttctggcactagacaagttgattctaaagttcatatagaaaaataaacatataagaataggaaaacagaagagctacaaagagaaagtagacttccagatattgtaacatgttgcaaagcttctatcatgataatattgtggtatagaccaatggtatagaatggaaagtcaataattagtctcctaaacacatgaagaatttagtgtatgataaaggtagttctgaaattattagggcagagatggactctttaataaatagtgctgggacaacttgttagccacttgaaaaaacaaaattatatctatactttatatcagacacaggaataaactccaaatgaaccagaaatctaattttttttaaattacctactagaagaatacatagatgagttttctgtaacctggatgtggagaagggcaataaaagagggggaaaaattggctacattgaaaagcaaattcttgattacaaaaatgaaaaacaccataagcaaatttaaaagatagatgagaaaccaggaaaaaaatctgcaaaatacattttaaagacctactatccctagtctaaattgagagaaaaaaatactaaaatttggttaaaaaggcagaatacatgagcagatacaattttttaaaaagattcaaaaaccatccttaaatatgtgaagaaaatattcaatttcacctaaacaggaagtgtaaatttaaagctgcactgaaataccgtttctcacctatcagctctgcactaattagaaagcttcacaagaagccccattggtgaggctgtgaggaatgcaaacttgtaaaacctcctttgagggagaagttggcaatccagcagactacacatgcatttgccctttgacccagccattccacttgtagaaatattccctaaagatacattttcttttctttctttcctttttttttgagacagggtcttgcttgttgcccaggctgaagtgcagtagtgtgatcttggctcactgcagctcaaactcccaggctcaattgatcccaccttggcctctggagtagctgggaccacaagtgcatgccaccacgccttactaatttaaaaattttttttatagagacggagtctcaccatgttgcccaggctggtcttgaactcctggactcaagcaatcctgtctctgcctcccaaattgctgggatgacaggtgtgagccaccgtgcccggccttacgttttcaacagtagggaaatatgaatgcacaaagttatttgttgcagcattatttgtaattgtaaaatatcagggaataccttaaatgtccatacaggaaatttgttggtaaatatctacacaatggagtactgtacagctgtaaagaagaatgaggaaaatctttgcaaacgggtgtagagtgatttctaacatgaatggaaagcgtacatacagtgtgctattttttatgtaagaaagaagggaaaatatgagactctaatgtctgcttattttgcaaaaagaaaaacaggaaagataaatcagaaattattgaaattgataacccacaggaagtagatggcaaaggatggagagggaagaacacttctctgtggggaaaaacagtcttttatgtagttttaacttttagaactatgtaaatgttttatatattcaaaaatcaaatccacaagaacagtacaaacacaaactaatctaattcaaatgatgaatgtaatcaccctgaaggtgaggtgggactgaccaatcaagtaacttttgaatatagtactttaattatgtacccttaatctgaagaaagaaatgcaactgaattttgaactcttcttagtaggttttttttttttagtgacaggagtgtagcaatttgaaattacttcctatagtttcagattgaataaatgaataaatatatgatggttttttctatgaattttaagatagatggatagatcaatggatgtatagctgtagatacagaaatagatagaagtgtttatatttcctagatctgtctactaaaagggcctaggagcaatgatatgcaagtagcagatcatatctaatggccaggtcttagattttaaagatttttcctcattaaaataaatgaaggctgtttgaggaaatggtgattctatggctgaagcaggaaaagtaaatgaagaccatgaatgttgtgccaggtaataagaaagtgcctgatgggaacactttaaaggacagaggaaccaatggattaaagaagaaaacaagagacattagagtatatcttgagacaatgaaaacgaaaacacaacatgccaaaactcatggaatacagtgaaagcagtactagaaaggaaatttatagctacaaatgcttacattaaaaaagaaagatctgaaatcaacaatttaacttcacacttaaaggaacagtaaaaagaacaaaccaaacccaaagctacagaaacaaggaaataataaatattagggcagagataaacaaaacagggactagaaaagcagtagagaaattgacaaaacagaattgattctttgaaatgataaaaaaattgataaaactttagccagatggactaagaaaaaataagacaaattactaaaatcagaagtgaacaaggggacattataactgatttacagaagtaaaaagatttataagagaatattgtgagcaaatgtatgccaacaaatttgataacataaatgaaatggataaattcctcaaaacacataaccaccaagacagaatcatgaagaaacagaaaatctgaacagacctataactagtaaggagattgagttagtaatcaggtatcacccaacaaagaaaagctcagggccagatggcctcactggtcatttctaaccaatatttaaagaagaattaagtccaattttcctcaagctcttccaattaatgatatatttgataaagggttaatacccaggatatataaagaactcctcagcactttgggaggctgccgggacgggagaatttcttgagcctaggagttggagaccagcctaggcaacatggtgaaaccctggctctacaaaaaatttaaaaatttgccaggtgtgatggtactttgctgtggtcccagctactccgtaggctgaggtgggaggaccacttgagcccgggaggtcgaggcagccgtgagctgttgcactccagcctgggtgacagagtgaaaccctgtttcaaaaaacaaaacaaaacaaaacaaaacaaaacaaaacaaaaactcatacagctcaacaaataacccatttagaaaatagagaaaggactcgaatagacacttcaccaaagaagatatacaaatggccaataagcaaatgaaaagatgcctattatcactaatcattagagaaaggcaaatcaaaaccaggagataagacctcacacctgttagaatgcctgttataaaacaaaacaacaaccagaaaataacaagtgttgctgaggatgtggagaaattaggatgtggaaaaatgggaagccctgtgcattatttatagcaatgtgaaatggtgcaaccactgtggagaacagtgtggtggttccttaaaaattaaacataaattaccatatgattcagcaattctcaaaaagatatttgtacacccatgttcataacagcattattcacaatagccaaaaggtggaagcaaccctaacgtccttgaatggataagaaaatgtggtatgtatctacagttagatattattcagccttaaaaaggaaggagcggccaggcgcggtggctcacacttgtaatcccagccctttgggaggctgagacaggcagatcacaaggtcacaggttcaagaccagcctggccaacatggtgaaaccccgtctctactaaaaatacaaaacagaaaaattagctgggcttgatggcacgcacctgtaatcccagctactcaggaggctcgggcaggagaatcacttgaacccgggaggcagaggttgcagtgagctgagattgcgccactgcaccccagcctgggcaacagagcaagactccatctcaaaaaatattaataataataaaggaaggagcctggcatggtgactcatacctgtaatcccagctactccggaggcagaggtgggaggatcattagagctcaggagattgaggctgcagcgagctctgcacacaggaaattctgacacatgtctcacaacatagataaagcttgagaacactgtgctgagtgaaataagccagtcccgaaaaggcaaatactgtatgattccacttacagtgtgaatacattatgattcccatactgtatgagtctgctgatgacaaactattgtttttttgataatctggaagtgtctctatttcttgtggcattttaaataacagctgtattgtttttaaattattatttgtttatttttttgagacagggtcttgctctgttgcccaggttagagtgcagtggtgcaatcacagctcactgcagcctcgacttcctggttgagcagtcctcccacctcagcttcccaagtagctgggacaacaggcatgcaccatcattcctggctaatcttttgtattttttgtagagatggggtttcaccatattgcccaggctggtctccaactcctgggctcaagcgatccccccgcctcagccttccaaagggctgggattacaggcatgagctactgtgtctggcctgaatgacaggtctattgaaatacattacacatataaaattcacccattaaactgtacaatccaatggctttgagtatattcacagttatgcaaccatcaccgcaatcaatgttggaacattttcatcagcccacagagaaatttgcataccccttgccatcatccccaaatcctctcatctttcccaaccctaggcaatcagtagtctacactgtatccatggatatgtctattcttatacatttcatataaatggaatcatacactagttcatcttttgtggctggattctttcacttaacataatggtttcaaggctcgtcattactgtagcatttatcagtactatatttttttgtgtggccaaataacattttgttgaatggatatacacattttatttatccattcatcacttgatggacatttgagtggtttctgaatttggctattgtgaataatgctcctgtgaacaatttgtgtacaagtatttattttgagtacccatttttcactctttcgcatatatagctaggagtgaaattgctgggttacatggtgatatggtttgcctgtgtccccattgaaatctcatcttgaactgtggctcccataatccccatgtgtcatgggagggacctcgtgggaggtaattgaatcatgggtttttcccatgctgttcttgtgagagtgaataagtctcacgagagctgatggttttataaaaggcagttcccctgcacacactttcttgcctgccaccatataagatgtgcctttgcccctcctttgccttctgccatgattgtgaggcctccccagccatgtggaactgagtccattaaacctctttttctttataaattacccactctcaggtgtttcttcatagcagtatgaaaatggactagaacacgtggtgactatgtttcgttttttgaggtactgcttgactgttttccaaagtggctgtgccattttagagtcctaccagcagtgtatgagggttctgatttccccacattgttgccaacacttatctgttgcttttattatagctactttttaaaaataacagctttattgagatataattcatataccatgaaattcacctttaaaaacctagtgtacaattcactgcccttgatttgtgaaagatattttttctgggaaaagaattctgggttaatttctatcagcacatcgaagatatcattccactgtcttttgattttcatttttgctaaagagaaatcaattttttgtccatatggtacactgatatatttgggtgtggatttctttttatctctgcttggaattttttggctttctcaaatctgaaggttagtgtctttaattagtcctggaaaagtcccagctgttatcttttcaaatattaattcttccctattttctcttctttctggaactctggctagatttatgttagactttctactctgtcttccatgtctcctaacttctcatattttccatctgttttctctatctctctgtgtgtgcatctattaagtcaaaaactatgaagggtctgagattttaccctacatttatagctatatttatctttagccacttttctgaagttctaattatctattgttatgactgattttctttgggttgtattggtatattatcaagttgtctacatataatgataatctcatctcttctagtatttcctttttcgaatatttttgcattggcaagagcatccaatatgggagtgaaaatgagagaacaatattgtttttgctgttgtttttaatggattcacccctagtgtaaaatatatggtatttgttggttctagattttaaacacttgtaattttgtgttttaatgtgtttgttagacatggtttgagttttattaggtgccttttcaaaaatgcattgataatacatactgtgtgattctatatatatgaatcaagaagtttaagaaaccatgaacgaagagaacatatgacataaaattctgtcaaaaatctctctttgtctagaaattgtgtttgatgtttaattttatcagagaacagaaagttgcttgccccagtgccccagttaaggtaaagctgaggttcataaatacctcaacttaaaaaaatacaaaaagtagattttttgatcgttcttagttaggctcaccacctttgccccagggaaagtaactcctcccctttgaacagtcactgagtgaggcttacagagcgacgctctgtttttcaggaaccaccccctaaaatctccacttttagcagaagactggaaacagaaacatctaaatgttacttggcactgaatgtcttggagtagtctttttggcagtctatcccttgatagactgaaatagccatctttgacaacaaaatgaataaaaagtaaggtttgacctagtcttaattttgatagatccccaaccagtaactttagtgtcacttatttcaaagaaaaggcactctttttttctgctgtgtttttctccatcccatgtctctctctctctctcttttttttttaaaggtttattgtgtttacttttattctttttttatttttgagacagggtctctgttgcccaggctggagtgcagtggggtgatcatggctcactgaaacctcgacctcccgggctcaaatgatccttcccacctcagcctcctgagtaactgggactacaggcatgtgccacctcactcagctaatttttgtgtttttttgtagagacaggtcgtactttgttgcccaggctgctctgcagctcctgggctcaagcgatcctcccgctttggcttcccaaagtgctagtattacaagtgtgagccgccgtgcccagcctatttgaaaaattcttaatagccagttttaaaggtaatgcttgaagcttacatttcctgtgactttttttttttttttttttaaacacagggtctcactgtcaccccagctggagcagtggcacagaattgctcactgcagcctcgaactcctgggctcaagggatactcccacctcagcctccctgagtagttgggactgtaggtgtgtgccaccatgcctggctaaagatgggatctccctgtgttgcccaggctagtctcaaactcctgggctcaagccatccccctgcctcagcctcccaaagtgctgggattataggcgtgagccaccgctcctggcctgcttatttatattcttttgtaatggcatgataacttctttcatatatgtaggagaaaattttaatcattttccagattgaacttgtgattcttgtggtcattctaattcataggtttatttttttagtttctggttgctcattgcacccagaaattgttcctttttttaatattgtgaaacttcactagcctcaatttatttgttttcagttaatttttctcctttatcactggtctttgttattgtggatgaacaattttttttaagagatggggtctcacagtgttgcccaggctatagtgcagtggctgtttacaggtgtgatcatagtgcactacagccctgaactcctgggctcatgcaatcctcctgcctcagcctcctgagtagctgagactacaggcatgttggtgaacaattttctttttgtgtccaacaattgtatcgatattttgatggagtatgtacagaagagacacccttatggttcttagtactcaccaacttcctgaaagcattcccactgaggattttgagtaagaaaattatgtactcattaccatacttcagaatatgattctggctggagggtgctacctcgtgaggaataaccaaagagcagtgcattttaaaagcaggaagaggtcccctggagttaaggttgactgcatgctagctgtgaatccatagtgtaatcactacagttataaaatagttaatcaaacaattgtactcctgggatggctaagtagacatataaaaccatgctgtggagtaatgtaggaaatctcttattaaaatatcatggctagttttgatccaaaaataagtaagttatggaaggaatgtgggaaaagggtaagtaatgatgccatagaccactttgttctgcttagtgtcattaagactgaagatctgtgtacctctgcctccttgtcagtagtctactttgttgatgttgaaattcttagagggcaatagtctgacttcactctttatcacttcgtatttattcatgtgggaaagactcccacattgtacaggaccttgaagaggggacgcctcaacaaaagatcaaggcttttattttttatttatttatttattttttgagacagagtctagctctgtcaccaggctggagtgcagtggcacaatctcggttcactgcaacctctgcctcccgggttcaagcaattatcctgcctcagcttcccaagtaactgggattacaggcacatgccaccatgcccagctaattttgtatttttagtagagacagggattcaccatattggccaggttggtcttgatctcctgacctcatgatccgcccacctcggccttccaaagtgctgggattacaggcgtgagccaccgtgcccagccaagatcaatacttttaaactggattccaaatggtgaagtgccctaggaaatgcagagattaaggtcttaaaatattctccattaaaaagaatcagggaggctgggcgcggtggctcacacctgcaatcccagcactttgggaggcggaggcaggaggatcccttgagcacaggagttcgaggccagcctgggaaacatggtgaaaccccatctctaccaaaaatacaaaaaaattagtggggcatggtggtgtgcacctgtggtccagctgtgtgggagggtgaggtgggaggaacacttgagctggggaggcggaggctgcagtgagtcaccactgcactccagcctgggcaacaaagtgagaccctgtctcaaaaaagaaaaagaaaacaagaattagggatgcttgacgaaatggccgattccaaatctggtgcaaaaaaatgcataaggtatgcctggaacatcttttgagaggaaagaagctctcaatgactcataaggttaagtcataaggactgaagagcccgcctgaaaagactcccactggccaaacatgaatcaatttgagaatcaataaggatgatcactgtattggattgaaacacacctaatatgtttaatccatgagttcataatgatactgaaaaaaaattcatcactatttgaaggtggtgaaagaatgaatatcattttttatttattattgttaatgtatgtaagggatacaagtgtagacttcttttttgttgttttttgaaacagggtcttgctctgttgcccaggctggagtgcagtggcacaatctcagctcactgcaatatctgcctcctaggctcaagcagtcctcccacctcagcctcctgagtagcagggaccacaggcccgcaccaccatgccaggctaatttttttatagttctttagagacagggttttgccatgttgcccagcctggtctcaaactcctgggctcaagcgatccgctcacctcagcctcctaaagtgctgggtctatgggcatgagccactgctgccagccacgtgaatatactgtatagtagtgaagtatgggcttttagtgtactgcatcattattttgaaacttacgataaaagtcttacagctggctacgcatggctcacacctgtaatcctagcactttggcaggctgaggtgggagaatgacttgagctcaggagttcgagaccagcctagtcaacatggtgagaccctgtctttaccaaacatttaaaaattagctgggttgtggtagtgtacacctgtagtcccagataactcaggaagctgaggtgggaggatcacttgagcccaagaggtcgaggctgcagtgagctgtgattgagccagtgtactccagcctgggcaacagatcaagaccctgtctcagaaagaaaacaaacaaacaaaaagtattcctgctaatgagtgaaagaagtaataacagaatcgaaatgtcaccattttggaggtggacttccaaaatggtggagtaaggacctcagggtgtatgtatagctgaaacaatattggatgagttgataattgttgaatctgggtgataggtatgtagggattcattccttccatctacttttttgggggtaataattaagatataattcacatgccagtgtgaattattcaatgtttattaaataactagctatattacctaaagcatgttaaagagggaaaagaagcagaaataattccttctggagaaagtgggacaaaagctgtattatgatcatgcttataaacatgaagatttctcaattggatgtaacttagtttcttctaaattctgattttcactgttatctaaagtcaagatggttgatagatatgggttaatgagtggaacacggcttatgcgaaacttcatatttctagaaatatcatctagtgttaaccctgcctcctaagatatatgctataaaataaaaatagatgtctagtaaaggtagggaaaagggtttatggggttataactatcagctaaagtgaggatttttttaactatgcatggattacagctaggatcttcctttagccccagtaattttaaggtggtttaagctgtttgttatcctgggctatagctcagcgttaccacagcttgttacacagagatataaatgtgcttggtaaacgtattctttcaggttgaaactagatgattatgaagcatagtatcttgctggtaaacctttgctctcattggtggtggtgttcctcctttccccagttctgcccttgtgcagaattcagttattcatttgttctttgggctttccgtgtgctttgatcatttcctcccacctcgctcccttccagctttcatttatccttccaggccaggtcccatttttctaaaagccctttcctaataatcccctccctaatgtcttttgtacttattttagcattgtggaggaagagagggggaacctggttattctgttattcaagtgagccttcagttagttgaagattatatatttcaagtgtcactagttgtaaatgtcaaaacagtctattgaccaaaaaaaaaaaaaaaaaaaaaaaaaagtcctattactctgggcacagttggaacaatgcctgtttgaatcaagtccttcctcccctcaaaaaacattgtgattaatgcaaagtacctaactccactgatttctttttccctcactttttaggattatggctgctgttcctcaaaataatctacaggagcaactagaacgtcactcagccagaacacttaataataaattaagtctttcaaaaccaaaattttcgtaagtgttttgactggtttgctgtcacataggcactaacttaccacattgtacacatgagatatcttctctttaaactcccccattgtacagatgaggaaatgaagctgagagattcattgattttcccactttgccaattaatggtagagtatgttttagcagcaccaggtgagattgtgtctcatctttgcatggttcctggcacataatatttgctcaataaagatttgttgagtaaatgaataattgatcttgtaaatttgggcaaataagtgttttttaagttttggggggtttttttgtttgttttgttttgttttgttttttcttttgagacggagtctcgctctgtcgcacaggctggagtgcagtggcgcgatcttggctcactgcaagctccgcctcctgggttcacgccattctcctgcctcagcctcccgagtagctgggactacaggcacctgccaccacgcctggctaatttttttttgtattttttagagacggtttcaccttgttagccaggatggtctcgatctcctgacctcatgatccacctgcctcggcctcccaaagtgctgggattacatgcatgagccaccgtgcccagcctttttttttttttcttttttgagacggagtttcgctcttcttgcccaggctggagtgccatggcacaatcttagctcaccgcaacctccgtcttccgggttcaagtgattctcctgcctcagcctcccaagtagctgggattacaggcatgcaccaccatgcctggctaattttgtatttttagtagagacaggatttgtccatgttgggcagactggtctcaaactcctgacctcaagtgatccgcccaccttggcctcccaaagtgctgggattacaggcgtgagccaccacgcccggccaattattttaatataattttatatactttcgaagaacagtttataaggaaactacagctctccagttctgcctctcctctaagctatactccagactccttctaatgatatctaataataatttatattataagtgatgcttttaccaggttgtagactttgttctgggtgcctggctttgaagtcaccactgactttgagatcattaaatccagcagatagccacgattcctgcgtcttttacttgtcctgcagattttaacagagttagcagtttttaactctttttcccctttaagttcttatcagagtagcaaaaagtagccatatttgaatctcttccgtttttcttttttctttttttttttttgagacagtctcgctctgtcacccaggctggagtgcggcagtatagtctcggctcactgtaacctccacctcctgggttcaagctattctcctgcctcagccttctgactagctagggcttcaggcatacaccactatgcccggctaattttttgtgtttttattagaggtggggtttcaccatgttggccaggctggtctcgaactcctgacctcaagcattccacctgcctcggcctcccaaagtgctgggattacaggcatgagccactgcacccggcctcttccctttttcatttatgctgtcaccccgctctggagatgctattaactaaggactactagcctgagaaataaagtagtgggaatgacctctcaaagccaaataattagcctctgaatgggaaggaccagagaacgaatacaatttaagttacctgataaatttaaaatcgagagagatggattctttgctcagttgggatacaattaatgtaacctgtgtgaattagtttaaaaaattagttttgtagagttggggggtttcttaaaatggatccatctaatctagtttttccattatttttcagaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagaggtaacaattattttatcttcattttagtatgttcattgtacttttttattcaaagctagccattgggaatagtcatgaatatatagagcttttgtccttaaggttgttagggtctttagtggtgctttttgaataatctgttggccacatttttgaggcaggacgtactgatgaaatggaaggttttagtctgctaatatagtttccaggatagctctgtgattttatacatgaagaaaatacaggagtttccccttgtccacagctttgcattctctgaggtttcagttacccgcagccggctgaggtctgaaaatattgcatcacttctcttgcgctttgggaccattattaagaaaacacaagccctgcaataccgcgacagtcaatctgataactgagaccactactaagtgattaacagcaacccaggtggacagatcaggtcggggcaagattttatcacactatactcaaaacagcttgaaactgaacacttatgaattaatttatttctgggattttccatttacatcacaatgcctacatcattcacctctcttcatctcatcatataggcattttttatcatcttatatctttacaaaggaagggtgagtagagtaagatattttgagcaagggagaccacagtcaaataacttttattgcagaatattgttataattgtgctatttcattagttgttcaccttttgctgtgcttaattaataaattaaactctatcataggtatgtatgtataggaaaacacatagtacttatcgggtttgatactatccgagatttcaggcatccaccggggtcttgtcacatatttcctgaagataagggggttgctgccgtaagatccatagaggttaaaatggtggttagtggtaaattggaaaatgaaactaagcctttctactgtaattcctttatggcttgttgccacctaatattgatgtataatgtgctctaattgcactattaaagtattataaattacattcaaagtttttcctggctagatcttgtaattatttaatgtccaaaattgagtaactgagattacccacatggggaagtaactcaccttatgaagcagttgcaaatatgagagtaaaatttttaaacccctgaatcccattaaggttactctagggtgagagagcactgaaaagtgattgacgataagcaaaactatagtctcatcaatgatgcctctgtttctgaagggaaaatttgttaaaagatagacagcaacaatttgggttgtgttttcccacatagtccaaaagagagacttaaataactgggaaactttgtgttaaagatgatttgtacaagcagccgtgtttgtgttattatcagacttatctgttgcactttacccttatttaaatatgagtgaaaagttaaaaactagaaacgtcaatagcaaatacgtgtttcgtaattaaccagagacagacatgaaaatccctaagcaaatcttcggcctcagtcgagcattcactggacttaatccacttgactcaatagtaatcatttatgaataaataagccagcattagcatgtaaagggagaggatccatacaaagtggtgtgattgtttgtgacttgccagaagcactcattcttaatcgctcatgccctgttctttctgtctcattagtggttaacaaatctatgtttatcaactgttttactgtagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttaggtaaactagctaaataattagcattattatttgtttctgggatactttaaattgtttaatttagtttataatatcatttctatataaaagtattttgtgctttctacaattattttacattcaagtgaaagcctcaaaaaaaaaccctgtttatacatttaattggttgcattctaaagatgaagtcccattatgattaattacatgaaacttcaaacaattttaggtagctgatttttttttttttttgagacagtctcgctctgtcacccaggctggagtgaagtggtatgatcttggctcactgcagcctccacctcccgggttcaagtgattcttgtgcctcagcctcccaggtagctggaactacaggtgcacaccaccatgcctggctaattttttgtattttcagtagagacgaggttttgccatgttgcccaggctagtcttgaacccctgagctcaggcaatccgcccgccttggcctcccaaagtgctaggattacaggcataagccaccttgcctggccttatatagttgattttgacataaggaatatatttctaaaaatattatatttccaaacctgacctgaaatgacacaaagctaacccattatatgggaagtgaattaggacattagtactttttaaaaaaatcctacaggatagaattggccattgtatttgttattcactcaattttagcaaattggtgacatgattattgttaattggtagtattacgagaaaaatagatactccacacgactcatcaacagcttaaattgctaagtgtcaatgttaccttcgtcctcatcccagtctcactctcagaccagttgagtggtagagtatagtatatactaaactgagcaaaagtttatatagagtctcaattctaaaccagcattctcatttaccaggtgaaacagctgaggcccagggaggagcaaggaattgcccaggttgatacaatgaatgacaaatggactcagatccagtgtagtgccttccctggtgtcatactgattccttgttgaatgcctggcttttttctttactcattaaaaatgtgtgttacgcaaataatataatcattttaacaaggattctaaataagaaggaaggagcactgctgggtgcggtggcatggtagtggcctgtagtcccatctactcaggaggctgaggcaggaggatcccttaagcccaggagttcaaggctgtagtatgctgtgattatgcctgtgagtaaccattgcactccagcctgggcaacatagcgagaccctcatctctaaaaaattaaaaagagagagagaaggaatactagtagtcccacaattctgactgttttctttatccatcttcagttttgatacatgtgtgtttgatttctgcattgttgtaatcaacatgtaattataattttatattctactttatttctcttagcattatttctaaatcattttccaattgctacatatttaattccttttaatggctacataatttatcaaattgtcatatcataaataaatttacctagagtcttagcaattaaaaaagcttgttttacaaagtatttccaaggtagactctctttgtacatttcccattgtaacttagtatacatatgtgtatatattataaaactgaaatagaattttcacaatattttttgtgcaatgcacagcttaaattctatgctacattttatttcagttttaaaaaatactggttgtaacctctgaatttcagaagtcaagtggtcagacagtatataacagagaagagagacctgtttttcaaactcctcttttccaaaacctctgtagctggccctcaagattctccatcttctggccacaatttacctttttcagctttatctccacttatgcccttgcaataacccagtggttttaatgagtcaaaccaacaatctagaaagcatatcattttctttaattataatgttattgtttaaaaaataatattaaaaagttacactgttttgatttagttagaaagttgcattccaaaattattctttaggaaaatacagttgattcccagatgtcaagcaaatagaaatgtcctttttaaaatctttctttcatagtctgacactttccccatacttgtcattcagtttgcttaaatcttatctccttggcaaagccttctaaagttccaaaaaatgttacctttctttggatttccacagtatcctctctttaacactcattcagtactaatttattttgttatttgtaaagtattttttctatgtaatcagactgaccaggtttatatgttaatatgtttttgtataatctgtgtggtgaggtaattatatatgcagacacacaaaaacacatgtacatatatttgcataataagagaagtccagaaaaagtgctttgaaatctcagaaaaaagagacattaataatcacttgctggagaagtaatgctttggctggggctagaagaacaggtgtgatttgggtacgaagagattggaatggcaggttttccaaattgagaggatcagtggcaaaatccccaaaataggcaatgcagggcttatatgaagaatgtaagtggtacagtatgactgaagatttgtgttactgaaaggacataatcggagataatgttgaaaagggctctttctggacaactttgaggaccagctaaagaagttttataattgaggaaatttaaaaaactacttctcttttctgttatatattgtctgatcagtggtagaaaaatattaagggtttcaaaattatacatttattgagtctagcctatagtatgattggcttaacattttttttatttgcagtacgttaaaggaccttgacacctctgacagaaaagaggatgttcttagcacatcaaaagatcttttgtcaaaacctgagaaaatgagtatgcaggagctgaatccagaaaccagcacagactgtgacggtacaagcaatattttagacataccatgtatttcaactacttacttttgaaaacaacgtaacacaaagattgtgttttgaacctgtggctgtatgttataaaatggcagatttgtagtttcttttcttctaatgtcataaccttgtttactggttagccagcatttgcctgaacaactcatgaactcatgctctcacaagggcgttcattccccattttgaaaatgctacttgttagaaatcatctctcatactgagccaagatctgcaactttaattctaggaggtttttaaatttttatttacaaatgagaacttccacaaaatcctgtgtttcagaaacacggaccacagagcgtaatctcatcataatagagtttccctccccctccttgactaaatattattaggtcttttaactctccttgctagaaattgctttcttgacctttcatcctccggttctcccttgtatatactctgagtctaggtctgggtcttgatgttcatttaaagctaaatacttgtttgcttgttttgtttctaattcattttttattttttattaaatatctagtgtaaataatcagatagcagtgcaagactttgataaacgacagtcccccttcccactcttggtgtctgctgctcagaggcaccttcagtctgaaaatatacatcctcttgtagacatttttctggcattatttctttttaccttctttttctctttttcactcttcctggaacttctatgatttgcatgttagacttccattaattatcttttctatttttcatctcttgattttctactttttaggatatttccttgattttatctttaactcttctgtggaatttttaaatttctatcaaggcaatttccgagagctcttctttgttctctggatatctctgtcgtgcattcgagtctgagggctgctgggcttttttagcgacgtctgcatgcatgtgcgggtcatgtgtgtagtgttctctgtgtgttgtttttgtttcctccagtttttttgtggtttattttggactcaatttattttagagatattcaggaggtgactgatgtgctgggcgctcttataaagtgccttacaatattaactaattcagtcatcaccataaactacctcaaactttaaggtagtttccttttttttttttttgagacggagtctcgctctgtcacccaggctggagtgcagtggcacaacctcagctcactgcagcctccgccttccaggatcaagtgattctcctgcctcagcctcctgattagctgggattacaggtgtgtaccaccatatctggctaattttttgtatttctaatagagacagggtttcaccattttagccaggatggtcttgatctcctgaccttgtgatccgcccacctcggccccccaaagtgctgggattacaggcgtgagccaccgcgcctggcccactttaaggtagtttctgttatccccatttaacagataatgaaactaaggtacaggagcgttaaatagttacacaccgtcatagaattagcctcagagctaggatctgaacacagcagtcttgaggcttttgagttttcattgataacaactgcattatactgtctctgtatcattaagtttcactaataaaatggttagctagaacaggggcaaggacagagttctacagcatgtcaatagaggcttccctcttggcttacaacagtccattcatcaccacttcttgttcagctagttacatatctgtcttcagaccatgtttctgttctttatccatggagacacaaaagacttgactatgtgactccaaaaagttagaggtgtgaggcagcaagaaggaatgggtgggacattgactctagagtcctacagacctgtaatagaaacctgtctcctcctactcttgactatgtgactatggcaaatagttaaacttctctggacttcagttttttcttctataaaatgaggagaatgatatctaccttgctgggtagttgtcaggattcaagataaagtgcctagtacactgcaggcctttcataaatgataactattgttatctgccagtctagtaatccttttaaaaaaggaaatacattaagacggatggtttgtttttatgaacttttgctaactctattattgtttcctcccccttagagctcacaaagcagctatttgataacaggctctagaattttgctttgaatttacatcaaatcaccagcctgtagtttttggcaatcactttcaaattttttgaaaattagaacaatgtttgtctgtcctcactttccatcagttctcttattcactagatgcctcacacacgtgtcagtgacaggggctctgagatcctgtttgcaggtttcctttgtactctgaggtataatctgtctagacaaggagtcttgggctagtctctgatagctaggtacccccttttatctccctctgagcctgtcttggctttcagttccatccgaccattgtgtattctctttccaatctgatgcttgttttccttgcagagaaaacagaagtaagataggaattcagcaattccattttacatctcatacctcacatttctctcagtcaccagaagtccaaatttcccaggccattcttgtgcagatgcccctcctcaccctgccatcttcactccctgttctgtcctcacttcctgtccttcctggcttgtaaaccatttaactgactgctctgtcagcaatgtccctgtagcctcatccgcttctctgatcattttcttccccttctttctctaattgttttctgaggatatgtactgtttcccctgcagcccacctaaactgttttttactctcacagactttaggcctgagaggtggcaaaggcatctgttgtccttgcttcctattgccattttttttcctttttttcatctttttttttttttctcgctctgtcacccaggctaaagtgcactggcgcaatctctgctcactgcaacctctgcctcccaggttcaagtgattctcctgcctcagcctcctgagtagctgggactacaggcatgcaccactatgcccagcttttttgtatttttattagagacagggtttcgccacgttgaccaggctggtgtcaaactcctgatctcaggtgatcctccagcctcagccttccaaagtgctgggattacaggcgtgagccaccatacccaggcgcagctgaggttttagatgaaggaaagggctggcacggtggctcacgcctgtaatcccagcactttgggagaccgaggtgagtggatcatttgaggtttaggagttcgagtccagcctgcccaatgtggcaaatccccatctctaataaaaatacaaaaaagccgagcgtggtagcgtgtgcttgtagtcccaggcactcaggaggctgaggcaggagaatcacttgaaccggggaaacggaggttgcagtaagccgacattgcaccactgcactccagcctggaagacagagcaagaatctgtctcaaaaaataaaataaaataaaacctctactgctttgaaattctatttattagttatggcttaatttttaaaatgggagtgggctggcaggattcagttgttcaaacatcatatcaggagttgctctgtctctcacttcccttctctctcctctcttctgtcccatctctccgggtcaaacctccatttctttctatgtgctttctacttttcctttgtatcaatcttatttgaaatctgtctttctttataaggtgacagaaatggccaccagaatcatattaagcttggaaaaagggaggtactttttcccagtcagccctaagtatttccagagttaattttcactgggctgccttgtgtcagatgcctactgagggagtgggaagggtaggtctaataggaaatcttggtaacagtatatgttaccattaaagggaagcctggattccaggcagatcaaaacaacaggtagggctcttgcctgtccaacgcttaacaatacactttgtgttggcacagtgagctttgcacatgaagttagttaaaaataaaatcatagttaactgataaacctttgttccagccaatgaccttgcttaccccaagaaatattatttattaaatattatgaaattaaatgaaaacagttatgagctcttatgataaagcgtagagacaacccaatttcaagttaattcacaggaagataataggacaatatatggttgtttatgatcttgtttttacactgcttcatattttacatatgtgactttcaaaatcttaagacttgactgggcacagtggctcacacctgtaatcctagcactttaggaggccaaggcgggaggatcacttgagcccaggagtttgagaccagcctgggcaacatggcaagaccctgtctctacaaaaaataattaattaaaaaaaaaaaaaagaagaagatgtgttgtgttgctgggcacagtggcataggcctgtagtctcacctacttggggaggctgaggcaggaggatctcttgagcccaagagtttgagggttcagtgagcagtgattgcaccactgcagtttaacctgggcaacagagccagaccccctttctttctttctttctttctttcttttttttgtgagacaaagtctcacttttgtcccccaggctggagtgcaatggcacgatctcagctcactgcaacctccacctcccaggttcaagcgattctcctgcctcagcctcccgagtagctgggattacagacacgcaccaccatgcccggctaatttttatattattagtaaagacggggtttcaccacattggccaggctggtctcgaactcctgacctcaggtgatctacccttcttggcctcccaaagtgttgggattacaggcgtgagccaccgtgcccagccccactttaaaaaaaaaaaaaaaaaagaaaaagaaatcaagatcttaagacttttttttttttttttagtgacagggtctcactgtgttgcccaggctggtcttgaactcctggacttaagcaatcctcctgccttggcctccccaaagggctgggattacagtcatgagccaccatgcctagccaagacttttttttttttccctcaaagaaaaatattaacaacataattattttatagctagacagataagtttacagcagcagcttattcatgtgatggagcacatctgtaaattaattgatactattcctgatgataaactgaaacttttggattgtgggaacgaactgcttcagcagcggaacataaggtatcttaattttcccccttctggaatatatctgattatatttctaccactctaagtgaaaaatggacagggcaaaatgttcaggctttctggcctggaaatggcataaggatgatcatcatgccactatgtttttgatttgtttacttttcaaaccactcctttaacattcgtattcatgtttttaagattgggaaaaaagcgaatatattttgctacaatttctatttggtatgaaaactacagatttgcttttgtggcctaccagagtaaactacttatatttaatacgttgttctcttttctctcttcagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactggtaagtttaaaataaattgaatgcttatatgaaaacaaaactgtcccaaaataggaattatataagaaaaaccatagcaaatcatcattgcctgaaaacattgttgctatgcaaatttctactgatgatatgaattacaaatcacaatttcaaaagcaagttgctcttttgtctctatagcagctgtagttttataaaatgtgtaattataacctattgtagtacggctctaaagtcattacaaatgtgatgtgcctttgaattaacattttttagttcctaaaacaaactcatgagggccaagtttttaatgattttgggatgggcaaaagcaaaaatggattcgcatgctaaaaatgtattttagaattctgtactgatgagaatcgattaatacaaagtagagaagcatgttttatgtgttaaaatgttaaaatatagggtagtctataaaggatatgaagtcaggagtgtcttaaatcagtcaaactacttctttgggtctaagggctcactgcatgccatgtgctatgttgggcgccgatcatttaaagatgaataacaaatactaagtagttcctgccctcctggagctcacagcttagtgagagagaagttttgagaggaatgaaattagccactgaaggctccagagaaaagccaaaaataattttaaaaccttacatcaaccctataaagttatcaaaagtattttttagctgaaataagtttataaagtacagccctccctatttttgccattgatgacttaataccacggaggtttttcttacagttacgctgctgacctttaaaacaacgattaatggatttatttttgtatcatgttagaatgtgtcatacttgatgtttgcaattatcttgagacagttgagtgttggggttagcgtaactgccagagctccgtgagtacctcttgttctctgtgctgaaccagagttgcgacagccaggctgcagagcaggggcacgtgtgagagatgttatgaaagaagagcctgaggaagctcagatgactccaaggtttcagacactgatgactgggaaaactgtgacaccagtaacacaaacaggggagtcaggaggcggagtcagatttggagaaaagctgagaagggctagtttaagtctagaggttaaagtgctggtaagtcattcaggtaccaatgtcttgcagacaacgggagctgtgtgcaggactggaacttaggagggtgtcagttgggtcttaagagaggtgtaggcatttgctgcacacgggtcatgtttaagatcataggactaggaaagctccaaaaaagaatgtctacagagcccagtcccaaatatctgaaagactccctcccctatttatggggcagatggaggtagtagagccaggaaagggaatttaaaatgagtagaaaaccatgattgtcttggtggtcatggttggaggaagggagaagaggaaggaaagaataaaagtagtggtaggtgctgtagaaaaagtcaaggaaatacttgatttgggactttggcaagtttttggtggctttgagacttgtagggaaggaaagccagtaaagagtttaagaactgtgctgcagggaaacgtgtgccagtgattctgcagggcaagggaaatgctaaagctgtactttcactgtattcatgtactgatttttcttaacgttgattattttcctagacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggtatgtatttttagaagtgaattggcaggaatccattggcagatgttaaatgaaagctctttaatagaaataaaaagaccacctacacagtatttctatcatttagggacctcttaaacctcctgtaccatagtgagaaagcatattactttatatcctttgttctggttgttgacatcatgaagtttatagccctgtaagattttcaactcgaagctcattgtgttgaactgatctagaatttttctttgggaatttttcttttttctagtctaagcagttttggaaatcaaacagaaaaatcgctgtcagagaccatgaccatttctggcagtttatttgcaacaatctggtgttgcatagtggttaaatcatatatgcatatatgcatagtggtccatcagctatggaccaaaggcctggacttaaagaacagctctgctgctcacagcagtgtggccacatgcaaggcactttactccctgggcccattttctcatgtgtgcaatggtgatagcagtaaagtacctggttcacagagtggcatgaggattaaatgaaaatcatttagcacgatattgtgttggccccactttaaagagtctaggacattcattgtgctgttaaagcttatgacagctgttcaatgatttatagtcattcacatgagaatattaaatcaacagggcagagcgcaaggagaatttgcagtttcagtacctatgtgtagtcctccctctgtctatcacctgacttgtgacctttagcaagttagctagtgctgtcattattgtataatgttgactgggcatctgaactttttcatcctggtttttagatttagatagccttggcttaataatcagcatttcaatttttattaatttattaatcactctgtgccttcctttcaaccctattttggtgtttcagaactctaacgctggaaaaaaccttggcaatgatctaatccattgattttttttttccagggcttcccattgtcctttagggtttcaagagggcatttttaaggtccttccaccccaatttcaaccacttgtgagagagagatatatataatatataattatatataatatgtatattgtattgtatataatatgtctattatatataattataatatatagtgtgtgtgtaaatattccaaataaggtttattttatttttatttcttattatttttgagacagggtctcttgatctgtcacccatgctggaatacagtggtgctatcacagctcactgcagcttcaactgggttccaacaatcccccccaccttagcctcccaagaagctggggctacaggcatgtgccaccacacctggctaatttttaaattttttgtagagatgggatctcactgtgttgcccaagttgatctcaaattccctgggctcaagcagtccacctgcctcaggctcccaaagtgatgggatttataaataataaaagtaaataaacattatatagaaagtaattattttaatcctagtgtcatttttagagactcttctactactagaaataaaaactttactgtattccactacattttaagtttcctgccctaattcttgcctttgctattatatatgtctatataagatgtcctaggccgggcgcagtggcttgtgcctataatcccagcactttgggaggctgaggcaggtggattacctgaggtcaggagttcaagaccagcctggccaatgtctctactaaaaatacaaaaattagcaggatgtggtggtgcatgcctatagtcctagctactggggagggtaaggcatgacaattgcttgaacctgggaggtggagattgtagtgagctcagatggcaccactgcactccagcctgggcaacagaatgagactctgtctcaaagacaaaaacaaaaacaaaaaaaacactttttttttaaagatcatttttacacattatttaaattgcctaaatataatagtttgagtcatttgagtatggcaaattgttggcaccagggacaatatgccttggtgtcctattaatgatatgatttcttttgtaacttttacattcatgctctgaagacagaacctgacagatattttttcattgttctctttcaggaggtggtaagagtttgtgttaccagctccctgcctgtgtttctcctggggtcactgttgtcatttctcccttgagatcacttatcgtagatcaagtccaaaagctgacttccttggatgtaagttataaaaatactaataaaaacacgccttagaaacaattaaatttcagtcctctggataacctttttattaaatagttcgtgatttgtaaaaaataaagcacagcagttaaatttgcagttgaacagaagtctgaaaatttgatacagataacctctagttcaatctgtttttattctacaagaatgtatcttagtaagaacttttaaccaatgctattttttgctgatgtaaatttttttaacgaatagaaaatcatttcttttttcagtactgccaggtcggcatagttctctttcccttatatcttaaagtgcatacacacatgcatgcctgcacacatatatctttttttctcatggctgagtttaaggaagtaaatgaatgcattctacttaactcttcacaatgtagttgggggtggtggctcatgcctgtaatcccagtgacttggaaggcaaaggtgggaggattgcttgaggccaagaattcaagaccagcctgggcaacacagcaagactttctctacagaaaaataaaataagctggacatggtggtgaaaacctgtggtcccagctgcttaggaagctgagggaagagggtcgctagagcccaggagtttgaggctgcagtgggtcatgatcatgccactacaatctagccttggtgaaagcgagaccccgactcaatcacattgtgattaaaaagaactgttttaagagttatgagtcaccacccctcaataagaccactagtttggttttcttccaaagaatgtcttagtgcagtggtggtagccattgttcaaccatttgtcatattatggccccttcattgtcattaatctttaaaaccctgaaatacatttatctaaaaaaaagatgccatacagtaggactggaatatcttgtataccaaattcatatttatcttatttacaaagatgaaaaataaagcaagaaaaggaaataaataatgagaagaccattttgtgttatgcttttttttgttttgttttgttttgttttaagacagtcttgttctgttgcccaggctggagtgcggtggtgcaaccttggctcactgcaacctctgcctcccaagctccagcaattttcctgccttagcctcctgagtagctggaattacaggcacctgccaccacgccaggctaatttttgtattttcagtagagatggggtttctccgtgttggccatgctagtcttgaactcctgaccccaagtgatccacctgcctcagcctcccaaaatgctgaaattacaggcgtgagccaccacgccctgcctgagttatgcttaataagggttttttaaaatgtatgtacttacatacttgttatgttgagatatgtatttcctttgataggtttgatatgtgactaataaaatatttataaaacctaaggacaaatgtaattttgtcaggttaatgtataaaattgaaattgtttactacttttatacttagattccagctacatatctgacaggtgataagactgactcagaagctacaaatatttacctccagttatcaaaaaaagacccaatcataaaacttctatatgtcactccagaaaaggtttgtatttatatcattattttaaaatatattaaagaccactagaatacatatatttttaagattttaacaaaattttgtatacgtagtgcaaagaatttttgtacaactttcatccagaaaccccaaatggtaacattttactataattgctttgtattctctctctgcatatattttcctgacacatttgattgaaaattgcagacatggtatccttttaagccctaagtacttcactgtacatttcctaaaaacaacgtattctctcatataacctcagtacaatgatcaaaattaggagatgtacattgatgcagtactattacttaatctgtaaaccttattctggtttcactagttgtcccaataatgtcctttatagcaaaagaaaatcccagatcatgcatgcattccgttgtgcttctctgtaatcttgtaaacagtttctctctcttaatatctttcgtgattttgaagtttttgaaggccagtcgttttcggaattgtccctcaatttgagtttatcttgcttcctcctgcttagattcctgttactccttgaatatcacagaaacagtgatatgttctcatgcccactgtcaggaggcacttgatgtcgattcgtcccattactgacaatgttagttaactgatcgcttggttatggtagtgtctgatagacttctccgctgtaaagttactcatttctttttggcctttgtaattagtagatatcctgttgtgggatgctttgagactatgtaaataccctgctagtgatcagaattttacccacaagttttagtatccattgatgattcttccccaaatcagttattactatgatagatataaaattattttttaaatgtagttggtgttttgccataaggaagagttttcctgttggttacactttttttttctttttttttttttgaggtagagtctcactctgtcacccaggtgggagtgctcggctcactgcaatctcggctcactgcaacctgggttcaagtgattctcctgcctcagcctcccaagtagctaggaatacaggtgtgtgccatgatacctggctaatttttgtatttttagtagagatggggtttcaccatcttggccaggctggtctcaaactcctgacctcaggcgatctgcccacctcggcctcccaaagtgctgggattacaagcgtgagccactgtgcccagcccacatatttattgatactagcatgaactcgacttcttaatttattcaatgagttacattcaattatcaagtattttgatgttctaattgtcctacatgtgaccagtgagacatctctctcaagctggcttctctgtccttttgacatgtcccggtcaagatgtgagtgctacatgtgctcgttgctactgagatgtcattgcttctaggccctgttatgaagagagctataaaatatataatttttcccccagccaacacgcatccatataacccagatatgtaaccctgttgccaatgtaaatgtatggtggccctcagatgtcttgaagcagacaaaagtttgagaaccactaacctgctaaataagctgtttgcttaatgttggtgaacattctaaaatttgatctgctattttctattacttctgctgttctcttcatagattgaaataagaaccaattttatatggaggtgtttttgtttttgtttttgttttttcgagaccgagtttcggtattgttaccaggctggagtgcagtggcacgatcttggctcactgcaacctccacctcccgagttcaagcgattctcctgcctcagccttcctgagtagctgggattacaggcatgcaccaccacgcccggctaattttgtatttttagtaaaggtggggtttcaccatgttggttaggctggtcacaaactcccgacctcggatgatccacccacctcggcttcccaaagtgctgggattacaggcgtgagccaccgcacccggccttatagaggttttaatacagcttaagttgtgatggaatttgaagaccacagaatcatgaggtgatgtgtttcagtgtttttacatgtctaatgtatttctggcctagatctgtgcaagtaacagactcatttctactctggagaatctctatgagaggaagctcttggcacgttttgttattgatgaagcacattgtgtcagtcaggtaaatactgttttttatatccggaaataccgataaatacatactaccaacaatatatgtatttactgaataaaaacccacactgagtgaacgagtctcctattttactgaagaataaggtagttcttaatacattgagcagtgttggctttttatagaaggaagctccaagtagtctgaaaagcagtatttttttttccaactagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtaagttgttgcacgtcacgtatttgagaaccctggggcagtgactgccagagctgctacatgttagaatcacctgtggcgctttaacgccaccaccccacccccaccccacccccatgcccaagttgtaacccgatggcagctaaatcagaacgtttggggctgagagccagtatttttttaaaaatccccaagtgattacaatgtgcagcagagtttgggaaccagagtcctagggcttttcttcacttactgaaattaaaactccttttcagtacctactttagaagtagggataaattgcatgccatatctatcatccctggtatagtcccagtaataaattaatttttacttatctaattttggcttccatatatcctagagtatacttcttgaaatgaaagatgaccctgctttgtcatttccccctaaggtcccagttgaatccaggatgttgaaaatagtccagatactatgtcgaatagcttttttactttgttttcttctcaacaacaaaatgcttcttgttgccaccaaatccataattcttcagtaacaaaatctactataaaagaaatccccccccccttttttttttttttgagatggagtctcgctctgtcgcccaggctggagtgcagtggcctgatctcggctcactccgagttctgcctcccggggttcacgccattctcccaccttagcctcccgagtagctgggactgtaggcgcccgccaccacgccaggctaattttttttgtatttttagtagagacggggtgtcactgtcttagccaggagggtctcgatctcctgacctcgtgatccgcccgccttggcctcccaaagtgctgggattacaggcgtgagccaccgtgcccggccaatccccacatatttatctaggctgtactggattattttatacttctacctgagtttgtagagatatggattctttggtaggtttattcactcagcaaatatttatttaacaactgttgtgtgccgagtttaaagtatttttttcttctgatttattagtgtgcactttagtttcagatgtaaacattaacatggtatgcctgaaggagtaatgactgaattggatattgaggtgaatttttaaagcacggcttttgttcatttgaaaataaagacaagctggtgctataaatattataagcagtaagaatagcaacagtatctcttagagggttatgagaagaactgaaggttccttatgaaggatatgaatgggtcatgtgattaagatagctacaaaagcttttgcaggttaaactggcagcttctaaattatctgatctaaatcaaggaattcaagcattttgggtttcttccagcctttaagttgtttggttccagcctagaattattttattgctagtagcactgttatatagcacaaatgaccatactcaagtgcaaggattttagagtcctcagaattttgtgtgtgtgatcacaaagtttggaatggaatattgtaatttaatctcacttgcagaggagtatttgtattaaatttggggaaaaatattttgcgtctataattgatatgcattataatgctatatttaagatgtcgtattaggctgggtgcagtggctcatgcctgtaatcccagcactttgggaggccgaggcaggtggatcgcctaaggtcaggagttcgagaccagcctggccaacgtggcgataccccatctctactaaaaatacaaaaattagccaggcctactggcgtgcgcctgtaatcgctgctactcaggaggctgaggcaggagaattgcttgaacccaggaggcggaggttgcagtgagccaagatcacgccactgtactccagcctgggcaacagagtaaggccctgtctcaaaaacaaaaaacaaaaaacaaaaaaaaagatgtcatattatactttagattctaataaataacctatttgcaagtaagtacttctgtaagtactacattgatctataatttttttttttttttttttttggagacaggtcttaccatgttgccatgttacccaagctggtctcgaactcctgggcttaaacagtcctcccatctcagccttcctaagtgctgagattcttctgtcctcttacgccggatgcaatctactgttcttttagatcagttacatcaatggcaaatgcctatagttaaatgataaaaaaaatttcttttccttttgaatgactttttgtaagtataggatttgtgatttatgtttgagtaaacagtgtacatatttatttatttatttagaggcaggcaccttgaatctgttttcttagtactgtggggaagagatctgcctgggaaagcaaggttgtggatttccagtctccagcacttggtacataattggcactcagtaataatcaataaatgaaaaatgtgaaggaatttgggtaaatgtaaaaatgtaggcatgtctgttgactccttaatgtgtttggcacttctctgcatttggaagtaggaaattttaaggaatactttctgggactctgtttcctgatcttttctgccagtaggccctggtttggattaaatttgctcaactgctgctatgtcgtggccctggcgaagtcaggtattcctaaggttgaagccacagcccctgtgctgctctcctcccgccagtctgtaataatattcttcctctttgggaaatataaggcacacaaaaaaggctttattccatttccttagggccttaaaatatgaactggaagagagcaaagagacaggcacatagagttaactataatagaacaataataatagctaacacttacatatccagcctactcagtgtgccaggcactgttgtcattttaagtgtatttacctccttgtccacacaaaagcaaggtaggtactcctattttcctcattctacaggtgaggaaattgagacacaaagagattatataacttcatatgcctagcaagggttggagtgagaacttaaaacaccagatagctggtttcagaatcctttaaatactaggtcaaattgcagaaagaagaaagcagtgatttgagatgtaaattacagctgcaggaactgaagaagacaagataagctagaacccccagtaacagctgttacaaggaggggtcagatcaagttttgtaaaggcactgggcattgtaggaggagtagtttatttaaaagcataggttgggcatggtgactcacgcctgtaatcccagcactttgggaggccaaggtgggcggatcacctgaggtcacgagttcaagaccagactgaccaacaaggagaaaccccgtctctactaaaaatacaaaactagccgggcctggtggtgcatacctgtaatcccagctactggggaagctgaggcaggagaatcacttgaacccgggaggcggaggttgcagggagccgagattgcaccactgcaccccagcctgggcaacaagagcgagactgtctcaaaaaaaaaaaaaaaaaaaaaaaagataaaagcgtagacagcagccgagcgcagtggctcacagctgtaatcccagcactttgggaggccaagggagacggatcacctgaggtcaggagttgaagaccagcctggccaacatgttgaaaccccatctctactaaaaatataaaaattaaccaggtgtggtggtgggcgcctgtaataccagctacttgaaaggctgagacaggaaaattggttgtacctgggaggcggaggttgcagtgatccaagatcatacgactgcactccagcctgggtgatagagcgagactccatctgaaaaacaaacaaacaaaaaaaggcttaaacagctgtattgaaataaaatttacataccataaaattcacctaaagttgacacttcaatggccttttttttttttttttttttttagtttataaggttgtgcagccatcaccattatctaattttagaacatttttgtctctgttgaaagggagagtatacccattagcagtcaattcctactttctcactttccccattcttaggcaacccctcatctactttctgtctctgtaggtttgcgcctattctggacatttcatgtaaatggaatcacataacatgtggccttttgtgactgacttctttcactgagcatgtttttaaggttcctccatgttgtagcctgttttcagtatttcattcctttctattttcagataatattccattttatggatcctactttctgttttatttgcccattcatcatttgatggatgttcaagctgtttcagtgttttggtttttttgaataatgctgctgtgaacatttgtgtagaagttgttctgtggtcatcagttttatttctcttgggttgctgggtctgtggtaactgtatgattaaccttttcaattcaaggactactaaactagttttcaaagtgcctccgtcttttttttttttttttttttttttttgaggcggagtctcactctgtcacccaggctggagtgcagtggtgcaatctcggctcactacaacctccacctcctgggttcaagcgattctcctgcctcagcctcccaagtagctgggactatttttgtatttttgtatttttctaattttgtatttttagtagagatggggtttcaccatgttggccaggctgttctcaaactcctgacctcaggtgatccacccatctcgacctcccaaagtgctgggcttataggtgtgagccactgcacccgaccgcctccatcattttatattaccttcagcagtgtgtgggggttgcagtttttccacatgcttatcaacacttgttactgtctttttttattacagctatatgaagtggtaggtgaacggcattttagcaggcaaagagtgaaaattcagggctgaagtttctgttataaaagtacaggtcaggccaggctcggtggctcatgcctgtaatcccagcactttgggtggccgaggcgggtggatcacctgaggtcaggagttggagaccagcctggccaacatggtgaaaccccatctctactaaaaatacaaaaattagccgggcgtggtggcatgcacctatagtcgcagctactcgggaggctgagacaggagaattgcttgaaaccagaaagtggaggttgcagtgagccgagatcatgccactacactccagccaaaaaaaaaaaaaaaaagtacaggtcaggcccaaggaatggtgaataatccattggataagtggagaaacatagagaagggatgaccctgacaaggtggcttgacgccagatcatggaggatcttgcatataacgatggtaaaatgtttggactttattcttttggcactttaacctgggaagtggcttgatctgaactgtgtggatgaatgataaccctggcaagagaatagaggagaggatgagtgagagaacagaaagttagaggtagagcagcccttcaggaacttattgcctattgcagtcattgaggagagatgatgctggtggaaacagcagaagtggaaggaagaaacagagtcaagagagagggcaggaatggtaactaaatggaatgagaagagtggatacggttgaagtttatactagttcctggggcaggtgcctagaaccattgaccataaatggaatggaggaaggaagatgagtaataaatttgattttagatgcatgatgcctgggatgtttaagggatgagtggatgaccacgatagccatcttcataccttctttggtcacatgtacctcctgaaaaaatcctggaaaactatgtacctcctgcatatatacatatatgttttaaatatatatataatatatatgtattttatatatatgtgtgtttttattttttatatatatatgtgtgtgtgtgtgtgtgtgtattttagaccaagtttcactcttgtcgcccaggctggagtgcaatgacacgatctctgcaatctccacctcccgagttcaagtgattctcccgcctcagcctcctgagtagctgggactacaggcacttgccgccatgcccggctaatttttctatttttagtagagacggggtttcaccatgttggccaggctggtctcaaactcctaacctcaggtgatccacccgccccagcctcccaaagttctgggattacttgagccaccacgcccggccataagcatacattttgattgagaatgtatctcttaatgagataggccttttgtttgtttgtttgtttaagagatgaggtctcgttatattgttcgggttagtctggaattcctggcctcaagtgatcctcccaccttaatcttctaaatagtgtggactacaggtccacacccagctaggacttttgttgttcacttagttgacatatctggatgaattgggtccatttatatttcttatttttatggatgtaagcactaagaaatattgctcacataaacatgtagatgggaatggaaggcattttttgtagctgtaacaattatttgaattccttctgatgtatatgccaagattacgtaatgatcagtcatcaaaaattatttttaattatctgtcaattgacaactcaattaggtctttcaaatttgtggtaagcaaagaattggaaactctctgggaaaataagcaagatcaatcgttattcactttactttttctaggaaaaataccctaaaaaaaagctttaccaatacttacctaatgactattaagtagtcttattattctttcaacaagaatcttgttccctgtatccaatatgtatggaagagttggggaaatcaaaatactgttagtttcagtatacctttccaatatgatatttttgacaaaatacttttattgtgtgatacgcttttctaataacttttttgttgttgttttttgagacagagtcccaatctttcacccaggatggaataagtacagtggtgcgatctcggctcactgcaacctctgcctcccaggctcaatttatcctcctgcctcaacccgccaagtagccaggactacaggcgtgcaccaccatgcctggctaatttttatgttttttgtttgtgttgtttttttcgtagagacggagtttcaccatgttgcccagactggtctcgaactcctgagctcaaaggatctgcctgccccggcctcccaaagtgctgggattacaggcgtgagccaccattcccaaccatattgtgtgacatacttttaaatagagttttgtcaaaactgtggctatagattagctctttccaaaaatgggaaatgaccaccatataacctaattggtaaagccagtctttattgctaaattagacttcttttctttgtgggttttgttttgttttgttttgtttttgtttttgttttggagatggggtcttactctcactatgttgcccaggctggtcttgaactcctgggcttaagtgatgttcctgccctagcctcctgagtagctgggactacaggcacatactaccatgcctggctggcttcattttccttttcttttttgaggggggtggggggaatggagtttcactcttgttgcccaggctggagtacagtagctcaccgcaacctccacctccgggattcaagtgattctcctgcctcagcctcccaagtagctgggattacaggcgcccgccaccatgcccagctaattttttgtatttctggtagagacagggtttcaccatattgcgcaggctggtcttaaactcctgacctcaggtgatctgcccgcctcggcctctgaaagtgctgggattagaggcgtgagccactgcacctggcctcatttttcaattcacataaactatttagtacacatcccatgacaactattgtcaattccaaaagcaacaagctgagctctaattgactttgtttcctcacacaacactttgaaaagacatgagtttgacaccccaaacaggataatatttaccattttaatggtaatatccagcagaaccttagacaagaaacagtagaatctaacttttaagaaaactttattaaaatgtaattcacacactataaaattcatccatttaaagggtacaatttagtgggttgctttttttctgtattttcacagaattgtacaaccatccccaatatctaagtttacagcatttttatcaccccagcgagaaacctggtacccattagcagctgctccgcatcttctccctcttgtttgtgcccggcttctttcactgagcgtagttttcaagggtcatccatgttgtagcattggtcagtaagtacttcattcatttttatagctgaataatattgcagtgtatcagtattttgcattttatttatccatttatcaattgatgggaactgtctgtaactaggtatttggtaattccaaacatcttattttccaacaggcagagtaagatttgttacatgtaataaactccaagggtctattaactttttcattataacaaattgtgtaaatattgctttcagttagttacccacagtccttttgcagtagagatagttgtcttggttttaattggattcatgatctacaactttatgttctaatctcatgtcatttttattatttttagtaaaagtaatttgtttgactaaattaactggtaaacagttctgagctttttcaattgtgtctacaaattttaagaaattcagattatgtgccagatgtttttagtaacagctttgttgcggtataatccacataccatacaattcccatatttaaaaagtacaattcaaagtttttagtatattcagaattgtacaaccattgccagagttttagaacatttcatcaccctccaaaaacacccatgcccattgcagttcaatctccttttcccctcacatccccatcctgccagccctaggcaaccactaatctgctttctatgtatagatttgcctactctgggtatctcgtgtaaatagaatcatccaatatgtgatcttttttgtgactgtctacttagcataatgttttcacggtttattggtgaataatattccattgtagacgtctacgacattttattcatcagttgatattgggttgtttccatttttattttttactattatgaataatgctggtataatcatacatgtataaatttttgtgtggacatatgttttcatttctcttaggtatatgcccaggagtgaaattattgggtcatatagaaactctatgtttaaccctttcttttttttttttttgagacggagtctcactctgtagcccaggctggagtgcagtggtgcgatcttggctcactgcaacctccacctcccaggttcaagtgattcttctgcctcagcttcctgagtagctgagactacaggtgtgcgccaccacgcccagctaattttcgtatttttagtagagatgggggtttccccatattggccaggctggtcttgaactcctgacctcatgatccgcccaactcagcctcccaaagtgctggaattacaggcatgagccaccgtgcccagcctatgtttaacgttttaaagaactgtcgcactgttttccaaagtggctgtgccattttacattttcactagcgatgtatgagggttctaattttttcatatcctcaccaacacttgtttttgtctctctttttgacccaaagatttttttaaattaataaaacacttttctgaaaataaatatatttttttaatgtgggaaaaagcaataaggccattgttatgcccagtcaccatagcattcctatcggtggagagactcatgcaccgtttccaacttaagcccaaatcaactcaaatgcattttaagattttcttcatcatttgtattcctagacaattctttaatctactaccttttttgccacaatctgctacacattctgccttttcaagcactaaaaggactctaggagttttttgcaaagaaatgctgtcataagagtggtggtatcaaagtattgtttaacggtagtctcaaagactttcagggtaatgcattctgtgattatagagatgaaagaaacaacatcataaagtgaaggtcatcttcattcccaccaccttattctcagtatatctgaaatcagaacatcctaataaggaccaaaatactttgttcctagttattcttcacccttaacagaaataagtaaaacaccgaaagatatgaggccctcctaccaaggatttctagtgctttaattaaagaaaatttcacctacactcatactatttttcagtttgctttgtttggtgtcctggaggtttttacatcctggaacagtgcacagtggtaaaattcagaatggatgaaaagtaggattggtttgtttgttttcaggaagtgaggcaatcgtaaaagggaaaaatgggaaaggcgaaacaagcaggatgtctttttttttttttttttctttttagacagagtctcactcttcgcccaggctggagtgcagtggtgtgatgtcggctcactgcaacctccgcctctcaggttcaagcgattctcctgcctcagcctcctgagtagctggaattacaggcacgtgccaccatgcctggctagtttttgtatttttagtagagacagggtttcaccatgttggttaggctggtttcaaactccagatctcatgatctgcccgccttggcctcccaaagtgctgggattacaggcgtgagccaccgcgcccgtccaggatgtcttttttctaattagagacgagggtctcactttgttgcccaactggtcttgaattcctgggctcaagtgatcctcctgccttggccttccaaaatgttgagattattgatgtgagccaccacccctggccagaatttcttgtctgtgggagcattctcagatcagtcttatgaaaaaggacagccagcccttcctatctgcagtttctgcatctgcagattcacccaactgtatatcaaaaacatttgaaagaaaaatagtttctgaaagtttcaaaaagcaagatttgaatttgctgagcaccaagcgctatgctgtgtccacatgaatgaagtgatgtgtaggcatactctgctgtatcctcccgccaggacagaagaaaaatgtcacatagttactgacagtacagtgtagcaactatttacatggcatttatttaatacattgtattgagtattataagtaatctagagatggtttaaagtgtgcaggaggatgtgcataggttatatacatatactacaccattttatatcagggacttgagcatccttggatttaggtatccgaggaggccctagaaccaatcccccatgggaaaccaagggatgtgaaaattgagggtctgaatttgtttaagattcacagaacagactgaaaagacaagagaggagataatggagagaacaagctcactgaggaagtgggcgggaggaaatggggcaagaatagtagaccagaggaagaggaggagcacatctgtctcagagtcagccacattttatttggggccaagaacaaaaataaagtgactgtaatcagtagggctttaactccttctgctgtcctgcagttagctttttatgtatcctggggtgtccaatcttttggcttccctgggccatactagaagaagaacgattgtcttggaccacacataaaatacactaactggccgggtatggtggctcacacctgtaatcccagcactttgagaggccaaggtgggcagatcacctgaggtcaggagtttgagaccagcctggccaacatggtgaaaccccatctctactaaaaataacaaaaatgagctgggtgtggtggcgggcacctgtaattccagctattcaggaggctgaggcaggagaattgcttgaacccaggaggtagaggttgcagtgagccaagatcgcacccttgcactccagcctgggtgacaagcgcgagactccctctcaaaaaaataataatacactaacagtaacaatagctgatgagctttataaaagaatcataaaaaatctcactgttttaagagagcttatgaatttgtgttggaccacattcaaaaccatcctgggctgcatgtggcccgtgggctgcgggttggatgagcttgagtacctggtcaaaatttgggaacattgatggcctaaaaatacgtatatttcctgtgtgatttccttaatattttaaataatgttctaaccatctctgcttttagtcagcctcatcttggagtcaagagactgggctcctgacttactttgtctttctatatgttttctcttccacaatcctaattttttgtcatctagtcccataaacattccctctttatcaccattcttttctttaacccttagccttacttccatttcagtgttctattgtgtaagctgctagcgacaatattcaacttaagactacttggtaggctgggcccggtggctcatgcctgtaatcccagcactttgggaggccaaggcaagtggattgcttgaggtcaggagttcgagaccagcctggccaacatggtgaaactctgtctctactaaaaatacaaaaattagctgggcgcgatggtgggcatccataatcccagctacttgggaggctgaggcaggagaatggcttgaacccagcaggcagaggttgtagtgagccaagattgtgccactgcactccagcctgggcgacagagtgagactctgtctcaaaaaaaaacaaaacaaaacaaaacaaaaactacttgatattagcttgggctgctatgacagaatactgtagactgggtggcttaaacaacagaaatttatttctcttggttctgaaagccaggaagtccaagatcaagatgctggcagatcccaagtcagatgaagtccctcttcctggtttgcaagtggtagtattctctttgcatactgacatatgcgggtggggagagccagcaaggtctctacttatttttgagcacttatctcattcataactccacccctcatgacctaattatctcccggaggctccaactcctaataccatcacactgggggttaggattttaggggggacacatgtagtctataacaatacctaaagtcatattttctcataataactaaattttatgtttgggacttttttaggtttagcatgagctttaacagacataatctgaaatactatgtattaccgaaaaagcctaaaaaggtggcatttgattgcctagaatggatcagaaagcaccacccatgtgagtacagccatgtgattagctgtctagaagtaacaaatgtctttttagtaccacaataagatatataaaattgcatattaaacattcctttttgcattatgacagcactaacttgctctttatagagcagactattgcaactctctcaattctggaaattataaaatctcatttggtttaataacaataaattctaacaaaaatatattaaatactccctcctacacacgtatattataacttttggtttcaatgtctttcctcaggcttctatcagtgtttgaattatacagctttttgttttagtgccttgtcccaagcctgtctgcctttgcattatgttaactaaaatgagattctgaaattcatagtagttttccatgtaaccccctttccacttttccatggagaatatttttggtatttctattttattttttagaaattagtatacatatttgtgtggacaaatcagtcagtagagatctaccaagaaaaagtcagtgatttccccgctcagactcacctcccccaggcagctaatgtcaatagcttcatgtgtatatctagacctttggctcagtcacagagagatgacttttcctttaatatcttttaatttccatttctaaaaataacacacataataataaatataatatatgctcattaaagaaaatttatatggccaggcactgtggttcacgcctgtaatctcagcattttgggaggccgaggtgggtgaatcacttgaggtcaggatttcaagaccagcctggccaaaacggtgaaaccccatctctacaaaaattatccagacgtggtggcacgcacctgtaattccagctattctggaggctgaggcagaagaactgcttgaacccgggaggcagaggttgcagtgagttgagatcgtgccactgcactccggcctgggcgacagagcaagactgtctcaaaaaacaaaaaagaaaatttagaaagcaacaaaaagaagaaacaaaagacaaacatcactcaatgagcaaaatcactgttatgttattattaatttctagtatttttctatgcatttttttctactagcatactatatacgtttctaccgttaatctactttatatatcatgagcattttcccatgtcttttaaaaacttagaaaacacttttgatagttatagtatattttatttcacagttccctgtatttgtttccctaatgttgctcagtaaaatctttgtaatttttaaagtttgaagtaaaacttttgtttatgtccttgtatcactttatttcctaatttcccagaaagaaactgagtcaaaggtatttctaagactcttgatacatactgccatatgcttttgacaaagtttgtgcaagaatggcttttcttttttttttttttttttttttttgaggctgagtctcactctatctccaggcaggagtgcggtggtgcgatctcggctcactgcaacctctacctcctgggttaaagtgattctcctgcctcagcctcctgactagctgggattacaggtgcccaccaccacacctggctgattttttttgtatttttagtgaagatagcttttcaccatgatgtccaggctggtctcgaactcccgacctcaaatgatctgccctccttggcctcccaaagtgctgggattacaggcatgagccaccgcgcccggccaaggatggcttttttatacccacatgtatctagtgtgaagtagagcccagagttcatccaggtccacctcacgagtcattagcagcgacaggattaaaagccacatctcatttccagcacacatgaattccttgcttgaattattcacgtgtgtggtcttccagcagtataagaacactacgggagatctatttatggttcatatatttctgaaaatgtagtgtaaattgtgtttttgtttatgttaaaaattcttgtttctcagtactcttggtttcttggcagatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggtaacatttttaaagataaacaaataatagaaataatcttttatagcatataaccaaacatgcacatgtagaatgcaaactgtttttaccttgaaggtagtaaacatcaaaataagactgaaatttaaaaaacagattttctttgagacttctaaagttgctttttctttcataaaaaaaatctgcttgagatataattcacatatcataaaatttatcctttcaaagcaaacaagttagtactttttagtttatttgcaaagttgtacaataatcatctctatctaattccagaatttttgatcaccataaaaagaaacctcatacccagtcacttcccccaccccctaatgcctggaaaccacaaatctactaactactgctaacctgtttctagagtttattactctgtacattgcatgtaaatagaatcatacagtatgtggtctttgtgacttttcttttttttttttttttccggagacagagtctcactctgtcgcccagactacagtgcagtagagagatcttcgcttactgcaacctccgcctcccaggttcaagtgattctcctgcctcagcctcctgagtagatgggattacagatgtgcgccaccatggccagctgatttttgtatttaatatttttagtggagactcaaactggtctcgaactcctggcctcaagtgatccacctgcctcagcctcccaaagtgctgggattataggcatgagccacctcgcctggcctgtttgcttttatttagcataattttttcaagatttatccatattttaggatatatgagtacttcatacctttttatggtcagataatattctgttatatggatataacacagtttgtttatctactcatcagctggttagacatttggcttgtttcgtttctttctttttttttttttttttttttttgagacagggtcttactctttcattcaggctagagtgcaatggcatgatctctgctcactgcagaccgtacctcaaacaatcctcccacttcccaagtagctaggacgacaggcgcaccactatgcctggctaatttttttattttttgtatagacgaggtctccctgtgttgcccagcctggtcttgaactcctgggctcaagtgataatcctgcctcaacctaccaaattcctgcgattataggtgtgagccaccatccccgatgtgtttctacttcttggctactatgaataatggctttgtgagcattcacgtacaagtttttccacggacatatgttttcagttctcttgggtagacacctgggagtggacttgctgggtcaaatggcaactctttgtttaacttttagaggaactgtgaaactgcttttcaaagtggctctgcagttctgcattctcaccagcaatgtatgaggtgccagtgtctccacgtcttcaccaatattttttattgtccagcttttttaatgtattcatccttgtgtgtgggaaatggtatctctttgtgggtttttttttatttacatggaagaccacacacgtgaataattcaagcaaggaattcacgtcacccaggctggagtgcagtggcgcaatcttggctcactggaacttccgcctcctggttcaagcaattctcctgcctcagcctcccaagtagccgggactataggcacatgccaccacacccagcttatttttgtatttttagtagagacagggtttcaccatattggccaggctggtcgtgaactcctgacctcatgatccgcccacctcagccccccaaagtgctgggatgacaggtgtgagccaccacgcctggccctctttgtggttttgatttgcatttccctagtaactaacaatattgggcatctgtttccgagatgagaaatttgccgtcacccaggtgggtggggaggaaagctgaaaatactttaggcatctcttttttttttttttttttttttttttttttgagacgggagtctcactctgtcgcccaggctggagtgcagtggcgcgatctcagctcactgcaagctccgcctctcgggttcacgccattctcctgcctcagcctcccgagtagctgggactataggcacccgccaccacgcccggctaatttttttttgtatgtttagtagagacgagggtttcaccacgttagccaggagggtctcgatctcctgacctcgtgatccgcccgcctcggcctcccaaaatgctgggattacaggcgtgagccaccgcacccagcctactttaggcatctcttattgtggtaaatgccagccttggatagatccctctaaatgaaaggatgaatttcagcaaaacaactaataattacttggagccaatgaaaagtttcagctcaggaaaaagtatttactttgaagattcagaggaaaaatatctctcaaaattgttttctctgggaaaacagaaaattttagaggatatcagtttagtatcccgagaaagatataagaagacttaatatacgtgaactagtaacaacttccataagatcacagggtgagatgaagggagaaataaaaatccagtttatggccaggtgcagtggctcacccctgtaatcccaccactttgagaggccgatgtggacggatcacctgagatcaaggagtttgagaccagcctggccaatatggtgaaaccctgtctctactaaaaatacaaaaattagccggacgtggtgatgggcatctgtagtcccagctactcaggaggctgaggcaggggaatcacttgaacctgggagccgaaggttgcagtgagccgagatcgtgccactgtactccagcctgggaaacagaacaagactctatgtcaaaaaaaaaaaaagaaagaaaaattcagcttatccaagtaagaaaaacaaaactaagagcagaattatatattaagacacaaatggaatgactcagtctcagtggagacaatagaatcagtgatgtagtgagtagcttgagaatgcaagggaaaaaagagattaaaatggggtggggtggaaattatctttgttgacaaaaggaggtaaggattcagcctaagaatagtaagtgtacccaagcaagaaagcaggataattgaaacagataagtgtgttataaataaatacataacaaatatataacaaaaataatagaagactgtcttcagaattggaagaaggaagactgggactgaagaatttcgtacccagctcactgtcatttatgttgaaaccaacaaaaggtcattttcagatatgcaaaaagtttagaaatacatcactcatttgtcttcactgaaatactgattttagtcttcccaaattagtttatatatttaacccaaatgccagtgttttgttttttttttttttttttttttggttttttgttcttttccctttgataaactttttctaaagtttgcctggaagaatattcaagtgaaaataactaagagagtttggcaaaaaacctaataatacaggaacactagtttgcagtacattataggcagatcagtggaacaggaaaacatgtaaaaacaatacatgataaggaaaaagtttgcatgaaagggccaggcatggtggttcacacctgtaatcccagcactttgggaggccaaggtgggaagatcacttgagcctaggagttcaagaccagcccaggcaacatggcgaaaccccatctctacaaaaaatacaaaaattagcctggcatgctggtgcacacctgtagtcccagcttctcgggagtctgaggcaggagaatagcttgaaccctggaggtggaggttgcagtgagccaaaatcacgccactgcattccagcctgggcaacagaccgagactgtctcaaaaaaaaaaaaaaaatgatttttttcaagtgctttaaatggttatgtatagtataaataatctacaatggagatatatatatatatatatataactttgataaaaaatatggttaaacaataggggtttataaaaacctaattatttctgctctcagactaattaatccttacagtcagcatgtaatattagcctacaccagctcgacagacttgatctcgttagattcatgagatagaataaaacttggccattattcttcacaaagaatgattgtggcttgaagttttaaaagcgcagaaataaagaaggaaatcacaattaaacaaagccacttttcccaatttcaagaaataagagctttcagaaagagttggcagccttgcatcctcatctggaggctgcaggcggtgcctcacagccctgtgcccgccctgatactgggagatgcacctggacttcatggaaccctgtgggtcatgcttccggacctgtcggctgacacatcttgctgtgcagcttctccacctgctctccatcactagaagctacaatagtctttctgtttccaaggagatttgcctttgatcagagtgccataaatgtagatggatgactaaccgagagcgcaggccactcaccgccattcctggtgttgataaatgtacccctttactgtccacatactccagagcttgcagttccttccgctggtactcacagttactgaaatcatgtcattagtctcagtctgcctgccagatatttcagatgcctttgaaatactgttcttgcagtagcaattcatttttttaagtgctaaaaaaaaacttgcagttttatttgtgaagtgtaattttgcctggagatataacattttggtctgggttaaatagctcctaaattctcaactgaaatggatatccttgaaaactgatttatcaagctcctgagagtgaactatcaccttgcttccactaagtaatttgtaaggtctaagatccgcagtccctggtgtttttttttttttttttttttttttttttttttttggtataagtagctctcagacttttacccacatgagtttccattaaaattgtacaagctttgactttaaatcagctgatgaatagaaggagttgatgtgtgatcagctggtgctattgggaaaactgatgataagcagtggagcaggtaagaacgtattgttcctgaaccattggaggaactagcagcagtgacctctgaggagccctgggaacaccctggagctcctgagcaacacgttgcttgtgatcactgacctggatatcatgactgtgtgagcaacaccccccacacctcagtagcaaaaacagagaacagtggcagcacatcgtgggctgactgcagttgattctggctctcttacatgagaatgccaagtcatacaagaaagtgcctgccatgctgagcttctctttaccttcttgggttttaatggcattgcaagttatcagtataaaaactcatattagttatactaaatagttggaccaagttaagatattaggttgttatgtagtgtgcattttaaagtaaaacaaatgatagagcttttagaagcatctattatgaaaatgttccttcaagtctgtgccttatgaatctaataagcttttgcttttatatcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgagtaagctgggctccattgtagagacattctgtcatcttcagcctcatgatagtagtctactcctgctattgtggtacttctggtccagttttccttaaataatcgtagaaaaatagaggagtttatacagattggcaattttattttagttcatttttattataaaagtggtaagtgcttattttgtaaaactcaaatgatacagatgtgtacaaggcagaaaatttacaaaccatgccttgtagttttgcccccaaaataactctagttattggtttcctttgtatcctttcagaccctatttctgcatgcattcttgcatgtaacacatatttcaaacatgcaggaagataaaaaggagaaaataatgagctgtcatatactaccatctggattaagaaataaaacacaatcaatcgagctgaacccctccccaccaccccatagcctctcttgtctcatccgtcctctcccattagaggcaggcaaatatcttgtatttggtatgtaccttttccaaatgcacatattttaaaatgtaaatgggattatattatacatactttatatatataatgacccgatttttttcagtcaacagtaggatgtaattatcattccaatgaatacatacagcctgactacctagaattccgtagtatggttattccatggttattaaactaatcccctcttactagatcttgtttattgtttttcactgttatcaacaatgcagtattgaacatccctccctatacaaatatctttgggcatttttgcagttacttatataagattttttttttttcaagaccgagtctcactctgtcacccaggctgcagtgcagtggcagaatcttggctcactgcaacctccgcctcccgggttcaagcgattttctcacttcagcttccagagtagctgggactacaggcatgtgctaccatgcccaactaatttttgtatttttagtagagacagggatttcaccatggtgtccaggctggtctcaaactcctgacctcaggtgatccgcccacctcagcctcccaaagtgttgggattacaggtgtgagccaccacgcccggccttataggataaatttctagagttaaacttgctgggtgaaagtgaatacatattttagaattttattacattctttgctcatttttctcctgggttgtgagagttaaatatatttcctaaatatatgtatttcttctgagaccacttttttttttcttttttttttttttgagacggagtctcgctcttgttgcctaggctgaagtgcaaaggctggaatgcaatggcacgatctcggcccactgcaacctctgcctcccagatgcaagcagttctcctgcctcagcctcctgagtagctgggattacaggctcccaccaccacacccagctaatttttgtatttttagtagagacagggtttcaccatgttggccaggctggtcttgaactcctgacctccagtgatctgtccgcctcagcctcccaaagttctgggattacaggcgtgagccactatgcccagccgagaccacttttaaattaactctggcagaagtacagtgcataggaaatggcacttaccaagcactgtgcccaacactgcatatatcacctcattaccttatttgttcaaaacaactaacttgtgatgtagaggtactcccataaaaagtgagcttcggaaaggttttgtaacttttccccaggatcactgatatggcaggagcaataagagtcgttgtagtagtagtataacaatggtaattattatagataagtgtttatttagcccttcctatgtgccattctaaatgccttacatgtatcatcaactaatttcatcttcacaataaccctcagagataaaacctttgctttcctcattttacagaggaggaaaatgaaatgcagaactagtaaatggtagagccctgacagaacccaagttcgtctgattccaaagtccatgttccttgcactataccaaagtgattctcagtgaagaaaattaaatatttacacttggtttgcccatttgtgttttttttaaaatctatattaaagctaggcccaaacatggccaggcatggtggctcacacctgtaatcccagcactttgggaggccgaggccaaaaaaaaaaaaaatttaggcccaaacaatttaatagatatttaagtcctgatagcagcaactatttgggggaaaaatactcataaactggaagaaaaaaataatattttttaaaaattattttcttttttttttttttgagacggagttgcgcttttgtcacccaggctggagtgtgatggcacgatctcagctcactacaacctccacctcctgggttcaagcgattctcagcctcagcctcccgactagcagggattacaggctcgcaccaccacacccagctaatttttgtattcttagcagagacagggttttgccatgttggccaggctggtctcaagctcccgacctcaggtgatccgcccaccttggcctcccaaagtgctaggattacaggcgtgagccaccgtacctggtgttaaaattcttaagtaacaacagttgcttactgatggaaagtatgccactgctgttctcacacattggaatcaaatccgacactgccaccctcatttcctgtttcacattgattttcttgagatacttctttttatcatagcaactgcgaaaaacccagctttgcaaagatgagatattgctaataggaatgtagcacaatctaatgttaataccattaactacctcaagctaataatttgggtgatgttcaacagatgttaggcattgctgtgtttcccttcatgtaaaatattctgtctctgtgagttcaccacagcacccccgggcttgttggcacacaattttggaaccactggtgtaactactttgacctcagatactcagagaagtgcatggccactgccgtaatctcaggctctgcttcctcaggatgttcagttcggtggatgctcgactgataaatacagcaaatataagtcaaaccatcatcattggggataatgaagatttgaaaaaaaaaaacctaacatttattcctatagtactaaaatcttgaggatgaacattaatactcagttaattataatatagaatgccatgttgacaatgctgttaacagtaattttcttatttaatatttaaagttatatgaatctattctaaatatttctatgatatgctctatttttcccctataagtatgtcttactatagtcttcatctcttttagtggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggtaaaaaaagaagttttaaaattctttataattaaattttttttctcttactttaaaaatgtagatacaaattagattgcaaaaggtggtctccgacagattaacaggggaaagacagcttccttccagtagtaatttggaatggaaacatttaaaaagtaatttcatgcggtatcttttctttataattagaaccctgttaaaaaatataatggacatcagcatatccagaatattgagtttatatatgtgcactgatgattacagaatattttagaaatattaatatgcaaacatccaaaaagatccaacatgggcaggtagaatattttaaatttaatatattaatgttattaatataatacattatattaaaaatttaattgattaaattaaatatattaaaattgacgtattaatatttaatattttaaatatttaattaatatactaaaaatctcattctcaaaagagtaataactagtgtaccgtatgtttgaattcaaatcaattacattactctttttttttaactataaagaataacagtaactgcttgtggataaattcactattatctgtcctaaaatacccttggaaggttgttaaattcagtcattaggtacttattttacctatcttggtaattctacattttaatgtctactgtaacctactgcttactgagcattttcacgtttggtgtattatttacctatctgggagtattagacttatatgtgcaagatgctggagagccacaagtgaccatggtatggaccaattcatagactggagtggagaccgacatacatgtgttcatagaagtttaacactctggcttggcgcagtggctcatgcctgtaatcccagcactttgggaggccgaggcaggaggatcacctgaggtcaagagttcaagaccagcttgaccaacatggtgaaaccttgtctctactaaaaaaatacaaaattggtcggctgtggtggcccatgcctgtaatcccagctacttgggaagctgaggcaggagaatcgcttgaacctggtaggtggaggctgcagtgagccaagatcatgccattgcactccagcctgggcaacaagagcgaaactccatcaaaaaaaaaaaagtttagtactctcagtaagtatagttaaaaaatacagagcacagggcagaacagagggtagtctctctcagtgtggaactggcaaattcatgccatctcctcccaccccaccccatcccttaaacattgctatcagttccctcattcaacagatatttgttgggctgtgtaacaggcactgttgtaggaatttgggatacatcactaaacaaaatgaaaatccctgcccttgtggagcttacactctagcagagggaggccagttacaaacaatatacacaataaatatacatgaaaggataagagctgtggtgaatggcacagcagagtaaaaagacaggaggaatgggtagagtgcaggatgcagtattagacggggtggtccttggaagtctaactgagaagatgggagctgaggaaaatcttgaagaagggagttagctggcagctccctggatgtgagctttcctgcaagaagctttggctagagcaaaggccctaaggtgggggtgtgcctggtgtgttcgagagatggcaagggagcccatgtggctgagcaggattaagagccagtgaggggaagaggtgatggagagccagagcagtcagttgagggctagagtcccagagtaactggaggcctgagtaactggaaggatggagttatccttggctaagatgcagaaggctggttggcagagaagatcaggagtttggtttgggttacctaaattgggaatctaatattgaattacatattaagattcaaaaattctgaaaacagactggtggcacatgggtgatatttaaagcatggccatcagctgacagtcgggataagagaagggacggaagagaaaggagaaagtatgaaatagttgtctaggacaggggtcagtaaacttgcttttaaagggccacagcataaatattgtacacttcgcagccatagtctctgtcacaacgactcacagctttgccattgtagtctaaatgcagacataaataataaatacaccaattttctagtcatcttccatggctgtgttccaataaaactttatgcacaaaaacaggcatccagctcctgggccatagtttgctgacttctgttgtgagagaatggaggaatgataggctagggaagtataaagataatgattgcctacagcattaacagtccattcgagctttgtggccacgtagtgacagtgaaaatgccaagttcagccacataggtacagggacctatggagatggagaattggatccattatgttttgccaggtaatatgttgaagtgatctaagggcaagagagctgagggtctatgagaggtagtgattataatgatcgactggaatttcagctgagttaggaggacatctgaggttgaggatcagcagatgggcattcccaggggattgttggagtcagaataccacatggtatgagttggaaagataggatgtggtggtctgagaatggaggagttgccattattagtaagcttaaggtaggaagtgtgagcggctgatgtatgtggaggacaggatcattggagcagaggagatcaagaaccaaaagaccaaagtaagaggatcagctctgtatacctaatcaccaagaattaaggtagatggccaggtgcagtggctcacacctgtaatcccagcactttgggaggctgaggccggcggatcacctgaggtcaggagttaaagactagcctggccaacgtggtgaaaccccatctctactaaaaatacagacaaattagtcgggcatggtggcaggtgcctgtaaccccagctactcaggaggctgaggcaggagaatcgcttgaacctgggaggtggaggttgcagggagccaagattgcgccatcgcactccagcctgggcgacgagcgaaactccatctcaaaaaaaaaaaaaaaattaagataggaatggagtgacagggcactttttcttgatgactctagatagggcctcagaatcacttgcagttgttagtgtaagaccagaaacctgttcatctccaggttattggtgtgtgcaaatgacaaggattagaaggtagggagggctgcatacacagaagcaccaagcatgatgcagctttttacacctgtgagtggtcagtattgatggtagagagaactaggggagagaaaggcaaaaagtcatctagtaacggggactctaaaaagtgggcaaagtttggggatagctgaaggaaatgagaaaggaaactagcaggagatgatgaaaagagcgttgactatggcaccaaagaccccagaggggttagaatccgtggatttacgtggcaccccacaggttcccacccagtatgtaacagagcactattctaggaggcatggaggatttaaattgtgtgtttgtgtgtgtgtctgtgtgttatatatgtgtttctacccacagagtgctatcaggtagttgaaagacaagacgtatctctgtgaaacagtaacaacatcgagtggtagttgttctagaacttagataagaatgaacatttgaaatttccgtaggttttggtctcggtattggtctggaaatgggttatgatgaatctactatagttaatattaaaccctagtaatctaggcattgttaccttaattatagcagaaagtattctctttttattcataggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttgggtaagtcatctgttttgaatgtttgagttacttcaattgaaattgaacatctaaagaatttattacaagtacatagaaaaactttttgtctattttcttataaaacttgagtttctgaataaaacttttaagtaacaaaagaaagtcaattattatactgttttatataatgtatatgtcactaagttgagatggtttcacatacaaagaagaaaataataaagcttatgcgagttcatctgagtgggtggaatgtaactattaaaatgtcagtaaggaaataaaatgaggattagacccataacagcatagagaataggagagagactattatcagattagtgccttaaaaatctctcaggggctgagcacagtggctcacacctgtaatcccagcactttgggaggccgaggcgggcggatcacctgagatcaggagtttgagatcagcctggccaacatggtgaaaccctgtctctactaaaaatacaaaaaattagccaggcatggtggcatgcacctgtaatcccagctactcgggaggctgaggcaggagaatcgctagaacccgggaagtgaagactgcagtgagctgagatcgcaccattgcactccagcctgggcaacaagagtgaaactgtgtctcaaaaataataaataaacaaacacacacaaaaattagccaggtgtggtggtgggcacctgtaatcccagctactcgggaggctgaggcaggagaatcgcttgaacctgggaggtggaggttgcagtgagccgaggtcacgccactgcactccagcctggcaacagagtgagactccatctcaaaaaaagaaagaaatggacagtaaagaggaagaccaaataaatagaatatttgaccctgggtgatagaaataattgaaaatagtagtttgggagagaggggagagaagactccttagtatcgtcttaaagagtttttaaaataaatacttaaataataattgaataatggaaaagaaataaaaatgagaaagagctgtcaattttaaatgattgacaaagtaaatttagtggagaggttggaaaataaagtcaagaaaatttaggaactgatcaaaatgatatatggaaaatagagaaagcatagaaaggattaatcctcagtagatgtaaaatctgacaaaaattttggaaatagaaaataaagggaattatcaaaccaatgatctaggaaaacttcctagagtggaagagataaaagttttggattaaaatgctcactgaatgccaaataagatgcctgtaaaaaaaaaaaaaaaaaaaaaaaaattaagacatatggccacgagatttgagaatactaagagttaaagacatgtcaaagaggaaaaacttttcctcaaccctcttaggttcagtgatggggcctgcaaattaaaccaacaaaaaacagattagcaagggaaaagacagatttagtcatgtgtggataggagttcacagaaaaatgtggttcaaaggggcagttagaatgtggggcttatataccatcttaatagaggaaggggagaaggaggggggcacttatggaaaaacaaatgactgttaggaaagacagatggactgttaggagaccagatgggagatacaaagtttttatgacaatgtctgtttaagtgtggtgtgaagtcttatctctgtttaaaagggtcagccttccctggtttttcccagggaggcaatttatgacaactgagttcttttgggaggccctgctttttggcagataagagatttcagatgccttctgctcaaaataatttttatgccacagtggcatattctggaccccttcagagacaattctgaaagctctggaaagaaaacaggaacccaaaccagactgacatcagcttaatatcagcaatcctggagactagcaggcaaagaaagtgagcacaggtcgtgatttgataagtggtggaacccacccatgggtccagtgaagaaaacccatagtcacagtcaggcagcagggccagtaagcaatctatgcagactaacaaaagtcaggaggaggctgggcacggtggctcacgcctgtaatcccagcactttgggaggctgaggcgggcggatcacaaggtcaggagttcgaggccagcctgaccaacatggagaaactccgtctctactaaaaatacaaaataagctgggcgtggtggcacacaccagtaatcccagctagtcgggaggctgaggcaggagaattgcttgaacccgggaggcagaggttgcagtgagccaagatcgtgccattgcactccagcgtgggcaacaagagtgaaactccatctcaaaaaaaaaagaaggaacagggcccacccaacgtagagagagagtaagaaaggaatggttttattgataacagtgaagaatgcaaatgttacttctcaaccaaaaaaaaggagagaggcccttagaaactccagggaaaagattatacaagagagcaagatcaaatataaaacaaaggaagttgtggccaggcacagtggctcatgcctgtaatcccagtactttgggaggccaaagtgggtggttcacttgaggtcaggagtttgagaccagcctggccaacatggcaaaacctcatctctacaaaaaaatacaaaaattagccgggactgatgttgtgcacctgtaatcccagctacgcaggaggccgaggcagaagaatcacttgaatctgggaggcggaggttgcagtgagctaagatcgcaccactgcactccagcctgggtgacagagcaagactccatctcaaaaaaaaaaaagttggtaaaatgtacaaaaaagtcatccatttgacatgatgggtaaacattctccttttggttccataagagtcatgacattgttccaattagggaaggaaatttgtcatcatgtaaacaacgattgaaatcaacatacagacctaaacaaggttacaggacagaacaagatgtaaatgttaatattgatgatataaaagtaaaagtacaatcgctaaaagtaaaagaaggcatacagggaaggcttgggtactaatgacatctcacattgtgggaaggggtagtggtcagaagttctattgaaagttagaaacataattagtacatgacccaacagtatcatataactagcaaaattcagagaagaataaaacaaagtgggggtggtatgaatgagataaaacctcatctttcataataaaggggcaaggacaatagataaatgtcaggcttttggacagaaggcaagatttcaggtccttctgtgtgtaggtagccacctgaagagctgaaaacaaaaactgtttaaaaagcgattcccttggggaagggaaggatgagtcaggggaatgttgcttttaattataaacctttctgtctgggtacagtggcccatgtctgtaattccagcactttgggaggccaagacagacggattgcttgagcccaggagttcaagatcagcctgagcaacctggcgaaaccctgtctctaccaaaaatacaaaaattaatcaggcatggtagcacgcacctgtagtgccagctactccagaggctgatgtgggaggatcacctgcgcccatgagatcgaggtggcagtgagctgtgatcccgccactgcacccccagcctgggcaacagagcaagaccctgactcaaaaaaaaaaaattgtatttcagccagctttcgtagttgtcctcagcagtaaggttggtccataccattcagcctatcattagcagaacggtagttctgtttctataatgtggcctttcagggatacaaattacttaaagaaaattttgaataattcaggatatatggccagaagccatttgaaatggacaataatataattatttggaactctttaaaacagagctaaagctttacgtaataaccattaattctgatttttataaatgtcacaaggtctcttaagtagattgttacaataaagttgtgtttataatgaagacattagcagtcacagcagcttatgaatgaaacaaaggatccagccaactgtggctctcggctagtaagagaaagagggaagtgtgtgtacatattcctgtcttcatctctccccttgagcatcttatagggtgttgtgcttttcttttagaatttgaataggcttcattagtgagggtgacaaaaagaatagacttaaatacttggattataaactagtagcagttttgataaccagggccagggatcatatttagaaaactgactgtcaaaaattgtttgtagccaggctcagtggctcatgcctgtaatcccaatactgtgagaagccagggtgggaggactgcttgaggccaggagttagagaccagcctgagcaatgtagtgagaccctcgtctctacaaaaaaattaaatattataaaataatgtaaagagtgtcattggattgtttgcaactcaatggataaatacctgagggaatggatggcccattctccatgatgtgcttacttcacactgtatgcctgtatcaaaatatctcatgtactacacaaatatatacacctactatgtacccacaaaaatttaaaaattaataaatactagatgcacttaaatatttaaaatttttaaattaggtgggtgtgatggcctgcacctgttatctcagctagtcaggaggctgaggcaggaggatcacttgagcccaggagtttgaggctgcagtgaaccatgattgcaccactgcactccaacctccacaatagagtgagaccctgtctctaaaaaaaaaaaaaaaaatgtagataagtaatgcacagttatcctaatacatagcacagtgataggaagctattatggtttatgtaaactctttctttgatttatttgctccaatataattttgctgctgttttttgtccatgtgtattgtaaaaagataaggaaaagtacatacaaccatagaaattttagcgttctactcaaatactctcatttaacagaaatgagtgtctgtgccaggggtttgtgatctattccatctgtccaaacctgtccataaatgactttttagcctcttctatttgagggtgatgatatacgtacatttactcatcttacttcctgtatcttcttatcagggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtatagtatttttcatgtttattttattatctcacaatgagtgaaccaaaatatattattgtgaagtatagtgtctttgtccaagcttatagatactgaatttatatatactgttctatacgaacatattctgtttttcttaaattggaaagagatcttaaaattcaacccaagtaatatgacacctgtcaaaagtaatttaatgggttatcaggtcactaaatctttatatattcattaaagaagcatttatcaagaggct

SEQ ID NO: 1407 - DNA, 4437 bp, Homo sapiens
gcgcggcggccgtggttgcggcgcgggaagtttggatcctggttccgtccgctaggagtctgcgtgcgaggattatggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacatctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagcttgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataaagctgttattcttgttataccaaaaaaaaaaaaaaaaaaaaa

SEQ ID NO: 1408 - DNA, 4254 bp, Homo sapiens
atggctgctgttcctcaaaataatctacaggagcaactagaacgtcactcagccagaacacttaataataaattaagtctttcaaaaccaaaattttcaggtttcacttttaaaaagaaaacatcttcagataacaatgtatctgtaactaatgtgtcagtagcaaaaacacctgtattaagaaataaagatgttaatgttaccgaagacttttccttcagtgaacctctacccaacaccacaaatcagcaaagggtcaaggacttctttaaaaatgctccagcaggacaggaaacacagagaggtggatcaaaatcattattgccagatttcttgcagactccgaaggaagttgtatgcactacccaaaacacaccaactgtaaagaaatcccgggatactgctctcaagaaattagaatttagttcttcaccagattctttaagtaccatcaatgattgggatgatatggatgactttgatacttctgagacttcaaaatcatttgttacaccaccccaaagtcactttgtaagagtaagcactgctcagaaatcaaaaaagggtaagagaaacttttttaaagcacagctttatacaacaaacacagtaaagactgatttgcctccaccctcctctgaaagcgagcaaatagatttgactgaggaacagaaggatgactcagaatggttaagcagcgatgtgatttgcatcgatgatggccccattgctgaagtgcatataaatgaagatgctcaggaaagtgactctctgaaaactcatttggaagatgaaagagataatagcgaaaagaagaagaatttggaagaagctgaattacattcaactgagaaagttccatgtattgaatttgatgatgatgattatgatacggattttgttccaccttctccagaagaaattatttctgcttcttcttcctcttcaaaatgccttagtacgttaaaggaccttgacacatctgacagaaaagaggatgttcttagcacatcaaaagatcttttgtcaaaacctgagaaaatgagtatgcaggagctgaatccagaaaccagcacagactgtgacgctagacagataagtttacagcagcagcttattcatgtgatggagcacatctgtaaattaattgatactattcctgatgataaactgaaacttttggattgtgggaacgaactgcttcagcagcggaacataagaaggaaacttctaacggaagtagattttaataaaagtgatgccagtcttcttggctcattgtggagatacaggcctgattcacttgatggccctatggagggtgattcctgccctacagggaattctatgaaggagttaaatttttcacaccttccctcaaattctgtttctcctggggactgtttactgactaccaccctaggaaagacaggattctctgccaccaggaagaatctttttgaaaggcctttattcaatacccatttacagaagtcctttgtaagtagcaactgggctgaaacaccaagactaggaaaaaaaaatgaaagctcttatttcccaggaaatgttctcacaagcactgctgtgaaagatcagaataaacatactgcttcaataaatgacttagaaagagaaacccaaccttcctatgatattgataattttgacatagatgactttgatgatgatgatgactgggaagacataatgcataatttagcagccagcaaatcttccacagctgcctatcaacccatcaaggaaggtcggccaattaaatcagtatcagaaagactttcctcagccaagacagactgtcttccagtgtcatctactgctcaaaatataaacttctcagagtcaattcagaattatactgacaagtcagcacaaaatttagcatccagaaatctgaaacatgagcgtttccaaagtcttagttttcctcatacaaaggaaatgatgaagatttttcataaaaaatttggcctgcataattttagaactaatcagctagaggcgatcaatgctgcactgcttggtgaagactgttttatcctgatgccgactggaggtggtaagagtttgtgttaccagctccctgcctgtgtttctcctggggtcactgttgtcatttctcccttgagatcacttatcgtagatcaagtccaaaagctgacttccttggatattccagctacatatctgacaggtgataagactgactcagaagctacaaatatttacctccagttatcaaaaaaagacccaatcataaaacttctatatgtcactccagaaaagatctgtgcaagtaacagactcatttctactctggagaatctctatgagaggaagctcttggcacgttttgttattgatgaagcacattgtgtcagtcagtggggacatgattttcgtcaagattacaaaagaatgaatatgcttcgccagaagtttccttctgttccggtgatggctcttacggccacagctaatcccagggtacagaaggacatcctgactcagctgaagattctcagacctcaggtgtttagcatgagctttaacagacataatctgaaatactatgtattaccgaaaaagcctaaaaaggtggcatttgattgcctagaatggatcagaaagcaccacccatatgattcagggataatttactgcctctccaggcgagaatgtgacaccatggctgacacgttacagagagatgggctcgctgctcttgcttaccatgctggcctcagtgattctgccagagatgaagtgcagcagaagtggattaatcaggatggctgtcaggttatctgtgctacaattgcatttggaatggggattgacaaaccggacgtgcgatttgtgattcatgcatctctccctaaatctgtggagggttactaccaagaatctggcagagctggaagagatggggaaatatctcactgcctgcttttctatacctatcatgatgtgaccagactgaaaagacttataatgatggaaaaagatggaaaccatcatacaagagaaactcacttcaataatttgtatagcatggtacattactgtgaaaatataacggaatgcaggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaatataaaacatgtaggtccttctggaagatttactatgaatatgctggtcgacattttcttggggagtaagagtgcaaaaatccagtcaggtatatttggaaaaggatctgcttattcacgacacaatgccgaaagactttttaaaaagctgatacttgacaagattttggatgaagacttatatatcaatgccaatgaccaggcgatcgcttatgtgatgctcggaaataaagcccaaactgtactaaatggcaatttaaaggtagactttatggaaacagaaaattccagcagtgtgaaaaaacaaaaagcgttagtagcaaaagtgtctcagagggaagagatggttaaaaaatgtcttggagaacttacagaagtctgcaaatctctggggaaagtttttggtgtccattacttcaatatttttaataccgtcactctcaagaagcttgcagaatctttatcttctgatcctgaggttttgcttcaaattgatggtgttactgaagacaaactggaaaaatatggtgcggaagtgatttcagtattacagaaatactctgaatggacatcgccagctgaagacagttccccagggataagcctgtccagcagcagaggccccggaagaagtgccgctgaggagcttgacgaggaaatacccgtatcttcccactactttgcaagtaaaaccagaaatgaaaggaagaggaaaaagatgccagcctcccaaaggtctaagaggagaaaaactgcttccagtggttccaaggcaaagggggggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataa

SEQ ID NO: 1409 - DNA, 34570 bp, Mus musculus
  misc_feature (1)..(448): "n" at positions 1 thru 448 can be any base
  misc_feature (6032)..(6550): "n" at positions 6032 thru 6550 can be any base
  misc_feature (29960)..(29979): "n" at positions 29960 thru 29979 can be any base
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacagtttgagacatattcagtctcctttgactctgtttcccccacgagcctcctgtatcttctcccttccctccaaaccccttcttcccagtgaatcccttttctgctttcatgtgtgtctgtgtgtgactgcacatgcacacatgtgtgagtgtgtttagttggggtttctggcatgagtgtgggtgaggagttatttacctaaacaaaggcaacttagagtgtctaagtcagcactgaggactctaactcctccttctccggcagccatcgcctgcctatggcacctctgagagggacaggcctcatgaggtgacactatccatgccatacatgacatatattcacacatgagaggatttgatggacccagccttgtacagatctacagtgagttcatgagtaccataaccatgccatgtatggaagatataaaactcatagaaacgccttcccatagaacgccatcttacactctagccatccttccttctgagatgttccctgagtctcagaggtggtgatgctgcggtctcatgtagggacacttcgaccagcacatagtcaccacattcaccatcacctactacaaacaagagctagaatttttttaatttctaattttgagccccaacgtatcttatatatgtgaatccataaaaggaatttgcctgagtggccatcattttttgaaaggtgcagtttacgtgagcatgagcctttaatcctatcacttagggagcagaggcaggtagatcctgtgagtctgaggccggcttatctgcaagtgagttctaggtcggttagggttacatagtaaaaccctgacttaaaacaggcagggaggcaggcaggcaagcagacagacagacagcaaaagagtgaagtaggggagtaagaaggaagaaaatatgagtattatatatactaagtattctttataatgtttattatatgttgtgctggatagtttcatgttgatgacacaatctagactcatttgagaagagggaacctcaattgaggaaatatttccataagactgagctatagagacacttgtagggcattttcttatttaatgatgggcgggggtgagatggggggcacctctggcctagtggttcaggttctcaggctaaagaaaccatgaggattaagccagtaagcagcatcccttcgtggctcctgcatcagctcctgccttcaggttcctgcctggtttgagttcctgcgttggctcctctcagtagactaggactcaggatctgtgagcttaacagagcctttcctcctcacactgcttttgctgatggcactttaccacagcaatggtgaccctaactaagacagaagtgtatgcacaccaagcaggctgcattgaatgcatgtctcactgtggggcacagtcacagtgacaggatacatgatgtatctaacagggactaaacactcaattagagcagaggctgaagctgatcccagtggcagacacttggagtctcagcatgtaaaaaacagaagcaggagggatgccatgagtttgaggccagcccaggtaacaggcaacagcgtgagagatcttgtcaaacacacaaaccagaattacaaaacaaactcagagatatggcttaacagataaaggtactcactgccaagcccgaggacccaagtaagaactgactcctgcaaattgtcctctgtcctccacacacatatgtagaatgctcatgctcatatacacacacatacaaatacatacttgcatgcttacatacatacacacatatatgcatgcatacataatacatactacacacatatacatgcatgcatgcatacatactacatgcatacatgcatacacatgcacacacatatatgcatacatatggcaacaacaatatagagtggaaattaaaatagaccagcaaggtatccgaggcagaggcagcaaagtctgtgtggcatgatggaagtttcagctgttccagagttggccctggggacactcgttctgcgcaaagaaactggtgggttttgctagttgtgggaggtgctgtccttgttccagaaaggtctccattatataatgtgctctttgtgtggacaggccgagagctctgtgggatgggctgggaggtccagtgtggcatgctagctgtgtcagaacagggcactgactggtgtatctaagtaaagaggtccttgtggtgtagggcactggctttctgagtgttcttaggacatatgctagacccgtgactctaaggccagagtcaaccactcggctggggcccagacatcgtgcttgccaagtccttcaggccactgtgtcaagttcgagaaccgctggctgtctgaggcataactgtttggtgtttagagcatcttagaacactgggcaaagcctgctccttgatgaacagcagaagtgctgggtcctccatctggcctttaggtgctgtatctacaatctttctctcagtctctcagccttatacagcacattcacacacagctctcctgtgagagatggctgcttggcccttcatctcaagctccttccaccctgtaccacttagctgtgttacattaacctggtaccactgaaaatattctcaacacatggatagatacatatacaagtgcatccacaggctgtcctgccctccctgttagacacactgccccacgttgtctcttccctggccagtgctcacttagtactcatccgataaacacctgatccaggcatctgacttgctctccaggctgaggtgcccagatacacacatagtccctgtaaccttacggtaaccttggtgtgccaacccaacacctggcctgtttcctccctgcagactacttactacctggtacctaaagacagcagagctgtgtgtgtgggagttggctcccagcaatgacagcctttattgcccacttcctgtgttgactgtaatgtgcttttgggtcctgtgcctgagtgagctgctaaccttcatactgcttccactgctgtctgaagctcagtttccacgtctgtaatgtggtgataacatgattacacctaaaggctgttcagaggaggaaaggaagggagagtgtaaagaatttagcttgatgtatggaacacaacactaagaaacagcctctggaggggttagccatagttttcccctgagacagtcaggaaagtacaaatcctttgcaaatcgtgtggccttgtgcggagttaggtttgatgcctatggagctgcctccagatgctggctctctaaacctttctcactataatcatgagaagaagaaaagaaggaggaggagaaagaagaagaagaggaggagggacagaaggcactgtttctctaccttccagtccccaactatggcaggcaccatgccactaacttctaacacagatgttttgacagttttgtatgaagagtgaatgttaagggttgggcgggcagcctgatatactggcctagcttatgggcaggacttggtttgaacccctggtcctagagggggaaaagagtgtgttgggcatggtggcgcatatctatcaccccagcattccagagccagaggcaagtgggtctctgtgggttcaaggccagtctcctttacacagtgagggcctatctggaaaagaaaaagaaaaagaaataagacggacagacagatacagagtataaagactgagaaaagctaaagttgagagacatagggctgtgtaactgttgaatgctgtaaaaattcaaggttgattttccttaaggacttagaggggccctactcttcctgaggctaatgagctgtgaagtgttactgctcaccactgaaagagacccagaggaagaacaacgaggtctctgcccaggaacagagaagagcactcccagttaataaaaggctgaggcagaggggacccattccctccagcaacgctctaagcctctgtggcacaagttaatttctctgtgggtacaagtgattataactagcagctggaacaaatgaaaatgaaatacaatctattaacagcgaggcataattactgagaaaattccacctgagctggggcttaagcagccacccacacctaagccagacacaaatctggcaaagccaccactggtcacttcagtgagaagcctggggtagaataattcagacttgagaaagctgtccacagggtagaaattgagaatcagaaacaaactgcaaattgaaatgtaatcttggctgtcttacctggaagcacccctaccccagctgactataacagaaaattgaaacctctgccttcatctcttttaagtcaaggaccacagcataggcattgccttctccatcctggagaagctactctggttctatgggcttgaaggtttcagttaccatagcaactctctgcaaccattagcctacaagagctaattttggctcacagttttggaggtatcagtccatcaccggttaacaccattgcttggggcctatggtagcagtatgtggcagaaccacgtggcagaggaggccatctgtgtgacgtacggatgatgctctgaggggatccctggaacccaaacgtccctctgctctacctctgcttctgtttggagcttgggtctacgaggcagtgtcttgccccaaacattcaggtcatccaggatggccctaaactcacagacatccttttgcctcagcattctattatctgtgttaagatagaggggctggagagatggtttagtggttaagagcactgactgctcttccagaggtcctgagttcaattcccagcaaccacacggtggctcacaaccatctgtagtgggatctgatgccctcttctggtgtgtctgaagacagcaacagtgtactcacatatataaattaaaaaattattaaaaaaatattgcagataacaccgggtgtggtggcgtacacctttaatcccagcactctggaggcagaggcaggcagatttctgagttcgaggccagcctggtctacaaagtgagttccaggacagccagggctatacagagaaacccaatcttgaaaaatcaaatatatatatatacatatatatatatgtatatatatgtgtgtatatatatatataacagatagatgttcctccacactgctttaagccccatctctttatttattgacctatatatcttatttatttttattattgtattagtttgtttctctggtgctgtgataagatgggaggaaagggtttatttgacttacacatcataacccgtcatccagagaagccagaaccttgaggaaggaactgaaataaagaccaggaaagagcgctgtttgctgacttgcttccaggctcaggtctagctgccttttatacacctcccaggaccatgtggccatcgctggctcagcacacagtgggctgggctctcccacatcatcagcaatcaagaaaatgtcccttggaccaggcagtggtaacagacacctttaatcccagcactcaggaggcagaagaaggtgaatctctgagtttgaggccagcctggtctctcatctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatgtgtggtgcacagactaacatttaggcaaagtactcatacacataaaataataaaaataaatctgagagagagagaacaaaggaaggaaaggaaaggaaaggaaaggaaaggaaaggaaaggaaaggaaaggaaaggaaaggagaaaagaaaagaaaagaaaagaaaagaaaagaaaagaaaagaaaagaaaagaaaaaaaattgttccacagacttgcttacaggtccatctaatggagacagttcaactaaggttccttcttccaagttctgtcaagttgacaaccaagattagtcatcacaattacattcagtgtaagtgtgtgtgtgtgtgtgtgtgtgtgcatgcacacgcgcgagcaacacttatgtggacgtcagaggacaacttatgggatttggctgtctccaaccatttgtttcctgaggcaggaaaggggaggggaggggaggggaggggtgggtcctgactcttcctgacattccctctgagtctacaatgcagcctgagaatcactgaaggtacaatgattgagaatcctcaaggagacagccccagatcaattccaggctccacccacctcctcacattgccatcagcatcaccacacccaatgctgtgtccacagtgcaccacacacggcacaattctttctacacactttctcatgcagtcctccatctctctctgtctctctgtttctctctctgtgtgtctctgtgtgtctctgtgtatctctgtttctctgtctctctgtctctgtctctctctctctctgtctctctctctctgtctctctctgtctctctctctctctctctctctctctctctctctctctctcacacacacacacacacacacacacatctccctaatgtccagcttaggtcctacttccacacagtcttccccaacctttgaagtgtctagctatatgaagtaagatgctggttttgattttatccttccaagagtggacttggttagacctagggatggctttttcatgttgtcatcacatccacagatgacaagtttcccttcataaaatccaatggtgggttaggaccaacaacgtgaagtccattaagcacgctgccaagggtagaaggcactacagaaaaggtcacgctaattgcaactaaatatgttcagagtcccgaacaaggaaactcgccttcccgtggtttgtccttgtcacaggctttctggaccactgacaggaaatcacctaaggtcaaagcacaggctgataaggcacccagaaaccagctattcgaaaaatagttgaagacattaggatgtgggttgggacacataagactcacaggcacatgatatctgtacccagaggtcacttgggagacatgctacctacacacacggtcctgtctgaggcccagctgggggtgtcatagaagatacattttgactcagcatgaaggctcaagtttctaattctaaacagtaaaccatcctactctgaaacatgatctaccctcccccttcgcactttattttatggatgggtcttatcacatagacatctttagcctcaaactcagaatcttcctgcatcatcctcccaagtgctggggtgacagacattcaccctcacagctgaggaaccatgatttcatgaggcagctttctcccccttgagtgaggatgctttggtctcctttcttgcatcctctggagaggaggggtgggcagagtgaggcgtgaccggcttgtctttcaaagtccctttccattccttggaatttctcatgctttggtcttttctggacagtgtgctcagagcagcaaaagctgacttgtgtgtgttgctgggcaggaggggcgtgaccgcatggtgtagggttggaaggatgaacagtgcttcgtcagctccagactcaggaagcgccgaggcagtgtatccctgagcagtacaggaccagaagagctggagaggggctccaaccctgtgccctggctttcttcctccttaagaacagttttgggggccagcaagatggctcaacaaggaaagacatttgccaccaaacatgactacctgagtcccacattcccacattgtaggagagaaacaacttccacaagttgtcctctgacctccataggctctctctgtgtgtctatatcgttgtctgtctctgtctgtctctgtctgtctctgtctctgtctctgtctctgtctctctctctctcacacacacacacacaaatagtgccccgtatgtagtacctacatagtgtagtgggtacaatcttacactatcatggactaagtcaggaaatatcctcccacggaagaaaacccaccaggacaagacctggaggggaaatggatcaatgtccaccacaggtcttcatgaacgaagtggctctcaggatgggacagagcaggggtggagagcaggggcagagagagcctgcagagcagctatgatggaagcaggggatgacaaatgtggagtcaggacacttgggtgcaaggttaccaccattgatgcgttacaggatcctgggtaggtcagtctccatctctgggcttcggggtcctcctgtgtaaaattggagctgtgggggtggcctaggtaaccatccatgtcctttcaagctaggtgtctacaagtttacttgtggtggaacgcctttttgacctttttctctgagtcagagacagctcgatggccatatttatactgcactcttgtctggtaatttcattttacattttttcttctagtattcttagggttcttccctttgaaagaacttaactctttcaaacttgagctgaaaagagggaggggcagggttccccctccctggccgggcaaaaggatggcagtcacaggttgatcaagtgccctggctcgcctgggactgaggggtttcccaggacaggggactttctttggttctgggcaaactgggatggttggtcaccctagtgataaggaaagtgagtgtgtagaggaggctgggagtactcttttcttagccccttctatgaggagttccccaagtctatatgcatccctcatagagatccagtgagcagaagggaggggcagccttcacaccagacgcctggcccagttcagaccatgagtgccaggaaaggcactgaaatgcttgcgtagtactgactctgtggggggagtttccctttttcttaaaaaaaaagaaaagaaaagaaaagaagggggaaaacacacacacacacacacacaccagaaaagactcagtggaaaaaaaaaaaagagatgagtcgagaggcaagcagcaagccctcactggccccaggagaccgcacatggctcatttgtttaagtttgcagctgacgcctgccacctctccataggcaccagcacaaaccttctcgacatcagacagtgaccagcctggtgacgcagagctgcagctatgaactacccactaaccctggacatgggctccatcacatacaatatggatgacctggtgagtcgagtcatgtggctccctgctgctctggtcctgcttggaactttaaatatactatgtcaaggaagaggggatagcttgggaatcccgccgcaaggattatagaacataggcaaatacatccacttttagactcttattgtctcccatatctgttgcccttaatagatgccaaagggaggtgggagacacaggatcaggtttggcatctcctgctgtgtgactgaggacccagctctgcctcttgcttctttaacagagaagtttatcttgtctccctgagttaaaatggcaaagtcatttggaaggggtatttttgtttgctgcttttttttttttttttttttttttgagactgagcttctctgtgaagcaagcattggctgtcctggaactctgtagaccaggttcaaactcacctactacctgccaagtactgagattaaacgtgtgcgctgccactgctgctgccgccgctgccaccaccaccacctggctggaagttttcttcatgtcagtttgctggcagtgctagtcaatcaggcagtgtggagttgttggctgggagaggaggggtgggcagagtactcagttggtagagtgcttgccgagtgtgcatgctgctaggctcatcctcagcttgcacagagtgtggtggtacacacctataatcccggcatgagaaaggtggaagcaaaagactcaggggcgggagcctagaacacattgagaccttgtctccaaaagaaggtatatataattgttcatcttgctgaatgacttgatcattaaggcacaatacaacatccatctgtgttgggtggagagactgagaacataatctttgccctcaagtcgctgatggtccagacaaggtggagctaatccctggctggaaggctttagacagtgattttgtatagatgaagaaagcatgaggccagacgtggcaaggaagaggatcccaggggtcaaagtcatgcagctgtattgctcctaaaaacaccttggagcatgtcactttgccctgggagggactgtcatctctagagacacagtatcttggaagagtttcttaggtgggagcttaagaaagaaacaagcaaagaaaggaagcagtgcctggcaccctctccgccccccgcctgagtgtcttccagttaagcataggagttcacttgacttggctgctattgaactaccaaaggatgttgttaggagcacttcaagtggaaaaacccagggctgtggggcagtgggttatgggcatcagtagacttagaaccttcatcatgaccttattctctatgaactccaaacccagagccctatcagctctcctgccctaatcacaccttgaggtgtttccccccgactctcccagctcgccaggatctgtggtctgctttatcattcttcccactatgtcgctgggcttgctgaacctgctcagctggcatcacttgggcactcatggggattctgcaaataaaaggacctcaggcttggctcaatgctttctgttgttgtcttgaaaaaatttggggggtggggttgtttgttggcttgtttgtttgaaacagagtctctgtgtagcctaaatctgcttcaaactcatagtcctcttgcctgagtcctttgaaaacctaactgttctacaggggagtgtgctcccacgcttgcttgccctcatccccactgccagctgcccctgatatggttaggtggtatcttctgccctcaagctgaccatcagccctgacccacttggatgcctttgtaaccacctggagacctggccgttcctggcttctgagaaacctcaagagtttcccctaactgcacgcctcacatcacagtgtgacctactagagacaggtggtagtgggggccagagggacagcaggacgtgctcatgacatgaagcaaacctacattccaaggagagaagcaaggtaacttctttcatgacacatatcaaacccaaggccctgagctatgtgcccagacatctcgctaggagtccaggggttctaagacaaccctgtccctggagtccttcaatcagacacgttcttccttcacccaccacccactctcttcaagggtggttgtcactctgaaacacagatcctcctctttggccccactcaccttctaaaaggccatgaccggccttggcatactgccctattctgtcatagcatgcatgtcctggaaagacagaactggcagaaaagtttagcattagtggcttctccataaaacaatgggtttctgttttgctctgtctgtctgtcatactggacaagacagtatgacaaggcctcctgcatccccagctctcccaaggagcacttcctgccctgtgacagacacttggaaggactgcaggcttggctcaatgctttctgttgctgttttaaaaaaatttgggtgggcgggcgtgtttgttggcttgtttatctgaaacaagagtctctatgtagctaaatctgcttcaaactcatagtcgtcttgcctgagtcttttgggtactggcattataaatctctgaggtcttagcttgacatttttcttaggcgtctgctgagcttctcccattgactttattttctgctcctcactccctgtctttgacccagctgattactggcccacttctccagatcagaaggttcaacactcccaactctgagttctgaaacaacagtcttgataagtcaaccatcccttgtcttaattttaattttctttttacatttgtttatttatagtcaacagaggataacttgtaggattcagttctttctttccagcatgcgtgttctagggacttaactcagctttttaggcttgatggcaggtgccccattaagtgtctcaccaactactctttttattatttttaatgacaactgattttgagacaggatttttttcccctttgcctttttgagacagggtttctctgtgtagccttgccaatcttggaacttactctgtagaccatgtcgatcaggctggcctaaaacttagagatccaggttggagagatgactcagtggttaagagaactgacagctcttcctaaggtcctgagttcgaatccagttaaccacatggtggctcacaaccatctgtaatgagatctgacaccctcttctggtgtgtctgaagacagctacagtatacttagatataataatgatacataaatctttaaaaaaacaagaaacaaaaaacttagagattcgcctgcctctacctccttattgctggggttaaaggtacgcaccaccactgccatctgagacaggatttttctaagtagttcttcctgtccagaaacttgctatgtagattaagctggccctgaactcagagatctgtctgcctctgattttcaagtgctgagattaaaggtacgctccactacaccctgtccatgtagaccaggctggcctcgaagtcagaaatcctcctgcctctgcctcccaagtgctgggattaaaggtgtgtgccaccactgcccggctaacagcgaatttttaattgttgttgttgttgttattattattattatttattattattattattttgtgtgtgtgtgcgtgtgtgtgtgtgtgtgtgtgcgtgtgtgtgtgtgtgtgtgtgtgtgtgtgtgtgccatgtgagtggaggtcagagagcaacgtttgagaattccttctctccttcttccatgggttccagggagcaagctcatcatttgtcagttgtcaggcatgtatagagagcaccttttcccatcgaggctcttttgtcccttgaactcaaagatcacctttgatctcccacacacttgctggccatgggcagctactaaacttcttgatggctaagagccaggagaagaaccctagcacctagagtaggcatggccagaggtcaccccactctggcgaggtgggccctggtggccctggaggagatcctgtccaggagaaccaccatgagttctttcctgtcactcctcaaatcagaggtccgtggtggggcttgtctggaacccacacagactagttctgaaataaagttctaggcgtcaggaggggaggctgccatagaacagggtgaagctggtctaagtctcgcttccctgacctttcctcatagacgatcaccaggagccatgaactcattgtgaccagagcatcacaggtcacagtctgtccacacacaagtgtctcagttcagcaagggagttaaaaagaggaaccaaaactcgctcaagctgtttctgggctttacctgagtggaggggagggtccccccgttctaaccacgtgaaaagtcccacagaagccccgttagaggaagcctcaaccgagggtaactggagggatcagaaatgaggggaaacctgaaaccagccttcgaggggttgcattagggagaatataggttctattactcagatatcacagaccgcattaggaacatatctctttataagagacacggtctgcctgttcttattcctttgggggacacataaaaagcaacaggtatttgggatgcgaagtcagaatacaggaatgagtttcttttgggaatgaaagacaaagtatttcaaatctacaccatcccagaaggtccagcaagatggttcagagggtaaaggtgcttgctgccaaccctgacgacctgagttcagtcctgcgtctcatatggtaaatagagagaaccaactctgaagttgtccactgatcttttgaaatttccacacagagataaatataataattttttaaaatttaaagcaagtgttatctcaggaggcagctttaagaggttactgggagattcgtgtgcacgttcctcaaatacatgaccccatgttcacagtgtagacagccattggttctcaagatgaactcattttaaacctaaagacgtggcaaagcgatagttcttccacgtttcccccagagccaagcatgacgccaatgactaagcatttaagagattgaaacagggagggtcataatgttcagggtatcctgagttcaaggctagcctgggctacacagtgatatcctgtttttaaaaactacacactggggctagagagatggctcagtgactaagaacacttgctgttcttccaagtttagtttccaatacccacatctagtctgatgagctcttctagcccccaagaacacacacacataagtggcagacacacacaatatatatatacacacacacagaaacataagtaaaataaaaagaaatctctttaaaaaatctaaaaatcaaaagcactacatactcctaatggccaaaaccctcaggcagagatggaagaggacccagtaggtttgctcctttgggggaaaagaaggacatggggcacatgacaaaccagagtcctgaattgtctttggggaattctgaaagaagagtgtgttgagaagaacagatctacacacacacaacccagtctcattcctatagactgcaccctgcaagttactgaaggctgaacttaatagcctctcccagatcccaactggtggctggaaacacttacgtaaaaggagacataagctcagcagaacctggaaacacaagcctgtaatcccagctactcaggagactaaggcaggagggttcaaaattgaagacattgcctacagagtgagttcaaagccatcctgggcaacttagtgacatgacactgtcttaaaacaatgagtaagggccaggtggtgcctgtgcacatctttaattccagcactggagaggcagaggcaggcagatctctgagttcgagaccagcctagtctatagagtgagttccaggacagccagggctacacagagaaattctgtcttgaaaacacaaataaggcctggagagatgactcagcagttaaaagcattggctgcacttccagtgatcctgagttcaattcccagctaccacatggtggcccgcaatcatctgtaatgggatctgatgccctcttctggtgtgtctgaagacagctacagtgtacttatatacataaaataaatattttttttaaaaaaatctacatctgttttaaaaacacacaaaacaaaacaaaagtaagtaaatagttatgctcttttgctatgaaagtatgaggattcaagttcacatacaagaggatccctggagggctggaggaagggctcagcagttaagagcaccggatactcttccagaggtcctgagttcaattcctagcacctacatggtacaaccttatataactccagttccataggatccaacactctcttctggtatgtgcaggctcatgcatatgggcacagacatatatgcaggcaaaacaccagtacacatgaagtgaaaataaagtaaagaagttcatttaacacttgggaggcagaggcaggcggatttctgagttcaaggccagcctggtctacaaagtgagttccagggcagccagagctacacagagaaacaccctatctcgaaaaaccaaaaaccaaaaaccaaaaaaaaaaagttcatttaaagggaggggggatactggcactcagtggtcagcaagtctacataatcagtgagtttaaggttcagtgagactgtctcaacagataagatggagaatgctgggagaagacacctaatatctacctctggcctccataaacacacacacaaacaataccccccccatacacacacacacagtcacagtcacagtagctcagtggaagagcacttgtctagcttgcaatattgctccacagagaggagcctgggggaacatacaccgggcaggaagccctgtaggctcctcagggggggattagggtgggcctgtgggcaagagaagcagagactgctgtgggaggggagctgagaccatgctaggaagcaactcaaatctgtccacacagggcgtgacagacaaccaggacagcagtgaacagcagactcgagaggcaggggtgactttcctgacacaggaactcttcccttgcacatgagttcaaagatggtggatcactgtgcctgttagaaagttgtccctccatcgactggagctacttgggagcttctgcccagtcctgctctatacgtgaggctcacatcggagtctagctgtctcctccgaaccaaaggcccttcccagcccttgaagacagttcccataggcttcaggcttctttttcctatttcctacgttcatagtacctggaaatgcctttccagggagggattttccaaacctttcaacagagccaactgacctgaaaaagagttcacctcatctagaaaaagcctatgacggcctgaacgcgcaaggaaggtgtgtgtgtgtgtgtgtgtgtgtgtgtgtgtgtgtgtgtctgtctgtctgtctgtctgtggctctgtgtatatgtgtggtgtttgagtcagggtctaagtatgctaactaggctggtttcaaactcatgagctcaaatgactcgttcgactcagcttcccagctaacagagactaccggctacaccccaacccagctctaacttgccccctgcaataattctacctggtgaatttgggttccccatctctgcttatgaaggactctgcattgttagtgttctccagccacaccccatccaaagcatcctgaattctagaagaaaatccagggtacatccttaaggaatgttccccagcctgctcccagagaaatccagtcagcaaaccctcacaggctgcctgctagacaactcgaagaaacacacacacatatcacacacagagagagacacacagacacagacacacagacacacagacacacagacacacacagacacacacacacacacacacacacacacacggctagacattttgcctgtcccagggagagaccccagtcttgtgtagagggaagaggagcctgtgtggatcccaacaggaagaacactttgcgtcgcttacttcttcttcccacccaacctccaacagcaggaccagcttcccatcctcctggcccagagcccacagtgctttctaaatacatccctagcttatgtctggcatcattccaggcagcatccgttcccatgggacatgcatccctagagcttgcgtgtacgctgtctgtgttctgtttcagtgcctgtctatgcagcagagcagtgtggtcccacctgggcatatgtctatgtctatataggatgtgtgttgcccatcatgtgtacccacagtgcgggtacacatgagggtttctgctgccttttgtagccaagaatgagggagccattcatcccatcgctgacaatgcactcttcccagtgtgttagctaggccagctccctttgacagcatctttccaccaggccagagccaaccctacctaaggcttctctctagggtttgatggagaggagaagtacccaagctcctgtgtatggggagtggctttaacacttgtcgagcttcaaaaatgtttgacaccttctgttgatttataccacactagcttcctcccatcttctcctcctctgaagactttaccaaaacaatacctgttggcatggaggaagagacagaccctcacccccttacctgtcccagtgggaatatcgcactgattgaacttcaagtggaaaggaagttcactagcctagataaaaacttgagccgttatcatgaaaggcctttaggccagacaggctggctagactcacatgctcccctagataggttcggctgttaccaaggtgaatcatcacatctccaccatctgcctgatgcctgtgctcaccagttcaccccacagcttccccctccacctcctactgcagagtcagagtcaaatagctctactcagttctactggaaacaactccctaaagggatagagagcccaagttagactccagaggcagagtttacagacagatgcaaacgtgtaaatccctgctgagccccagatggagtcaacttgggggccttgaaggaaggcaagagtttagagaggtggacttgaaaaaggagcgaaggtgacaggaagctgcctgggttgctggggacaggtggctgtggcacacatacctgaggaatagcatgtctggtgcagtgaagtcgtaggtaaggtctaatacatcaaaggagtgtacatttgggagaaatttatttttgcagggctgaggctcaaactctgggccctgtatatgctaggcaagcatctacctgctgagatgcactgccaggactactttagataaaaatgtaaaggccttctacctggggcattgaagccctatctaacaggtctattgttttcaagagttgtagggccattctctctctcacaggctgtttttgcacacgctaggcaagggctctactccaaaaatgtttgtttgttatagagacccaagcaatacttgccagcctggaactcatgtagatgaaactgtctttgagcccttcatctcctggctcttctctctagtgttaggataacagcctgagccaccatacctagccatatatataaatggttttactattgtatacgatatcagaaaaacaagacaaaagacacctgtttcttacaggtgatggggagtcattaaaggacactagatctatagggcctagttaggtgtggttatttgacctgtgtaggtgtagatttggtttgtttgtttttgagacatagtctggctataccgacaatggaactcaaatcgtgggcttaagccaccctcccccctcagctcctgagaagtgcagggctgggatgtgagtacgaggaagctccccctgtccactgggtaggaagtggaaaagaacagaaacagtagttagaaaaggacccataaggccggagcgaggctccaaggtcaagagcacttgctactcttgcagaggactggggttcaattcctagcacccacatagtgatttccaccatctgtaacctcagttccaaggaaaccagggccttcttctgacctccatgggcactaggcggtacatgcacacatacacacaggcgcaggcaaaactctcatacacggaaaataaaaaggtttgaagtctaatttaaaaaaaaaaatgaaagaaaagtaaggggaaagacccatagagagacaggatgggggacaggataaggtgacggcagaagaagggacactggagagtgggtagatagtgctgccattgtaccatgtgtccccatcctctctgaaagagccacctgctctagggaccaaaagaccaagatggggaatcagtttacccatcaggggaagtgagtgtgtcacccacaacagtgtgcctggtggcaagaaagatttaaggtaaccatgaaccaacccctactggcaggagcccctcactctcctcaaagggggtcagcacagagatgagatcgccagagcctagaggacagaacagcccactgtctcttacttccctggggcccatcacttatatcactgtgttttgaacccatagtagttcgggtgtaattggttttgtattgcccagggaggaggttgaccagggcagggcagggcaggaagaacagagtaaggagctgaggaaacgcaggtgcagggcagctgtgagtgaaaggtatgaaaacaggcaccctgtcttcctctgtggttagcaggcaaacaacctgagagctggggtgatggagggcagtggcagatggggaggaggacgcggaggtagggacttccggagatataacaggcacgcccccttcttttccactcagaaaacgcttcctccctaccctgcgcctagtctccctgtgtgtgactcatatttgcctccgctgctgggttcctgtgcctagggagtttactctctgcttgggaagtagctggaaacttaggctccgcccctttcccagaagcctttggagggaagtgtgggtagtagctctcattgtagcgttattgattgactaaagacaggcaaacgtgcctttaagcaaacctcctctttgagcaagacaggtctgtaaaataagaggaagattacatacctcaagcgtgtgtggattaaaccaaataggaggccatttcctcagtttcagcaataatcaagacaggaagaaggggagaaatttagaggaagtaagccagctacatcagcactcaaccattccccacccccagtgagagcttagatttactacccactgtccttacagaattggaatattggcttcttgttcctatcaggttccattcccaaatgtcagtactgactgcaatccctaagccttccatctttaagaacaccctaccactttgtgagtgactactggtccagtttacatacaaacaaacgaacaaaaacgaaagaaaagaagagaaaagaaaagacctgaagtttcaggccagggatgtggctcagtggtggaacagttgctcagcactaccaaaaattagaataaaaaattatatttaagagacagggcggggctggtgagatggctcagtgggtaagagcacccgactgttcttccgaaggtccagagttcaaatcccagcaaccacatggtggctcacaaccatctgtaacaagatctgactccctcttctggagtgtctgaagacagctacagtgtacttacatacaataaataaataaatcttaaaaaaaaaaaaaaaaaagagacagggcatgggggcatgtgcctttaatcccagaacccagcaagcagagactacccaaagctcaggtcaacctggtctacatagtaaattccaagctagccaaggctatagagggagatcctgtctaaaataaatatgcagaagggaggaaggagggtaaagatggcatgtttaaggacaggccaagaggaaacagaatagtacagacaaaaagcattagcctggaaggacaggaaacctcacaggtggcagcttcctctcagaggaaaaaagaagaagaagaagaagaagaagaagatatggctatcgttttcatttctctttcttttggtccttacagtacaaggaactggccttctacagtaacagcacggagattcccctacaggacagtaacttctgctctacagtcgagggacccttactgacgtcctttaaggcggtattcatgcctgtggcctacagcctcatcttcctcctgggtatgatgggaaacatcctggtgctggtaatcctggagaggcaccggcacactcggagctcaaccgagaccttcctgttccacctcgcagtagccgaccttctcttagtcttcatcctgccttttgcagtggctgagggctctgtgggttgggtcctagggaccttcctctgcaaaactgtgatcgctctgcacaagatcaatttctactgcagcagcctgctgctggcctgtatagctgtagaccggtacctagccatcgtccatgctgttcacgcctaccgccgccgtcgactcctctccatccacatcacctgcacggccatttggctggccggcttcctgttcgccttaccggaactcctctttgccaaggttggccaacctcataacaacgactccttaccacagtgcaccttctcccaggaaaacgaagcggaaactagagcctggttcacctcccgtttcctctaccacatcgggggcttcctactaccgatgcttgtgatgggatggtgttacgtgggcgtggtccacaggctactgcaggcccagcggcgccctcagcggcagaaggcggtcagggtggccattttagtgacaagcattttcttcctctgctggtcgccctaccacattgtcatcttcctagatacactggagaggctgaaggctgtgaatagcagctgcgagctgagtggctatctctctgtggccatcaccttgtgtgaattcctgggcctggcacactgctgtctcaatcccatgctctacaccttcgctggcgtaaagttccgcagtgacctctctcggcttctgaccaagctgggctgtgctggcccggcctccctttgccaacttttccccaactggcgcaagagtagtctctctgagtcagagaatgctacttccctcaccaccttctagatcccggaagtctcggggcccctgtctgtttctgttttccttgggaggataaagtggtggcggaacccatccaactcgagcttgggccagtgtccccagatgggaaagctagataaactctctcaaactttcccaaaggggaaagcagcccaaaggcaaagcaagctatatccaggccacctgtatcaccttagatgaagagaactccatacacctcccatcctaaccagctaaagctaagctcagctttatttcttcctggccatagggacaaccacctctgctgtggcccacagtctcatcttcctcctgattatgagcccagactctcctcccagaatgtattccatcatcttaaagactactggctgccacagctacccaccactcctataccacagaggaatagccagctggcggcggcagactatggccttaatgtgcctgtctcataaatacagacttcatgccagaccttcaaccgtgcctttctcttaaccaagcagaaagctgaaaccgatctactttaggtagctgtctggttccaacctaaccagcattgggtcagccccatgttactggatcttggattacagactgagggcaagttccagaaggttctggaagctagccagtatcctaagaagagtaaagggcaagccagcaggaaagaggcccagtggaaaagtggaaagacaccttttccaggctctaaggaagaacaagtaaaaatcaaacccagctgtcttctccacccaatgtaccaaagcttacagactggtggggaaatgagatccagggccctcgtggattctacgcaccaatggggaaggaagccaacttgcctggggaaagcaagatagcaaagtggtcctagcctcgagagaggggacacctagctaagagaatgacgacagaggttcctgtcttcattaggcagaggcaatataagaagccaacctgggcaggcaagtcctcaaaccccaggaaggcagtaccctgcccctgggagggtaccactcacatggaaccagaggaagctgctccatgcatacataggggaagttagcaggcaattctgagctcggcttcctcccagccaccgatctgggggcgtgggggtaggaagcagagttgcctagtaccactcaagccaaccgtacaagctccctgggggatcccactggggaaaccaatgctatagcttcagagactgtatcctcattgcagaaccgtgaagacacctggggacccccttttctgctcccagcatccaacaaccagctgggaagaggcaaaccgggcacagaaataaaaatgcaagagatggcatttttgaattttctctttttaataaaaaggcacctataaaacaggtcaatacaggcagagacccccggaacaagcctaaaaagtgtttcaaaataaaaacaggaagatgtcttcacatattgtatttatatatttatattttatatatatatttatataatggtacaaaatggctggggtatggccatggatggagggagaaggctggcctgtggagatcaccttgggaagctagtggtagaggtgggagacgagggcacaagaagagggcattgggccctttgtggccggagccctctccttggagcagggcaggctagacagtctgggcagggtagggatgtgggtgggggcacaaggcccagatggaagcagggagggcagtgtctggcaggaaggacaggtttccacccacctctcaacacaagagaccttggctatggtccctgggaggagcaggggaagccaggggcctgcagccagctctggagggggcttggtgcctggcctggctgatggtggacagcaccagactgggagaagtgggcacaaattccctttgtattacagctgccaaggcaaaaccaggccctgcaggtcagaaaggctggggacagggccctggtaaaagacaccctgtctagaatggcccttggccctggaggcaggacaggaaaggccttagccagggagctgcccgccaccttacaaggcaggaaaggacgtgagaaaaacagaagtagtttactcctggggccaaaggggacaaaacacccattcctgtatggcttgagtctgaccaggggcgggtgaggggctctcctgggaagtcagaggagaggcagtggctgtgtctggtgggcatagacagatctggtgcatggccctgagccctggacagaaggaccttgcagagagtaggcaggcagaggaggcaacaggatgttctcgctcacactgccttccctcgctcggcactagaggtggagggccaactctgtaccttccttctttggtgagaagcaagtggtggtttctagaagagtccatgccctgaagggttacctggcccatggctactgcagccagggtcccagcatcctaacccctccatagctccattctatggggccacacgctgccccttccttctcgccttttatcctagaatggggataaagggcttcaagttctggctaagatgtagcagcagaggcacccaggctgggggccctatgtcactggtgtgggtaaacacatgtacatgtgcacacctgctctccggaaatcactcagcagcagacaggcggccgtcgtagagggacgggggtagattctcagtcctcaggggctcaccaaatggaagcctagatggtctgatatcattttataggtggggcttatggagggtgcataggactgtatgtctctgggtccagaggaatgaagggtgtgatcatttgaaagaggggggaaggtttttttttttctcaatcttttttttttcttgtgtgtgacttctatcaagacacagaaatacggcacacgcacaaaccggcacaaaagcccagctctatttacagctccgctggcacctgcccacctggccagctgcctgcagggggcgtgggagaggaggtcagccacgtcagtagggaaaggaaatgaggcagaaggaaaacagggtaaaagcagagagacgggaaggcgagaaacggacctgaagcgccgccggcaaggtgacagtccacgacgggtcagaggatggaagaccctcctctctccccaaggacccccaaaacatagctgaaagcggggaagtgcaaagacaaagggagacagaagctccacgggaaaggggggggggggcagaggaggcgcagtcctagtgacagaaatggagcagagcccgattccaactcctcacccgacacttgccgcttccccctcagctgccagcacagcaggtttccacaaacaccactccccacacaagcccgttcccacccgccaccctacccctggacccaggccatccatcccaacactggaggaaaaacaaaactttttaaagttaacatattttcagtttccccagccccagaccgaggggcctgctagaagggtagattggccatgctgcccggcgttggcaggtagcccatctggctgtccagagacacactgcgctgacgcagagggtgggacaccatgaggttctgctggggtggggggcccatgagggagccctgtggggagagcatgtgggggaggctgggtgtagacctcgcccccccacacccctctgcttcatcagcataaaattctgctgggtcatgaggccttgtggaggggacatgaccccctggtgcaggccatggggcaccatgccctgttgtgggggcacacctgtcctgcccagcaaggacatctgtccagggtggcacatggacatgctgagcccccgctggaccccctgttggcccgggaggttggggggtcgagacggggtctgctctgccatcatgttctgcaggttcatgagatgcagattggggggctgggccttggggggctggttctcgctcttggggaagtactggagggtgctgcttggtttctcagaggggatgatcctggataagtcgaactcaggaatgccggtaggggtgggccggatcacctcactcagctctgggtcattcagtaccgatgccaccccagggagcaccccgggtgggtatgcgtcgcccatgcggccagtcatgcctttgcccattaggtgctgctgggggggtatgggacccggtggctgggtgggcaggtcctcggggggcagggccatgcctgaagggtagtgctgctgcaggcctgggcccccggccccggtgggggccatggcaccgtgaggttgctgcagccgaggagggaaggacatcatctgggaggagctgggcacagggccacaaggggcatttagggagtctgggcctcctggggccatcatcattgagttttgagaagagcccccagtcccctgtgcattgggatgcagtggaatgttggaccccagaggggtgggggagggcaacatagtagggggaggctcatgggacaggggctgctggcctggcaagttcatgcccatggggctctgggcagcagcagggttcatgtgcatctggttgggctggttattgctgatacctgtgggaggaaggacgaacgggacattagaggccatgcccacccagtttggggaggggtctcccagtccttcccagcccactaaagagctctgggctaggtttcatgaagcgatggtagtcattcaaacggggcctcagagctcacaccacccccatgagcagagactatagaagcatgcagaagccagcatgtccacgggggcaattcctaagcaaacccactgttgccactcccagagagagctctgcctcctcgcacctggcccagagccctgcggtggtgggggtgggggtagcaggggccggtcaggcagcagctcgtcatctgaggtggcgatggtcttgatggcgttgtggtatagcggggtcgagctgggcatggcgtacttggacatctgagacatcatcagtgacagagggttctgggaaggggtggggtctggggaggatgtgaacggtaggctggggttcatgaggccactggaagggttggcgggaggagcggaggagctgttccggggtgcgctaggtggaagagcacctacagaagcggagagacagaaagagagcgggagggggggtgtcactagcgaggttaacgtcccccaaatctccacctcacgtcagacacacccatatcccactgaccacaggttccctgtggtccctacggcccatgcttctccaagcagtttccccagtggggaaagtcctagctccaagtggcacccttcaagatgtttaagaggctccggcagagcatgcccctgcaggaacctacccgccaccaaggctcccacccaagcccacctagatcactcaccctgttccacgttgcccagggtggaggaagagtttatgctgagaggtggctgcttgttctgggagaccccaggactaggcatggctgtcttgggagaggcgacccagcctggagaaggcaccgccatggagggagacttgagcctgctgggtgagccagtgggtgaacgcacaccgagggaagagctgaggacctggggtgacttgagaggtcccggtgggttggcagaaggcaagggtaccatctgggagggagtctggggtgacttgaggttggcagagggtgaggtgaccaggggggagtgcacctggctaagggtgggtgacttcagatgtcccatgcccggtgagcccatctgattaatactgatggtgagatctgaaggccgcctgcctagccccctgttggaggccaagtgcacagacccaggaggattggaggcagggggcagaggcatatggctgagccgggcagtgcccacagtgcccatgggcactgaactctgatcagggctgaacatgtctggagtgttgcccatgtcctggggcatggcttggtaaggtccctggcccccagagaatccctgctggccctggttgggaaactgtgaaggcatgagcatcttctgcggaccccccatcatgccactactgttctgggcccgaacccgagccatctcttcgggactgaggccctgaggacccatcatgtctccagggccccgcatcttctgtgacatcagcatctgctgctggggcgtcatctgcacattcaggttcatgttcatgttcatgttcacattcatgttcatgttgaggttgcctggccccataggcgggtctacctcccgcagcccagactgtcccattggagggctcaggaggccccgacctccaccaaactctatgcccatgggtgtgccggcgagaccatctcctccagtcatctgtcccgggaacatggcagggtccatctgtcgatgagcctgtatcatccgttccatttccatgctctgtcccatgccgctacctgccatgcccaggggacgctgcatgcccatggaccgcttctccagcaactggtgcctcagcagctcctcccggacacgaggggtcatgaatcgctctgcctccccctgcccacctgggtagggcacggcattctgggcaaagttgctgggtcccccaatagggggcaagtcttcattccaggccatgcctggccttacaggtctctgcatggcattcatgggtacttccatgggcatactctgcatacctccaaatccgggcaccctttgcatctggttgcctgggaaacgggggccagggaagggaggtccaggtcggagctgcatgggatcttggacatccataggccctcggagttgtgcacccattccaggtggccactgatccnnnnnnnnnnnnnnnnnnnntcctgcagagggcggcctccgtgcaatccaatctgctcctctttccgccgcttctcctcgtagtactcttcctgcagtttgcgccaggccacctgctcgggcgtcagactgtcctggcccagcctctgcatcatcatgttcatttgctgtcccatgtctccaccctgagggtgccccggcacttcatgctccagagggggacctcctaggctctgtgtctgtgagatcattgactgcagaggctcctcatacttcttcagccccccaggaggggcggagggaggcggttgagcagcagagggcgcttgtgccggtgggcctccctcaccagctcctcccgggggccccttgaggaagggctcagtctccccactgcggagcagcagcctctcgatgtcccgcagtgtctggagggagcgctcccggtgctccagctgctctttggacaggccctcagagcccaccaggttcctctgcccatttccggtgggcgtggcctcccccaatagggcggagccaggggcactgccagggtctcctccaggaggcagagggttgttagcggtggcagccgttggggtgttagggtgggtacccccagtcccaccacctgtactggcagctcccactgagttgggggccaggtcctgactggtgtcttcaggaggcccctccgggggcagagcaggaggggcactgccaggggctgggggtggcggtggcaaaggaggtggctgggactgtggtgtacctgctgatggcgtattcaggggtagtggttctggggtgggtggcactttaggggcctgcaggaggacaaaggtaaagaataagacagatgaggggacatcccaaagaatattagagcctggcaggctaccacacttacctgatccagcttggcccgaggcacattctgctggtggtaggcaaggatggactctgcccggccctgcagcactgcctctgccgctctgcatagggaagcagccacaggcagctcagagatgggcaaaagcaagctggccctcacccaccaaccttgcaccgcacccccaccccccctttgctcaggctggtcagacagacaaaaccctctcacccctcatctctcccaaagacttacgtgttggccagatgggtggtgaagacatagacgaactgtgacggaggctttcctgggacgcccccacccccacccccaggaacgtctggccgaaggcctggctgggggccatgttgggggcctggtgcactgctctcactgaggggcagttgggcagtttggccaggacccaactgtggggtcaccatggctgggtctgctacattacaatctgtaagaggaggaagaaaggagagcgggtgagcggcccagacgtgggaagaaggccaatcagccggtgttcctgccctcagatgctcgctcactgcctcaagcccatgcccagagggtcatctgtccctacagtctccgtttaccagcctggctttccagttcacttaacctatactaacctttgctcaagatggccaggatgcagaaagatgaccatggagagaggtgagaaaaagtgacagaaaccccaaagctctgctctaaagctcccacactcaagcacttgagatcagtcagtttctctgcctctctctctctctctctctgtgtgtgtgtgtgtgtgtgtgtgtgtgtgtgtgtgtgtatgtgtgtgaatttactgtctaaatgacccagccaaggggaaggtagggaggacatagtagtaactgatgattcaaaccacagacagattttcatcttaccccacgattcactaactgtggttttacaaaacagcatttgtttaagcctcagtttcttcatctacaaaatgcaaacactactcatctcccacgtgccctgcccaaggacaagtccttttaaaaacatgggtactacgccacaaagcaaaacatcagtttcaacaagagtcagaaaggctttcacaaatgatcaacgcaagacttcggtcacctctgatgaccaagaatctcacggaggtgttcccatcaacaacatgcatacacacggatggatgcaggtgagatgaacacagtttgcaaggcacgtgagaaagggcatttgcttctgcaccctctctgaacacgagacagtccttttggattttgcaggggaagggcatacatattgcacacattcagtttaagggcacagggcacatatggagctcaacagagaacactaagtgttggctctcagactttatcatgcacaccacgttagctggacaatgacaatgagcttccagagaacctggctgctctgctttgaaagtcccatcactgggctgattataggcaggtaccactgtacctggcttcctgtgtgggttctgggaatccgaaaccttgcaaggcaagtttctcccaactgagccacctacccagccctcttttttggatttttacagattaatcattagtcacatttaattaaaccattagcttcaggtgatcaatttgactttcagccccactcctttgacgaggatggaatgtagggctgaaagccccaaacctctatcctgctttgattttcccagtcaccaggttccatctagaagctacctcaggactgccagacacaccagtcgatacagcattaaacaaaacagaacaacaaaaaaccacttatccctctggagcttcccaggaaacaagagaagaccaaatatatgtttcacaatatcacagactcacatactcggaacagccgaatattcctcaggagcaagacaaatttcgctcctcggtcacaagcctggcattccgttctcacatagataagacccacgactggtcttcagtggttttaggtgaggcagagatccatggtcataccaagaaaaaacaagttaaagcctccggactacaaacagcaagtgccagcacttcccaaaatcacaagaacttgaccaaggtggcagacaccagaggcctagagtataaatcagagcacacaacaggctcctacaggctacggagagggaagcagagtttatcacaagaaggaattttctagtaccctaacagcaatacaagctagcactgttcaaagtatgtcacatgcctggactcaactttctccttgtgccaaatctatatgacaaagatcacttctatagatgagcaatcagaactcctttctcaagtttacagtccctgggatgtaagtaaaggcgcctgggctctgagcctgtctcattgacagctacctcagtctgccttgctgtgtgaagaattcagttgcatggttgaatgctgctgaatgacacagtgacacaagactataatcccagcacttgggagctataggcaagagggttagaaggtcaaggccagcctcatctatacagtaagcctgaggctaatctgtactacatgaaacctggtcttcactgaattgcattccatctaaaagaggctggtcaagggatcttagctatttcttatcgctctgtatctttcaaagtttctccaatgacacgggataatgttacagacacaaattcggggagacaggagggttctggtcccaggaagcagtgacagattctaccactcaagcatccatactgagactgaacatagctcatacagcactagttagtcacatggggccttggcagtcccagccagttgtagagacttcttacaggacactggtcagtagggtctcctcattccctcttgctgactgtttcctccactgtgacagtcatcattacactttcttcatgggcagctgtgaggactaaactcagtagcaaatgtatctttcttctcctttccttaactcctgcctgtaagcagcacacaatttaagctctggctagcttctcacatgcttagttaggttggaagcaccaaggatgtctcgggcctcaggcacagaaggatggattggaatgagagaaatggctatgaatcctagaaatgcatcatgagcattttctgagtgtcatttagagactggagaaaggaaccagggacacaattaagggtcagttcacacctaggcttagcaaggctttgcaaagccaagctaacagattcccatcttcctgcccatcctccactgaccggtaggtggcagcataggccatgaaatctgttagatgtgtaggtgagttgtccggaaaagggattacctgagagaccttcgacagagggagggagaggggaagggaaagagagagggagggtggcgagggtgtgagcagcactcacactatagataaggaaaaagtccaaagtagggctgaagaagagcctgggctcctagtccttgccatttcttgaacaatcccctaaagcccaaggtaagctccctcaggacggacacacacacacacacacacacataccaggggaagggcaccatgaggcacagcatcaatgggcactcactgtgggcggccgcaatgggcttgtcgtcctcctcgctgtctggcccagagcaccattcgtccccactgtacggctgcttccgctccagcacacacctccgtttactccggggtgccacctc

SEQ ID NO: 1410 - DNA, 2517 bp, Mus musculus
atgaactacccactaaccctggacatgggctccatcacatacaatatggatgacctgtacaaggaactggccttctacagtaacagcacggagattcccctacaggacagtaacttctgctctacagtcgagggacccttactgacgtcctttaaggcggtattcatgcctgtggcctacagcctcatcttcctcctgggtatgatgggaaacatcctggtgctggtaatcctggagaggcaccggcacactcggagctcaaccgagaccttcctgttccacctcgcagtagccgaccttctcttagtcttcatcctgccttttgcagtggctgagggctctgtgggttgggtcctagggaccttcctctgcaaaactgtgatcgctctgcacaagatcaatttctactgcagcagcctgctcgtggcctgtatagctgtagaccggtacctagccatcgtccatgctgttcacgcctaccgccgccgtcgactcctctccatccacatcacctgcacggccatttggctggccggcttcctgttcgccttaccggaactcctctttgccaaggttggccaacctcataacaacgactccttaccacagtgcaccttctcccaggaaaacgaagcggaaactagagcctggttcacctcccgtttcctctaccacatcgggggcttcctactaccgatgcttgtgatgggatggtgttacgtgggcgtggtccacaggctactgcaggcccagcggcgccctcagcggcagaaggcggtcagggtggccattttagtgacaagcattttcttcctctgctggtcgccctaccacattgtcatcttcctagatacactggagaggctgaaggctgtgaatagcagctgcgagctgagtggctatctctctgtggccatcaccttgtgtgaattcctgggcctggcacactgctgtctcaatcccatgctttacaccttcgctggcgtaaagttccgcagtgacctctctcggcttctgaccaagctgggctgtgctggcccggcctccctttgccaacttttccccaactggcgcaagagtagtctctctgagtcagagaatgctacttccctcaccaccttctagatcccggaagtctcggggcccctgtctgtttctgttttccttgggaggataaagtggtggcggaacccatccaactcgagcttgggccagtgtccccagatgggaaagctagataaactctctcaaactttcccaaaggggaaagcagcccaaaggcaaagcaagctatatccaggccacctgtatcaccttagatgaagagaactccatacacctcccatcctaaccagctaaagctaagctcagctttatttcttcctggccatagggacaaccacctctgctgtggcccacagtctcatcttcctcctgattatgagcccagactctcctcccagaatgtattccatcatcttaaagactactggctgccacagctacccaccactcctataccacagaggaatagccaggctgggcggcggcagactatggccttaatgtgcctgtctcataaatacagacttcatgccagaccttcaaccgtgcctttctcttaaccaagcagaaagctgaaaccgatctactttaggtagctgtctggttccaacctaaccagcattgggtcagccccatgttactggatcttggattacagactgagggcaagttccagaaggttctggaagctagccagtatcctaagaagagtaaagggcaagccagcaggaaagaggcccagtggaaaagtggaaagacaccttttccaggctctaaggaagaacaagtaaaaatcaaacccagctgtcttctccacccaatgtaccaaagcttacagactggtggggaaatgagatccagggccctcgtggattctacgcaccaatggggaaggaagccaacttgcctggggaaagcaagatagcaaagtggtcctagcctcgagagagggacacctagctaagagaatgacgacagaggttcctgtcttcattaggcagaggcaatataagaagccaacctgggcaggcaagtcctcaaaccccaggaagcagtaccctgcccctgggagggtaccactcacatggaaccagaggaagctgctccatgcatacataggggaagttagcaggcaattctgagctcggcttcctcccagccaccgatctgggggcgtgggggtaggaagcagagttgcctagtacactcaagccaaccgtacaagctccctgggggatcccactggggaaaccaatgctatagcttcagagactgtatcctcattgcagaaccgtgaagacacctggggacccccttttctgctcccagcatccaacaaccagctgggaagaggcaaaccgggcacagaaataaaaatgcaagagatggcatttttgaattttctctttttaataaaaaggcacctataaaacaggtcaatacaggcagaga

SEQ ID NO: 1411 - DNA, 1125 bp, Mus musculus
atgaactacccactaaccctggacatgggctccatcacatacaatatggatgacctgtacaaggaactggccttctacagtaacagcacggagattcccctacaggacagtaacttctgctctacagtcgagggacccttactgacgtcctttaaggcggtattcatgcctgtggcctacagcctcatcttcctcctgggtatgatgggaaacatcctggtgctggtaatcctggagaggcaccggcacactcggagctcaaccgagaccttcctgttccacctcgcagtagccgaccttctcttagtcttcatcctgccttttgcagtggctgagggctctgtgggttgggtcctagggaccttcctctgcaaaactgtgatcgctctgcacaagatcaatttctactgcagcagcctgctcgtggcctgtatagctgtagaccggtacctagccatcgtccatgctgttcacgcctaccgccgccgtcgactcctctccatccacatcacctgcacggccatttggctggccggcttcctgttcgccttaccggaactcctctttgccaaggttggccaacctcataacaacgactccttaccacagtgcaccttctcccaggaaaacgaagcggaaactagagcctggttcacctcccgtttcctctaccacatcgggggcttcctactaccgatgcttgtgatgggatggtgttacgtgggcgtggtccacaggctactgcaggcccagcggcgccctcagcggcagaaggcggtcagggtggccattttagtgacaagcattttcttcctctgctggtcgccctaccacattgtcatcttcctagatacactggagaggctgaaggctgtgaatagcagctgcgagctgagtggctatctctctgtggccatcaccttgtgtgaattcctgggcctggcacactgctgtctcaatcccatgctttacaccttcgctggcgtaaagttccgcagtgacctctctcggcttctgaccaagctgggctgtgctggcccggcctccctttgccaacttttccccaactggcgcaagagtagtctctctgagtcagagaatgctacttccctcaccaccttctag

SEQ ID NO: 1412 - DNA, 32404 bp, Homo sapiens
  misc_feature (384)..(403): "n" at positions 384 thru 403 can be any base
tttaaaaagcatgagtgggcctgacgcagaggtgcatgcctgacatccccgtgctttaggaggctgaggaaggaagtttaaggccaggagttcgagaccagcctgggcaacatagcaagaccttatctctacaaaaaaaaattaaaaattagcctggcatggtacacacttatagtcccagctgctcaggaggctgaggtggaaggatcgcttgagttcaggagtttgagactacagtgagcgataattatgccactgcactccagcctgtgtgacagagcaagaccttgtctctaaaaaaaaaaaaaaaagcatgattgtgtgtgtgtgtgtgtgtgtgtgtgtgtgtgtgtgtgagtgagtgtgtgagagagagagagaaannnnnnnnnnnnnnnnnnnntacaggcacatgccaccaggccccactaatttttctatttttagtagatacggggtttcaccatgttggccaggttggtctcgatcccctgacgttgtgatccgcctgcctcagcctcccaaagtgctgggattacaggcactagccaactgatattttgttgactgaagatttcaaacacatacaaagtcggtctaatgaaccctacatatctgtcatccagcttcatctccccacaggcaatgttattaacacattcattcccctttcctggattattgtgtgtgtgtgtgtgtgtgtgtgtgtgtgtgtgtgtgtgtgtgtgtgtgtgtgtgagagagagagatagcactttggacctatggaggatttctatttggaaagaaaaaggcttttacatacaagatattatttaatagcaaaattggccatgcaggtattttacaattgtacatattaggaaactaatgctcagagaagttatatttgtaattttcaaactggggattgtgacttatgtgtggacccatgaaagcagtgtgattcattgaccgctattaaaaatagaaagagggtcgggcatggtggctcacgtctataatctcaacactttgtgaggccaaggtgggaggatggcttaagcccaggagttccagaccagcctaagcaacataacaagaccccatctctacagtaaatttaaaagttagtttggtgtggtgatgcacacctgtagtcccagctactcaggaggctaaggtgggaggatcacttaagcctgggaggtggaggctgcagtgagccatgattgtgccactgcactgcagcctggctgacatagagagaccccatctctacaaaaaagggaagaaagaaagagtgagagaaagaaagagggaacgaaaggaaggaggaaaggagggaaggaggaagagtagaaaatatgagtatgctacccatactaagcagtgtttacaaaacttactgtgtatttgtgtgtatatgttcatcacacatgtccaactagcttgtgatataaaatatatttcttcctatgggtcatgatcaaagtgacaggattacatgacatgctgaaagctaactagtagagctcatgcattacttattagagtagagctgagaccgaccagagagatagaggtgcaacctgtcagagcccgggaggcaccacagaaatctcaacggtgccagggtggggcccagggaggccggtgttctgggaaaaccaactgttgtgtgctggttgtatgaagtgctgtgttgttgtgggttgtgtgctggttgtatgaggtgctgtgttcttcctgttgtgtgttgtgtgctggttgtatgaggtgctgtgttgttgttgtaggttgtgtgccggttgtatgaggtgctgtgttgttgctgtgggttgtgtgctggttgtatgaggtgctgtgttcttcctgttgtgggttgtgtgctggttgtatgaggtgctgtgtcgttgttttgggttgtgtgctggttgtatgaagtgctgtgttgttgtgggttgtgtgctggttgtatgaggtgctgtgttcttcctgttgtgtgttgtgtgctggttgtatgaggtgctgtgttgttgttgtaggttgtgtgccggttgtatgaggtgctgtgtcgttgctgtgggttgtgtgctggttgtatgaggtgctgtgttgttgctgtgggttgtgtgctggttgtatgaggtgctgtgtcattgttgttgattgtgtgttggttgtatgaggtgctgtgttgctctggagagacgtcaactatggcaccctttgtgtggagggactgaaggccctgctgggtggttgggagctccaggttggaaaacaagctgtgtggggacgagtttaccaattggtatatggctgtgtaccagtcctacgtggcctagagcggtggttctaggagtgtagttctcaggccagcagcatagcgtcacctggacactcttagaaatgcacattatcaggtcccaccccagacctcccgaatcagacactctcgtggtggggcctggcaacctggaggtaacaagccctcctggtgactctgaggcataaagtgtgaggagcactcccctggggatgcctgtttggcattctgtgtttggcgtgtctttgcgcaagcaggcagggtctggtctcagagcggccttgctgggaagcagacatgctgggcctccagtgcagcgtttcttctgtcacccactcagccttacagcctacccagcgcatgcgcccacagcacttaggtgcgaaggaatgctgcacgtttcccccattccctgtgccttccacactgctgactccacccacactaccttagcaacacggtagagttttgcatattctttgaaaatgtgcccagttgcatgtgaatatgagcatgccaacttgcatgatgtgtctgttttgccttctctgttagacaaggtgctcctccatcagaatctcgcctctggctgccgcagtactcagtatacaaacacctgatccaagcaccagactcactctaaccctggccacacaacctgccccaggccgacgttcccaagctcatttgtggcccccatgaccttgtggtaaccttgatgtgcctacccagcacctgcagcccatttcctccctgcaggactctacctgtttcctaacgagaggggagctgtgcgtgggtgcaggctgccggcaatgacagcctttaccaccccacttcctgtgttgacttgtaatggggtgttgggtccctgctgtctgagtgagctgtgaacattcatgctacttcccattactgtctgaagcttggtttccacatctgcagtgtggtaataaaaatacccaacactttgccggacgcggtggctcatgcctgtgatcccagcactttgggagaccaaggcaggtggatcacctgaggtcaggagatcgagaccatcctggccaacatggtgaaaccccgtctctactaaaaatacaaaaaattagctgggcgtggcggcacgtgcctataatcccagctactcgggaggctgaggcaggagaattgcttgaaccagggagtcggaggttgcagtgagccgagatggtgccaccacattccagcctggcgacagagcgagactccgtctcaaaaacaaaacaaaacaaaaaacccaacactcaaagactgttcagggaatgaaaagaaatgatgtgtgaaaaacctatcatagttcatggcacatagaaagtacctgatgaggagcctgtgcaggatttagccatagttttccccttagccagccaggtaagtgcctgtcctttgcaaaatggcgcctctgagagacgggccgtgtggtcttgtggagggagccctggatttggtgcctacagggctgacttcaggctctgactctgcaacgaaccctccctgcaatcacgagcaagaaaatgagactctgtttccttgtcctcacaaaatacggccaggagtgatgccaatccctccggcacaagccgcttcaaggactacatataattaaatgtgaagattaagtgaaatataaagattaagtaacattaaatttaaactttcatgggactgtgtagaccggtgactgctatgcaagtctatggcgagtttccttcagtgctgagaggtataccctactcttcctgaggctgatgaggtagggacctgggagctctgttctcagctgttgggaaagacccagagaaagaagagaacaaagtctctggccatgtcagagagggagagagtcctaggttaatagaaggggaaaccccagcccgttccctgtagcagcaccccaaaactgtgtggaacagcttactttttctgtggaatatagaaaatgaactccaagacaagtgattgtatctaatctctggaacaaatagaaatttaatgtaatccatggactgtaaagtataattactgagaaaaatacacctgagctgatgtaagcggccacccttgcctaaaccagacacaaacccagtcttggcggaagtatcagtagtctttctgtctttttttttttttttttttttctgagataggatcttgctttgtcatccagcctggagtgcagtggtgcaatctcagctcactacaacctcgacctcctgggcccaagcaatcctctcacctcaacctcctgagtagctggaagcactagtgtgcaccaccagctaatatttttattttttgtagagatggggtatcctatgttgcccaggctggtctcgaactcctgggctcaagtgatcctccccccttgacctcccaaaatgctgggattacagaggcgagctaccatgttcagcctccagtggtcattttgacgagaaggctagaaaacaatttagcctcaattagactgcctatggggtggggattgggatcctgcataggtgaaatataaacaagttgcacactgaaataaaacctgagctgcctgacctggaagggtcctctgccatccgattgtcacacacagatggaacctctgacatctcctcttcaaaggcaaaggatcgcagcttaagcgttgccctctctatcctagggagctagtctgactttatgtgtgtgaagattgtaagatcatggtttctagtagaggcagtaactctctgagccttctcaaaacaatattagaactcacggttgctgggcatggtggctcatgcctgtaatcccagcactttgggagtctgaggcaggcggatcggttgagcctaggagttcaaggccagcctgggcaacatggtgaaactctgtcttgacaaaaaacataaaattagccaggtgaggtggcatgtgcctgtagtcccagcaactcgggaggctgaggcaggaagatggcttgagctcaggaggtcaaggctgcagtgagccatgatcgtaccactgccctccagcctgggtgatgaaatgagatcctgtctcaaaaaaaaaaaaaaagaaaaagaaaaagcctcaaggtcagaaggtatttaccactgggggcaaactgagttgactatcaaaggtcagaggctaacacaagtagaccctgggaagctgtagtgtgttcaccatctggagagaagaatgggatctctgaataggcccaaaaagtcaaagacttcaggtgacagtcacagatgtgtctaatgtgtgacgcctgagtcagccatagagaagctggtaggctacctctctgctgcccaaaccatcatagctgaaactactggccagagcctgctgctatagcacctgggaagcagtcttaagcctcccccaaaactctttttctaggcctacagcacatgtggaaaatatagagaactgtggaaagagtaggagaggagaaggccataagagcagctcctaccttgtccagtacatgctccaaccacttccttgctcctccccctgccctatctcatcatcattattgccatagccacaccaccatacacagaaggcccatgatgtgccaggcacaaggtaattctttttttttttttttttttgagacggagtcttactctgtcaccaggctggagtgcagtggtgccatctcggctcactacaacctccgcctcccaggttcaagtgattcttctgcctcagcctcctgagtagctgggactacaggtgcccaccaccacacccagctaatttttgtatttttagtagagacggcgtttcaccatgttggccaggatggtctcaatcccttgacctcgtgatctgcccacctcagcctcccaaagtgccgggattacaggtgtgagccactgcacccggccatgcccgggtagttctgtcgcccgcactggagtgtggtggcgcaatctctgctcactgcaagctccgcctcccgggttcacgccattctcctgcctcaacctcccaagtagctgggactacaggcacccaccaccacgcctggctaattttttgtatatttagtagagacggggtttcaccatgttagccaggatggtcttgaactcctgacctcgtgatccacccacctcagcctcccaaagtgctgggattacaggcgtgagccactgcgcccggccagataattctttctacacattttttccaagcagttctcatcatgtcccacactgtccaccctgtccccctctccaggcacaccaagccttcactctctccaagcctccagtggccaagacttccatgaagtctttcctgacctttgggtatagtaagtctctaatggcatgaagcagggttctggttttggcttcatcctgtcaatatttgccatcaggacttggatagacccaaggatgacttatctatgttgttatcacatcaccagatgacagaattgggatcagaaaaatttccctttataggttgcaacaatggcccagaaccttcaaaatgaaatcctttaggcatgttattaagaggagtaggaccctgcaggaaagtccaattgtattgtagttacatagttatagaagtatggaatcttttttttttttttttttgagtgtcaccaaggctagagggcagtggtgtgatcatggctcattgcagcctcaacctcctgggctcaagcgatccgcctatctcagcctcctgagtagctgggactacaggtgtgtgccaccatgcccagctaatttttgaattttttgtagagacgaggtttcaccatgttgcccaggctagtctcaaattcctgggctcaaaggattctcccatcttgacctcccaaagtgctgggattacaggcatgagcaaccacgccctgccaagtatagagtcttgaacaaggaaatgcatatcgtcctatattttttcctagtcagataatatctagaccattaaccagaaatcacccagaggtcaaaaaacagggcgtcaaaggacccagaaaccaagtctgcaaataacgactgaagacactgtggaagtgtgtttgggagacaacaagactctcaggatgtgctggctgtcttcagaggatgcttattggaagaggagtcagacagtccagacagaaggcacagccaggacctctggagaggagttacaggaagacatattttgactcatcataaggaataagtttctaatcatgaaaccatcctccactgaaacatgatctattgaaaggagcaaatgtctcaccttcattgatgttcgtattcattgattctgggtgatcatctgataaggatgcagtgacgagaatcttgcatttgctgggggtgggggtgtggttgaggatagtctggtttatattccaaagttcctttcaattcctctatgattctatacgctgtactccttcctgatcaatgtccctagccagggtggccaaggctaagtcaagtatgctaagggattggaggggcagggatattgagaatagggtgaatggaaggatgaggagttcccagcaagcttgggacacaggaaaccttggggcagcttcctcctggaggtttcaggactgtacgtgctggagaagaagtgtgatgccttgtcctgaaagccgtcttctttgaaagcagcttctaaaggcagtgaatggagaagagcgaggaaacgaccccaataccaccaacagaggctggaaactcctcaggctgtttaatcctaagaatgatgcatctgttggccgggcacggtggttcacatctgtaatcctagcactttgggaggctgaggcaggcggatcaccttaggtcaggaattcaagaccagactgaccaacatggagaaaccccatttctactaaaaatacaaaattagccgggcgtggtagcgcatgcctgtaatcccagctactcgggaggctgaagcaggagaattgcttgaatccgggaggtggagtttgtggtgagctgagatctcgccattgcactccagcctgggcaacgagagcaaaattctgtctcaaaataaataaataaaaatacaaaattagccgggcgtggtggtgcatgcctgtaatcccagatgctcgggaggctgaggcaggagaatcgcttgaacctgggaggtggaggttgtggtgagccaagatcatgccattgcactccagcctgggcaagaagtgcaaaactctgtctccaaaaaaaaaaaaaaaaaaaaaaaaaagaatgatgcatctgttggggatgcagtggggtaagcatcttcagtaagcaaggtgtgaagaggggaaagagggaaggtgaatatggaggagagggtgaaggagggcactggaaagggtagtaggatcccagcaaagggcgatttggctgaaagggagcgtgataacaagggtgggggtggggccaagaagcagccaccatgtgtgggtgcctctgtgcgtgcagtcatctttctcacatcattgtggatcaagagaggaaatgcccacttctggaagaaaaagccacaaaatgagacttggaagggaaattgatcaacatctacaaaacggcttcttaaaggaagcggccctcagacaggacagagttgagggaaaggacagaggttatgagtgcctgcaagagtggcagcctggagtagagaaaacactaaaggtggagtcaaaagacctgagttcaagtcccagctctgccactggttagctgtgggatctcgggtaagttgctctccctctcggcctcacggacctcctgaataaaaattgagggttagactggatgatctctgaagccatctctagcttggtagtttatgaggttaataatttatgagcaaacaaagttaatttatagatagaacatcattatttttgagtcagaaaatgactctgtaactatgtgcttttcttggtgatttcactttttttttttcttttagagacatggtcttgctatgttgcccaggctggtatccaactcctggcctcaagccatcctcctgcctcggccttccaaagttgatttcatttttgtcttccagtattgttttactgttgttccctttgaaaaattctaacctatcttttctgaacttgagctgagaagggaaggggttttgcctctgttgggcaaaaggatggtggcaagtagtgtgaccaagtgccctaacttgccaggacttaggggtttcccaagtcaagggacttttcagtccttggcagactggaatggttgatcaccctagtggtgaggaaaatgaaggtttggaggtggcttggaggagaggttgctgggagagctcttctcctgttctctgttgatcaggagtttccctcatcaacctgctgactttgcgtggtggtttcattacaagttgtgagccccttattgggggtatagggaggagaagtgagggcagcctttaaactagtcataggccccagttgagacaattattgccgggaaagaagctgaaatgcttgactagcactgatgctgtgggggattttccctctttcttcaaaaaaacagaaaagacccagtggaaaaaaaaaaaaaagtgatgagttgtgaggcaggtcgcggccctactgcctcaggagacgatgcgcagctcatttgcttaaatttgcagctgacggctgccacctctctagaggcacctggcggggagcctctcaacataagacagtgaccagtctggtgactcacagccggcacagccatgaactacccgctaacgctggaaatggacctcgagaacctggaggacctggtgagtagacacgggtagcttcctgtcgccgaggccctgtctggaattctaacatcctttgccagagtccgagggagaggggacagtgtgggaatcctctcccactgtggatctgtaaaatctagacaggtcagtcagctcccgccctttaagagtttattttccattctgtggaagaagcagataaggagagctgctgtccttaggagacatcctttagaggaagctggaagacacgggttcaggccctgcatcctcctctgagttgctatgtgactgggaacaggatacttcacctctccattctttctctccttttctcttagggtcggaatatggaactagacaggaaagtactttggaggttttcttaccgtaaggaggctggcattgctaatcagtcaatgaatgcatagctgttcgtctctggccatatgattatgtcatcagggcactacattctgtgttgggtggagaagttgaggacctggtctttgccctcaaatagcttctgctctggccagagaaaaaaatcactcactggaagctattaggcaacaattatgtgctaaactgagggaatgtgagaccagatggtagcaaggaagaggatcccagcaggctggagtcagggagcagggtgagaaaactgttaatctgacaaatgtcttggaacctgttgtagaatctctagagataaggtattcttggaaaggtttcttgggtgggctaagaaaatggtctccagcactacgctgccaccactcaagtctctccagtgaagcgtagtggtgcagttgacttggttgtcactgggctcccagaagatgtgtgtgtgtgtggagcagctcaaccagagaaacacagggttccttgtgagccgacggcagaggctggttgtaagggtttcttggaaacttcttcactgtcttttctccccctggagagaggacttgtttcggggctgcactctgggttagatcatgaaggagccaaaccctggctcctaccaactctcctgtcccaaacttaccctaagatattgtctgactccctcctgctcccccggctggagtggactttgtggagtggactttgtagttccaccaaccatgttcccagacttgctcagagaagcccgcctctcgcttgcccagatcccaaggctgggaagtgtaagtaggacacggggagaaagtgggcagaagggctgactacccaaagcctggcccctcggatccaaaccgtaggtggaatcagagccggaccattcatctaaccaggacctgctacataatttgtgggacccaatgcaaaatgaaaacatggggccccttgttgaaaaattattataaataagaaggcaacagcagagcactaaacctcgtggggggtcctgctgggtgcaggcccccgtgtgactgccccagttgcaagcccatgaagctgccctgagtctaatcacagagtctgggcaataccccaaatcagactaaaaacccgcggccccaaaggggcaatgtgctcccaccctggcccccggtcacagccgctggcctcgcctgattaggttactgggcgtcttcctctgcctgcagcttcaaactgaccacgagccctgacccagttggacatcttagtaaccaactggagacccggcgggtcccagcttctgagaaaccttaagagtttcccctaactgcacgcctcacctcactgagtgacctactagggacaggtgggggcagggggcaggggcagcagggcatgtcccaagaaaacctacatctgggggaaagggacccagtgactttcttcatgtcacacctcaaatgagtgatcctcagccaggcattccaatatctggatccctcactcagggtctagccaggagcccaggagtcctaggaccatctgggctctggagctcttcagccagccaccagtgcctcgttcccccttcacgaatctcctacacaccctgtctccagggccaatgtcccctcagaacacagaccctctcctccgcccccacccactcactgaagggccgtgagcagcttggcagactgtccctcagtgtcacagtacaaaaacctcgggcgtagtggtacaggcaggagaatcttgcatgtagcagcttctcaataagtatttattgatttgtgatgcagtaaaggtcttagctcaccattttcctctggagttagtctgggtccttctattccttctgcttcctattctcctccttgtccttgcccataccaggtattggttcacattccttgaacgctgggttttacactctcatgttgagctaagaactggggccttttggttacacaaacttgccagaaaaaaaaaaaaaaaggaactgggggctcctggccataagccaggttcgtcattctgtattccatttgtcctcttgaactcgaagaccaactcgagccgcttaaaatgtccacttctttaaggcaggggctggagggtggggaggggctgctaattctcatgaatgaaaggtccaaatagaacaaaaattagatggctaagaaccaggaacaagaagattccaggtcctggggtgggtatgccagggacccatcctgctggaaaggccgatcctggcagacctagagcagaccctgtctatgcgaccctcgatctgagagcctccttccaacagaaccagggcctgggctggggcatccacagaggctggtcataaactatacctccagccccaccctgcacaccagccgggaggggaagctgctatagcgcacggtgaagctggtccaagccccagagcctggctttctatgacccctctccatagacaattaccacacatcatgacttcagtgtgaccagagcatcacaggcgacacagcccgtccacgtggaccatctcatttcatcatgtaggtgtgaagaagaggaaccaaaaccagctcaggctgtttctgggcttcatctaggggaaagggaggttctccacccgccccccgcaaccaggtcaaaagtcccagaggaaccccagcagaggaggcccaactggggtgtagttggaagggtcagagatgagggagagccccaaggccaagctgaggatgggtcagggtcaaagtgaatatgggttcgggcatacaaactgcagagtctccgtcaggaactcttgctttccccagggacgcaggctgcagctgatcccactcctctagcagaacggcagaaacagtggccgcatatgtggacctaagaatcaggacacaagaatgagcattctttcaagagtggtggggaaaaatatttccaacccaggagatggtttcaagaggctgccacacacacctgggaggcctgtctgcctgcatcttggactgtgtgactctgtatccaaagggcaaagagacgctggggtgccaggtggggctcccttaagcctaaagacttgctgcagaggcttggagtagcttaaactctccccctaacaccacatccagcacagtacctgcttctgatggccaaaacccgtgggtagagatgaaagaggagtctcacagacttgtccctgaaggctgtgggtgcggcaagggagatgtgacaaatggcaagccagagtctcagatggtctttaggggctgtgggcctcctgaagaaagacggggtaaggggtacagacctaca[450 bp omitted]ttgaaggcagagtccagcctccttcttcccagggcaggaatctcttcccacacacttgggctcaaacgttcctctccttcctaaaggtaccatctcattgctggacagttctgtctgttagaaagttctccctcctttgactgaaacgctaccccctcagcttctgcccagtccttctagactgccccctggaagctcatagcaagagtccattgctgccctcttgcccatggagcttctttccaagccttgacatcagccctcagggactcaagtcttctctgtcccagacactacacccctagtacctgaaaatttcctctatgggcagggttttccaagcccctcaacaaagtggtcatccttgtccagaccaaccaaactgggctggtgtcagctgcccacttacaagcctctgttcacctagatgaaggtaacagtggcccttcggctggccacgtcactcccgtgactcatcttaagcttgtaggtgacaaactcccaagtctttctgacgaactgttgttacctggtcctccctaacttatccctggacgggtaatgttttaaacctgagtcctggcttgtatatttttccccatgcaatttcatctggttaggttggacccatggttccagcttgtaaagaactctgtgttgcctgagagtgcccccaaagctgggctgagagtgctgaagaggaggggacccaggatagatccctgaggcatgctaggcacccctgcccaatgcacctgctgacatagaatccccattagcaaatgtgagctgagctccatgctggccagtgctgggcagtggggcagcctcattatttggagaagtcaggtggggcttggagacttaattatccagggaggagcctgcatcctacagtggagggaaggagaagagtaacattttgggccctaccacaggccaagcactttgcatctccttacaccccccacctcccgctaagcccctcaatactggacactgttacagcccctgctcctccccagtgctcacagcaattttctaactagattctagctccactctcagcctcattctggtcattgtgtttcttgccttctttggggcatgtgaccctggcccatgaccaggctgttgtctgctgggtgcctgtctaggccacatgctggtgtggcccatcttggcacctgtgtctatgcaaggtgcatgttgctgtcaagagtgtgtgtgtgcacgagggcctcaggtttcagaagcttttcatgtcaaagaatgggcacaccgctcacgcaaatggtctgccctgtgctccctctgggcatgggattggagggcttccttcagcagcacatgccccatggtattcaggattcctgattcctcaatttcccatgaggccggagccaaccttgctttattgcctctctccatagtttgggggagattgggggagctagaactcctatgtgtgggaagtggctttaacatgtgccactcccgaacccccaaaacgtctgtttgacacctcctgctgagatgtgctgtcaattcccagcacccctcaaaccagcttcctcccatcttaccctctctgaacgctgccagacaaatacctcttggcaaggaggaagacacaggcccctcccaagccccctctaaatctggttctcaggagatgggagccctagggagatgtcccactgcattgactttagatgagcaataactcagtcagtctggaatctttgaagggcaagaacttgtgtggaggacaagcccagaaacccagggctttctgggtcagacaggctggctggacctaagccctcacccaggcacggccaaggtaggtggagtccagccctgctgaccgccccaggccctgcttctctcctccctgtctgaacggcttggctctgcgtgaagactgctgaattccagtattagtcaagtgggtgtgctcagtgacggtattggaaatagctcccaatagagggagagcactcaagataggatctaggatcaaggccatcaaggttattgggagaaggcagaatgcagaagattacggagtgagtccctgcagaggcacttgtctaagtctcaggttataagggctcctggccttctctgggaaactgctttcagagcaggtcagcacacgtctgtcctacgtaaaacacgtggccttgggagggggacacagaaggcctgcttctgagaccttgccatctggttagaaagtgtcatcccaaccctgggtgctgtaataaatgcacacgcatcataaggagaagagagaattccaagaggggagccgggaaggatgtctgaagatgggattgaattcggctttggaggaagggtggaaattaggcaaatttggaaagaaagacctgctagacagaaggaaaaggccaagcagaggtttggagacaggaatgtgttggggtgttggggaaaggccggggggtggtctagagcaataatttattaatagaagacaaagtttgaaaggtcagaggaatatacatttgggaagaacataaaggctgtgttgggaggttagacgtcttcccacaggtccatggttttcaaatgaaagtagaaccattttcttcaatgaaagcttatgtgtgaagcactgcacaagtcaaaagtggagagctctagtttaaagtcaaggaggggagcctggagccccaacaccactccccactccaggggaaccctgtgacacacacacagtcatgggtactctaaagaaagtccttggagctgggcactgttgtcacatacctgcagtcctagctacccagaaggctggggcaggaggaggatcacttgggcccaggaggtcaaggctgtagtgtgctatggtcacacgtattaatagccactgcactccagcctgggcaacatagcaagacactatctatcaaaaaacaaaaacaaaggcgtgtgtttgggggagaaattccatggaatcctactgcatgggatgttctgcaatgagttctaaactttattttttaaaaaaatgttttgtagagatggggtctcgctatgtcatgcaggctggtcttgaactcctggcttcaagcaatcctcccacctaagcctcccaaagtgctgggagccactgtgcccaggagttctgaaatttagcgatgtgtgaatggcactaagtttggcttactccaatcattttctttttttttgagattgggtcttggtctgttacccaggctggagcgtagcagcataatcatagttcactgcagtcccaaattccctggctcaagtgatcctcccgccttgtcttcccaaagtgctgggattacaggcctgagccaccatgcccagactccaatcaatcttctattgatgaacatgatcacaaatatgactttttcttatagctgactttgctattaaatgtgaaattgaggccaggtatggtagctcatgcctgtaatcccaccactttgggaggccgaggcggggggatcacttgaggtcaggagtttgagaccagcctggccaacatggtgaaaccttgtctctactaaaaatacaaaaaaattacctaggtgtggtggcagatgcctggaatcccaactacttgggaggctgaggcaggagaattgcttgaacccaggaggcggaggttgcagtgagccgagatcgtgccactgcactccagcctgggcaacaagagcaaaactccacctcaaaaaaaaaaaaaaaaaaaaagtgaagttgaaaaaataagataaagacaaaaagcagaagaaaaccactgcttacaggtgatggggaaccagtaaaggactttaaacagaacattgatgcgatgggatttgtgttttagaaaacttaccctgtcctctgtgcaggaggtggacaggagtagagaagctggtggggatgggacccatggagagatggtctcctgagcattagagtaaagagaaggaagaccagactgaggcaatggcagagggatgctgcgggaagggttggcagatggctctacccttgcactgatgtatctcccacacctccttctcacagaccctcattcccccagagccagaaggaaagacccaggttggagaatgggtctgctcagcattaggagtgagtgtgtgacccacaactgtggctcctgagaggcaagaaagccctgtggcacccagtgtgaccatcccctccttgtgggggtgccttgctctcctgaaatgggggcaccattaagccacccggagcctggtggacagagtaccccatcccatcctctgcctccctgggttcatcatttatagtattgccattttgaatccacataggttggttataattggttttgaattgcctggggaggggcttgggtagggagggtgggaagaacagagctgggaggtgaggaggaacaggtgcaggggacagctgtgagtgaaaggtgtgaaaacaggcacatgtcttcctttgtggttagctgggtaaacaacctgagtgctggggtgatggggggggggtgatggggagaggaagaggaggatggggaggagggaacttccggagacatcacgggcacaccccctgcacttggagcaggctctctccttctctcctgccagtctccccgtgtcgccctcactttctcctgcctctctctgcctctgggctttctgcttctgagtgctcctagctgcagggaggttgccagtgatgggaagtagcagggagcctgcatctgctgcccctagaaggaagcccaggcagggttgttcagtgggaggtactggctttggaagtagataaacgtcggttcacacaaacctgatctttagcaagacacatctgtgaaataggaataatattacataccttgagcgggttgtgcatattgaaccagatgggaggctattactgccatttcagtgataacagagacagtcaggaacaggaagacccatgaggagggagcccacaggccaagtcagcacccgcccgcccctagtccccagcacaatgctaagttgcagtgcccgactgttctgctcagaactggaacagatgggtccttgtaccaagcaggtccattccccaaattgaagtcctgtgactccagccgccaaggctgcaggcttccgtacatgaggacccaaaaacacaagctgacttatggggtccagccctccagcacttacaaagctcagccacccgcacgcctcccttcatcagcaccaccactctaaggaatgcggtccctttgacaggcgaaaaactgaagttggaaaagacaaagtgatttgttcaaaattgaaatttgaaacttgacatttggtcagtgggccctatgtaggaaaaaacctccaagagagctagggttcctctcagagaggaaagacaggtccttaggtcctcaccctcccgtctccttgcccttgcagttctgggaactggacagattggacaactataacgacacctccctggtggaaaatcatctctgccctgccacagaggggcccctcatggcctccttcaaggccgtgttcgtgcccgtggcctacagcctcatcttcctcctgggcgtgatcggcaacgtcctggtgctggtgatcctggagcggcaccggcagacacgcagttccacggagaccttcctgttccacctggccgtggccgacctcctgctggtcttcatcttgccctttgccgtggccgagggctctgtgggctgggtcctggggaccttcctctgcaaaactgtgattgccctgcacaaagtcaacttctactgcagcagcctgctcctggcctgcatcgccgtggaccgctacctggccattgtccacgccgtccatgcctaccgccaccgccgcctcctctccatccacatcacctgtgggaccatctggctggtgggcttcctccttgccttgccagagattctcttcgccaaagtcagccaaggccatcacaacaactccctgccacgttgcaccttctcccaagagaaccaagcagaaacgcatgcctggttcacctcccgattcctctaccatgtggcgggattcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggcgtgaagttccgcagtgacctgtcgcggctcctgacgaagctgggctgtaccggccctgcctccctgtgccagctcttccctagctggcgcaggagcagtctctctgagtcagagaatgccacctctctcaccacgttctaggtcccagtgtccccttttattgctgcttttccttggggcaggcagtgatgctggatgctccttccaacaggagctgggatcctaagggctcaccgtggctaagagtgtcctaggagtatcctcatttggggtagctagaggaaccaacccccatttctagaacatccctgccagctcttctgccggccctggggctaggctggagcccagggagcggaaagcagctcaaaggcacagtgaaggctgtccttacccatctgcacccccctgggctgagagaacctcacgcacctcccatcctaatcatccaatgctcaagaaacaacttctacttctgcccttgccaacggagagcgcctgcccctcccagaacacactccatcagcttaggggctgctgacctccacagcttcccctctctcctcctgcccacctgtcaaacaaagccagaagctgagcaccaggggatgagtggaggttaaggctgaggaaaggccagctggcagcagagtgtggccttcggacaactcagtccctaaaaacacagacattctgccaggcccccaagcctgcagtcatcttgaccaagcaggaagctcagactggttgagttcaggtagctgcccctggctctgaccgaaacagcgctgggtccaccccatgtcaccggatcctgggtggtctgcaggcagggctgactctaggtgcccttggaggccagccagtgacctgaggaagcgtgaaggccgagaagcaagaaagaaacccgacagagggaagaaaagagctttcttcccgaaccccaaggagggagatggatcaatcaaacccggcggtcccctccgccaggcgagatggggtggggtggagaactcctagggtggctgggtccaggggatgggaggttgtgggcattgatggggaaggaggctggcttgtcccctcctcactcccttcccataagctatagacccgaggaaactcagagtcggaacggagaaaggtggactggaaggggcccgtgggagtcatctcaaccatcccctccgtggcatcaccttaggcagggaagtgtaagaaacacactgaggcagggaagtccccaggccccaggaagccgtgccctgcccccgtgaggatgtcactcagatggaaccgcaggaagctgctccgtgcttgtttgctcacctggggtgtgggaggcccgtccggcagttctgggtgctccctaccacctccccagcctttgatcaggtggggagtcagggacccctgcccttgtcccactcaagccaagcagccaagctccttgggaggccccactggggaaataacagctgtggctcacgtgagagtgtcttcacggcaggacaacgaggaagccctaagacgtcccttttttctctgagtatctcctcgcaagctgggtaatcgatgggggagtctgaagcagatgcaaagaggcaagaggctggattttgaattttctttttaataaaaaggcacctataaaacaggtcaatacagtacaggcagcacagagacccccggaacaagcctaaaaattgtttcaaaataaaaaccaagaagatgtcttcacatattgtatttatatatttatatttatatatatatttatataatggtacaaaatggctgggggtgtggccatggatggagggaagagtaggctggcctgtggcgtgggtgggaggagaggggacggagagggcactcggcccgctgcaatctgacccctctctcctcagggcaggaaacacagagtcagacagtttgggggggtcttgggccaggggtggagggctcaagggcacagggcccaggctgaggcagggcgggcaaagcgcctggcaggatgaagggcaagtggccccccaaacacagaggccctggccatggaccctgggaggtgaccggggtgagtcaggggcctgttgtcagccccagaggaagcgctggacctggccgatggtgggccgagaggacagcaccaggctgggagaagtggggcgagttccctttgtattacagctgccagtgcaagaccaggccctccaggccaggaaggctagggacgggtcctggtagaagacaccctgtctagaatggcccttggtcctggaggtggggcgcaaaaggcctcagccagggaactgccctgccacctcccgaggcaggaaaggaagtgagaaaaggagaagtttttttactcctggggccaaagtagggggacaaacacccagtcgtatatggcttcagctctgaccaaaggcggatagggagctctcctgggtaggagcagggagccaagggggaggcagtggctgtgcctgggtgggcacagacagatctggtacatggccctgagccctgggcagagggacaaccttgccggtgagtgggcaggcagagaggaggcggcaggatgctgtttccccgattccatcctcagggagtggagactggaggggaggtgcactgactcagatgaactgttctcccccttctttgataagaagtaggtggcagcagcctctggaaaagtcagggccctggaggttacctggcccagggctactacagccacaggccccagtggcaccatgccaccccttccatggctccactcaagggggccacacagccaccgcctcttcctcctttccttcatcccaaactgggacaaaagacttcaagttctggctaagatgtagcagcagcggatgcccgggcatccaaagtggaaagccagggccccgtgtcaccggtgtgggcaaacacacatgcacgtgcacacatgttctccctgaatcactcagcagcagacaggctgccgccctgggggtctcagccctgctagggctcaccaggtggaagcctaggtggtctgacctcagtttaggagtgggtcatttacgtcatcttaccatttggggacgagacaggaatggtatcccttagggacccagagacactgcaaacagtgggtggccatgtagggctgcatgtccctgggtccaggggaatggagggagcaataacttgaagaaggggggaagggtttcttttatccttttttttttgtgtgacttctatcaaaacacagaaatacagcacacgcacaaaccagcacaaaagcgcagcgctctatttacagctccggctggcacctgcccacctggccagccgcctgcagggaggggtgggagaggggtcagccacatcagcagggaaaggatacgaagcaggtaaagacagaaggaaaatgggcgggtgcggagaaaccaagagggaggtggagctccagcaatgcggacacgaggagacaggagcagaaggggctgggggagacctgacctgtccttcctctctccccccagattcccatccaggactccaaaagcatagctgaagggggtgtggcgggtgcagggatgcacggaaagaggtaaaatagagaggctccataggaattgggaggagtgggggaggggcagtcctggtggccgaaatggaaccaaccccaatgcaaaatcccccaccccacactgccacttccccctaagctgccagcacatctggtttccacaaatgccactccctacacaagccccctcccaccccctccaccccaccccacgacccaggccatcccaacattgaggggaagaactttgttaaggttatcgtatttgcaacattgccccggctccagccctggcagcgacttctagaagggcaggttggccatgccgcctggtgccgggaggtagcccatctggctgtccagggacacactgcgctgccgaagggggtgggacaccatgaggttctgctggggcggggggcccatgagggagccctgcggggagagcatgtggggcggctggctgtagacctcgccccccacgccccgctgcttcatcagcatgaaattctgctgggtcatgaggccttgtggaggggacatgaccccctggtgcaggccatggggcaccatcccctgctgtgggggcacgcctgtcctgcccagcaaggacatctgtccagggtggcacatggacatgttgagcccccgctggacgccctgctggcctgggaggttgggaggccgagagggagtctgctccgccatcatgttctgcaggttcatgagatgcagattagggggctgagccttggggggctggttctcgctcttggggaagtactggagggtgctgcttggcttctcagaggggatgatcctcgacaagtcgaactcggggatccccgttggggtgggccggatcacctcgctcagctcggggtcgttcagcactgatgccaccccagggagcacacccggtgggtatgcgtcgcccatgcgcccagccatggctttgcccatcaggtgctgctggggaggcatggggcctggcggctggttgggcaggtcctcgggaggcagggccatgcctgacgggtagtgctgctgcaggccaggccccccgcccccacccccagtgggggccatggcaccatggggctgctgcagccgaggggggaagggcatcatctgggaggagctgggcactgggccacagggggcattcagggagtcggggccccctggggccatcatcatggagttttgagggggcccccctgtcccctgtgcgttgggatgcagtggaatgttggagcccagaggggtgggggagggcagcatggcgggcgggggctcatgggacaggggctgctggcctggcaggttcatgcccatagggctctgggcagcggctgagttcaggtgcatctggctgggctggctgttgctgatccctgtagggaatagaagacagggggtcaggcacggtgtgcccagctcggggagggtgcagggctcaggccttccccactcccaagccagggggtgccagaggtcaaagtcttcaccactggcttcccctggctgggagggaagggactggaggcattgatgctagaagccaagagaccaagttctggcccagttcgccagacacaccaccaggtgttggaaagaccactcgagtgctctgggctgggtttccctaatgactccagcgagtgggaacagcatcccggagcctccacccccacacccagggccttcagaggcacaaaaaagccagcacaaccacagctgtgctccccgctcccagtgcccacaccagctggcctccctggggccctggcctgtcctcgcacctggcccggagccctgcggtggtggtggggggggcagcaggggccggtcgggcagcagctcgtcgtctgaggtggcgatggtcttgatggcattgtggtagagcggggtggagctgggcatggcgtacttggacatctgggtcatcatcagtgacagggggttctgggaaggtgtggggtctggggaggaagtgaatggtaggctggggttcatgaggccgctgggagggttggcgggaggtgctgaggagctgctccgggggccgctaggcgggagggtacctacagaaacggggagacaaagagagcaggggtgactggggaggggcagatgagtttggctgtggatatggggaggtttaggaagcggtcagttccccaaatcacctggtccttcagacacacccacaggcccccactatctccagagcccaccagtcttcaagcaattcctgcagcctcagggccccaggcaaggggaagatcccaggccccaagtacgatcactcaaaatgcctgggagactcacgtggtaccccctgagaaagcccacaaatgtcatcatctgccccataagcagagccatccacctctgggcccgtggtacacaggcccttactcactcactgcccagccccagcatggacacactgctcagcgcctgcctgcctgcctgcctgcctgcctgcgcaattgactcaccctgttccatgttgctcagggtggtggaagagttcatgttgagaggcggctgcttgttctgggagacccccgggctgggcatggccgtcttaggtgaggcaacccagcctggagaaggcaccgccatggaaggagacttgagcctgctgggcgagccagtgggtgaacggacactgagggaggagccgaggacctggggcgacttgagaggtcctggcgggttggcagaaggcaagggcaccatctgtgagggagtctggggtgacttgaggttggcagagggcgaggtgaccaggggtgagtgcacctggctaagggtgggcgacttcaagtgccccatgcccggtgagcccatctgattaatactgatggtgaggtccgaaggccgcctgcctagcccccggtttggggctgaatgcacggtcccaggaggattggacgcagggggcagaggcatgtggctgagccgggtggtgcccacgttgctcatgggcattgagctctgatcagggctgaacatgtcttgggtattgcccatgtcctgggacatggcttggtagggtccctggcctccagagaatccctgctggccctggttgggaaactgtgaaggcatcagcatcttctgcgggccgcccatcacgccactgctgttctgggcccgaacccgggccatctcctcaggactgaggccctggggccccatcaagtccccagggccccgcatcttctgcgacatcagcatctgctgctgcggggtcatctgcacgttcaggttcatgttcatgttcatgttgacattcatgttcatgttgaggttgcctggccccatgggtgggtccacctccctcagcccagactgccccatgggagggctcaggaggccccggcctccaccaaactccatgcccatgggagtgcccgccaggccctcaccaccagccatctgcccgggaaacatggcaggatccatctgtcggtgcgcctgcatcatccgctccatctccatgctctgtcccatgccactgcctgccatgcccagggggcgctgcatgcccatcgaccgcttctccagcagctggtgccgcagcagctcctcacggacccggggagtcatgaatcgctccgcctcaccctgcccacctgggtagggcatggtgttctgggcaaaattgctgggtccccccatagggggcaagtcttcggtccagcccatgcctggtctcacgggcctctgcatggcattcatgggcacctccatgggcatactctgcatgcccccaaacccaggtacccgttgtatctggttgcctgggaaacggggcccaggaaagggaggtccgccccggagctgcatgggatcttgaacatccatgggcccccgcagctgcgcacccattccaggtggccactgatccccaggcttgctgtggtaaggaggcgggggccccctcaccatcatgccccccatgcccatcatgtcctgcagaggacggctcccatgcagcccaatctgttcctctttccgccgtttctcttcgtagtactcctcctgcagcttgcgccaggccacctgctcaggcgtgaggctgtcctggcccagcctctgtatcatcatgttcatctgctgccccatgtccccacccggggggtgcccaggcacttcatgctccagcggggggccccctaggctctgtgtctgtgaaatcatggactgcaagggttcctcatatttcttcagcccgctgggaggggccgtgggtggctgctgggggggagggggggcttgtgctggtgggcccccctcacccgctcctcctgggggccccttgaggaagggctcagtctctccgctgcggagcagcagtcgctcaatgtctcgcagcgtctggagggaccgttcccgatgctccagctgctctttggacaagccctctgagcccaccaggctgcgctgcccatttccaggggcggctgcctcccccagcagggcagggccgggggcactgctggggtctcctccaggaggcagagggttgttggcggtggtagccgtcggggtgttagggtgggtgcccccagtcccaccacctgtgctggcagctcccactgagttgggggccaggtcctgactgctgtcctcaggaggcccctctgggggcagagcaggcggggcactgccaggggccgggggtggcggcggcggcagtggaggtggctgggactgcggggtgcctgctgacggcgtgctcaggggtagcggttctggggtggggggcactttaggggcctgcagaaggacaaagagagcatgagacaggtaaggggacgttccacccagtcctgctgctcacagaggcgccacgctcacctggtcaagcttggcccggggcacgttctgctggtggtaggcgaggatggagtcggcccggccctgcagcactgcctctgcagccctgcacagagtgggggcaccgacagctcagagaggtgagcaggagggagccccaccctcacccaccccaccctgcccctgcacggggctccctcggaaccccaggctgagaggtgctgggcagagagagagagagacttggcctgcccaccaggcacttacgtgttggccaggtgggtggtgaagacatatacgaactgcgagggaggctttccggggacgcccccgcccccgcccccgcccccaggggcatcaggccgaaggccaggaggagggccgtgcggggcgcctggcacgctgctctcgctgaggggcagttgggtggtttggccgggacccagctgtggggccgccatggctgggtctgctacattacaatctgcaggagagaggacagggaaaggggctaagtggtctagatacaagaaggaccagctgatgccccctcccactgatgctcacagccttacagctcgtgcccacagggacatttgatgtcagtatctggtgttctcaccaggctggtttccacgatggcaagagtggtgaccatgtggagagcagggacagagaaaatgtgtcctctccacaggctcccatgggcctggcattctgctggggacttaacaggtgtgatttcatctcatcaacacaccctgggaggaacgtgtcacacactccacttaacaaaggaggaaataagttcctcacccacagttacacagccagttagtgcagagccagaactgaacccagggccgggactctgaagctccgctctgagctgctgcccctctcactgggtaagtgtatgtgcacacagtctagtgacccagttagggagaaggcagagagggtacacaagctgatgatccaaatgatggatggtttttcactctagccccaccactaactgactttgtgattttatgaaccagacatccctctaagcctcggtttcttcatctataaaatgtaaaatactaacctcctccttgcacagggggcaggccaaagaaatatattttttaacagtaagtttaaatcaatgtcacagactaaaaaaatccatttgaaaaacagagagccgggagcggtgtctcacgcctgtaatcccagcagtttgggcggtagaggcgggcggatcacctgaggtcatgagttcaagaccagcctggccaacatggtgaaaccccgtctctactaaaaatacaaaaattaactgggcatggtggcgcatggctgtaatcccgctactcaggaggctgagacatgagaattgcttgaacttaggaggtggaagttgcagtgagccgagatcacaccattgcactctagccagggcgacagagcgagactgtctcaaaaaaataaataaataaataaaaataagaaagaaaaaacagttagaaaaagctgacatactggaaacactctcaagacagaccagctgccctcagcaccaagggaagttttgttccatggttagacacttgactgtaagtcttagcgtagaaaaaaatctacaacgggtctaggtgagtgggtagacccattcgcatgccaagaaaagcaagtcacagttcctggcccgcagacagtaagtaccagcattctcagttaatgggagacagattgcctgaagttgtctccatccagccagggcagtgaccaccttcccatgggcccagtgtcaggctgccctctttggaaaaagtttcttctgcaccttcttctctgatggacccaccccaaaacggccctgctctggaccctatctatccaattttacatagaagagcagagccagaaatttgcgggggagcttgagagctgacctcaatgtgtgaaggctgctgagtagctcttggatacgagctatggggagacaggcagggcttagtccaacaaggaactttctagtacaataacaatgataaaagctaacatgttacatgtataacctcatttactcctcataccaaccctatgagataaataatacttttacagatgaggaaactgaggccctttcccaaatttacagaaataacctgggttgcaaacgaaggcagcctgatggcagaactagtcctgtcaatgtctacgttctatcgcccctccagtaagaactcttcaagaatctaagggcaggccgggcacggtggcttatgcctgtaatcctaacactttgggaggccgaggcgggcggatcacttgagggcaggagttcaagaccagcctggccataatggtgaaactccatctctactaaaaatacaaaaattagccaggcgtggtgacgcatgcctgtaatcccagctacttgggaggctgaagcaggagaattacttgaacccaggaggtggaggttgcagtgagccgagattgtgccactgcactccagcctgggcaacagagtgagtgagactctgtctcaaaaaaaaaaaaaaaaaaaaagaatcaggccgggtggctcacgcctgtaatcccagcactttggggggctgaggcaggtgtatcacctgaggtcaggagttcaggaccggtctggccaacatgctaaaactccacctctgctaaaaatacaaaaattagccaggcgtggtggcaggtgcctgtaatcccagctactcgggaggctgaggcaggaaaatcgcttgaactcaggaggcagaggttgcagtaagccgagttcgtgccattgcactccagcctgggcaacaagagtgaaactccgattcaaaaataaataaataaataaataaataaaagaatctaagggtagtacgactaaaatagtcgccttgagtatgggatgttagcaatttctactttgtatttccctatgtttgccaggcacagtggctcactcctgtaattccagcactttgggaggccaaggcatgaggatcgcttgagaccaggagttcaagatcagcctgggcaacatggcaagactgtctctacaaaaattagccaggtgtgatacatgcctgagccccagctacttgggagtctgagatgggaggatcacttgagctcaggagtttgaggttgcagtgagctgtgatcacaccactgcactccagcctgggtgtcagagagagaccctgtctctaaacaataaataaataaaactcacaaagtttctacaatggtgcagtctgatgtgacataagtgaactg

SEQ ID NO: 1413 - DNA, 2824 bp, Homo sapiens
gctgccacctctctagaggcacctggcggggagcctctcaacataagacagtgaccagtctggtgactcacagccggcacagccatgaactacccgctaacgctggaaatggacctcgagaacctggaggacctgttctgggaactggacagattggacaactataacgacacctccctggtggaaaatcatctctgccctgccacagaggggcccctcatggcctccttcaaggccgtgttcgtgcccgtggcctacagcctcatcttcctcctgggcgtgatcggcaacgtcctggtgctggtgatcctggagcggcaccggcagacacgcagttccacggagaccttcctgttccacctggccgtggccgacctcctgctggtcttcatcttgccctttgccgtggccgagggctctgtgggctgggtcctggggaccttcctctgcaaaactgtgattgccctgcacaaagtcaacttctactgcagcagcctgctcctggcctgcatcgccgtggaccgctacctggccattgtccacgccgtccatgcctaccgccaccgccgcctcctctccatccacatcacctgtgggaccatctggctggtgggcttcctccttgccttgccagagattctcttcgccaaagtcagccaaggccatcacaacaactccctgccacgttgcaccttctcccaagagaaccaagcagaaacgcatgcctggttcacctcccgattcctctaccatgtggcgggattcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggcgtgaagttccgcagtgacctgtcgcggctcctgacgaagctgggctgtaccggccctgcctccctgtgccagctcttccctagctggcgcaggagcagtctctctgagtcagagaatgccacctctctcaccacgttctaggtcccagtgtccccttttattgctgcttttccttggggcaggcagtgatgctggatgctccttccaacaggagctgggatcctaagggctcaccgtggctaagagtgtcctaggagtatcctcatttggggtagctagaggaaccaacccccatttctagaacatccctgccagctcttctgccggccctggggctaggctggagcccagggagcggaaagcagctcaaaggcacagtgaaggctgtccttacccatctgcacccccctgggctgagagaacctcacgcacctcccatcctaatcatccaatgctcaagaaacaacttctacttctgcccttgccaacggagagcgcctgcccctcccagaacacactccatcagcttaggggctgctgacctccacagcttcccctctctcctcctgcccacctgtcaaacaaagccagaagctgagcaccaggggatgagtggaggttaaggctgaggaaaggccagctggcagcagagtgtggccttcggacaactcagtccctaaaaacacagacattctgccaggcccccaagcctgcagtcatcttgaccaagcaggaagctcagactggttgagttcaggtagctgcccctggctctgaccgaaacagcgctgggtccaccccatgtcaccggatcctgggtggtctgcaggcagggctgactctaggtgcccttggaggccagccagtgacctgaggaagcgtgaaggccgagaagcaagaaagaaacccgacagagggaagaaaagagctttcttcccgaaccccaaggagggagatggatcaatcaaacccggcggtcccctccgccaggcgagatggggtggggtggagaactcctagggtggctgggtccaggggatgggaggttgtgggcattgatggggaaggaggctggcttgtcccctcctcactcccttcccataagctatagacccgaggaaactcagagtcggaacggagaaaggtggactggaaggggcccgtgggagtcatctcaaccatcccctccgtggcatcaccttaggcagggaagtgtaagaaacacactgaggcagggaagtccccaggccccaggaagccgtgccctgcccccgtgaggatgtcactcagatggaaccgcaggaagctgctccgtgcttgtttgctcacctggggtgtgggaggcccgtccggcagttctgggtgctccctaccacctccccagcctttgatcaggtggggagtcagggacccctgcccttgtcccactcaagccaagcagccaagctccttgggaggccccactggggaaataacagctgtggctcacgtgagagtgtcttcacggcaggacaacgaggaagccctaagacgtcccttttttctctgagtatctcctcgcaagctgggtaatcgatgggggagtctgaagcagatgcaaagaggcaagaggctggattttgaattttctttttaataaaaaggcacctataaaacaggtcaatacagtacaggcagcacagagacccccggaacaagcctaaaaattgtttcaaaataaaaaccaagaagatgtcttcaaaaaaaaaaaaaaaaaaaaaaa

SEQ ID NO: 1414 - DNA, 1119 bp, Homo sapiens
atgaactacccgctaacgctggaaatggacctcgagaacctggaggacctgttctgggaactggacagattggacaactataacgacacctccctggtggaaaatcatctctgccctgccacagaggggcccctcatggcctccttcaaggccgtgttcgtgcccgtggcctacagcctcatcttcctcctgggcgtgatcggcaacgtcctggtgctggtgatcctggagcggcaccggcagacacgcagttccacggagaccttcctgttccacctggccgtggccgacctcctgctggtcttcatcttgccctttgccgtggccgagggctctgtgggctgggtcctggggaccttcctctgcaaaactgtgattgccctgcacaaagtcaacttctactgcagcagcctgctcctggcctgcatcgccgtggaccgctacctggccattgtccacgccgtccatgcctaccgccaccgccgcctcctctccatccacatcacctgtgggaccatctggctggtgggcttcctccttgccttgccagagattctcttcgccaaagtcagccaaggccatcacaacaactccctgccacgttgcaccttctcccaagagaaccaagcagaaacgcatgcctggttcacctcccgattcctctaccatgtggcgggattcctgctgcccatgctggtgatgggctggtgctacgtgggggtagtgcacaggttgcgccaggcccagcggcgccctcagcggcagaaggcagtcagggtggccatcctggtgacaagcatcttcttcctctgctggtcaccctaccacatcgtcatcttcctggacaccctggcgaggctgaaggccgtggacaatacctgcaagctgaatggctctctccccgtggccatcaccatgtgtgagttcctgggcctggcccactgctgcctcaaccccatgctctacactttcgccggcgtgaagttccgcagtgacctgtcgcggctcctgacgaagctgggctgtaccggccctgcctccctgtgccagctcttccctagctggcgcaggagcagtctctctgagtcagagaatgccacctctctcaccacgttctag

SEQ ID NO: 1415 - DNA, 28430 bp, Mus musculus
  misc_feature (4762)..(4781): "n" at positions 4762 thru 4781 can be any base
  misc_feature (21523)..(21759): "n" at positions 21523 thru 21759 can be any base
  misc_feature (23376)..(23892): "n" at positions 23376 thru 23892 can be any base
aggacctctggaagagcagacagtgctcttacctgctcagccatctctccagcccctaagcttaactttataataaaagatgcttggatatcgtcaagtgctattaactagtctctaaatgttaaagtacaaatgaaatgacagtatggatgagtagaatcaatttaacatgctttatttttttggttgagactggtttctctgtgtagcctttgcatctgggaactcactttatagaccagggtgccctcaaattcagagatctgtctgcttctgcttccctgtgtgccactactgcccagcccatctgttttactttttaaagattaaacagttagatcagcacccagggttaggattataacaacaggtcttttcatgttattaaccggtataattaatgttttcaaatatgagttgaaaatacttcagtacttgtcttaaagctatttgtagacagagataactaaaaaggaatttgaaaaccattccctttgatttgggtggaaacagggcccactggacatgagttagcagctgtcagtgtctcagaagcagttgtactgttggctaattgctttcctttcctttttgagtggcaggccatgtgtctttgctgattctgaaatgttaagacatttcctaccatcaaggtcatagctttttatagaaaggattattgatttctgtactggaacttcattctcaagttcccttcttaaaggaggaagtgcaggagtgagaataaccaaggagcaactctgaaactcttgagagttgttttctctaaccagttaaagaagctgctgttcatctatttacagatactgtggttcctagtataaaatacacgggatactttatttactgtctaggatcaaagtcgatagaaggagggaaattaatagaactcttctaaatttcaagccagtgcgccggtttttgtttgataaagcgaggtaaataaccaggctggagagaagagttgtctcagcagtagtcagcagagttagagtaagtcaagagaatgagcaatttcagcttgagactagttaactaaatgagaagtgttgaattggtaaatacaaattctcttcagattgcatgccttcagagcattctcagaagcgcagagtgcagtgcttcactcagtactacagtactcagttctcagtacaacagggagctgttgacggtcagaatgattttcctctatagtctgagcaggtgccaatgaatgtcacggtcacttagggtcttggctttcaccttcaatatccagtctgtggacacagccttctgggttctactttagagtgtatctgaaaactgactttttcttatcctctggattgttactgtcttggtctcagtggcgttatctcctcgattatagcaacaggcccctgcccatctttttgcttccacccatatcattttttccagtctatctttataaagcagctggagtgatctctttaaaacataaattgttgtcgggcagtggtggcacacacctttaatcccagcacttgggaggcagaggcaggcggatttctgagttcaaggacagccagggctacacagagaaaaaccctgtcttgaaaaaccaacccccccccccaaaaaaaaaaaccataaattgccattcacaaatgaaacccttaattggcttcatttgagggttgttgttctctgaatgaaatcgaaaaacctcatggagcctaaaaagttctcacttctgactctgagtgtctttgccctctatcccagtagggttggccctcctgtttttcctggaacacccaaagtatgtccttattttataattgtaaccatagcctatctatttgtctaaaatgttctctgaatatctatttggttcgcaccttctggacatagttaaaatgtcacttttctagcaagttcttgccgatgggctttttaaaaaaggaatcccggtttcttctggaactgcagattgttttactttgcatttttctcaaaggagtggcattatatttatctttgttttgcccactaaaatataaaattcatcccagtaatttcctcccccagtagtaatttttaaaattgctttgctttaagaggtatgtgacatatatccagtagatatttaaattaatatgtccttaacgagacatatacaaagaaattttagcacattcgggtaaatttccaaatcagttggatttatttcaatgggaaatgcagatgtttttgttcatgtaaagtggatttgttttggggaatatattacaaggttttggctgtgtatactgtgcgtgtacattttggctttatgttgcttgagcatagaggctaatcagactcacatggcttcccatagaatttctgatgagtaaaataacagtaaatacacttgttttaggctttggggtttaggatctatttccttctgtctagaattcttttattgtgcatttgtattctaatgtgctgttttaatttggtgaatactggtataggtcatcacattagggcttatatgacttaatttagagttaaaaggtggaacgcttgatgggagtggattgatgtaagtaagattggatcaaattaaataggactgatctctcttgctgctgaatagctgtattcacatttaaacaggactgtagttgctgtggcacgacatgaagtttgctgagtctttaacaaatatgaaaactgtcttcctggtactgtgttactggcttgctcaaggcagagggactagccctctggaggccattactaataatattgtttggaacctaaattttaagccattagaggaccttgatcatcttagaattttttatgatacatggaatagctaaaaccatttgaaaggtgcgtgttaagaatagcaaattaatgcttctgtccttcagcctcccctcccctcttctctacttccgggaaaccttacccttatctttgtaacatttcagatagcccttgggtttggaagtacccacaaatacatttttaaaagcataccatttattctgccatgcatctttaaagtttgtttgctcagtagtgtctttcatctatctttacctgcttattatagatcttttttttttttttttttttttttttttttttctgtttgtttttcgagacagggtttctctgtagccctggctgccctggaactcactctgtagaccaggctggcctcagaaatccgtctgcctctgccacgcccagcagatttatttttttaagctttgcttagttctccattttaagaatataccctgtatccaggaggtgcacaaaatgcctttaatcccagtactcaggaggcagaggcaagaaaatctcttgagtttttgaggccagcctggcctacagagtgagttcaggacagtcaggacaaaacaacaacaaagaagaatataccctgattaaaggatgggtactggaccatattatacatgttggctgtagattctcatttgggtagatacaaatggtaaaatactgataccaggatttcagctgttttaaacccccagagtggttttttgttttgttgttgtttttgttttgtttttaataattaactaattggtgttttgtgagtatgtgtgctagattccttggaactggagttatagacagttgtaagctgctgtgtgggtgttgggaattgagtataggtctggaaaagcatatccaccgtgccatctctccagcccctgccctcagagttttacatagtccttgtgccattgactggcagtacactggcagctagttaggactctgcttgcttgcctagtcttccaaacccctacatcttttccccctgctctccatccctgctatcttagatggaggggtttctgtcacagaccatgcttttcaattcttctgtgaaaatactcttgctgaaattaaaatgttacataaaaacagacatgtatttaacatacctttttttaatgtatggacttgtctgtggaggtatatgtgagtaagggtggcgctcttggtattgtgactgcctgacgtgctgggaactgagtgatagtcttctgacagagaagcaaattctctgaaccccggagccatttctttaccatcccccccccaatgtaacctttgtaaaattaggctctataaaaggtaggctattttgtgcttaatactatgctgttatttgtcaagtataatgtatcttgttgctagtaagttttttgacatagggtcttgaactccctctctaggtgaggatgccttgaggttttgaggccttatgcctccacctcccgagctgccaaataggactccacttttaaaaatcaagcgctggattttgggtttgccaaaaatgtgttctcccactgagctactttcccaggtcaataatgatttttcttttttgaagtaagtagagtagaattaatgccagacagtttaggaaaaaaaaaattcccctgtatgggacataagagcagtatgtatgtaaatacaggatcctgcagcttttgagcattctagctgtggtaggctatggtggagattatgatttgtttttaaatcaggtttcgctggacagtgatggcgatggctttgggtctatgctgttaagagtcactgctggaagcctatgtggtggcgcatgcctttaatcccagcgctcagggggcagagacaggcggatttctgagttcgaggccaacctggtctacaaagtgagttccaggatagccagggctannnnnnnnnnnnnnnnnnnntcctttgcattaagtgtcaactgtagttaacattagttcagctgaagtgacaggtgcaaaacttgtactatcaatgtgtatgtagttggactcttgggagaagaggtgggacaaaaacttgcttttatcatgtgcctgttaattttgatagaacatactgttttttttttttttaaagatttatttattatatgtaagtacactgtagctgacttcagacactccagaaaagagggtcagatggttgtgagccatcatatggttgctgggatttgaactcatgaccttcggaagagcagtcagtgctcttacccgctgagccaccttaccagcccaaacatactatttcttttggcagaaattctgttgttggaactcctcagtattaagaattgaaaatctaataaaaagttatcgttatccctggaaatggttcttccagagtgaactgggaggaataagaaggcataaagcgtgttttgtttgttcagcagacaaacactggggactaggtagaaagtgtaacgctaggactgaaagcttttaagtctggctgccaggacaatgcaatccttctactgcttctactgatcggatacacagtagctgtgataagcttgagccagaggatccaaatgtgggttagagttccctgtgttttcctgtgctctatgcaagccattgttctgagtagcgttttaatgctcctttcctcagagaagtcatcagttgcagttacttggaaaagttagacttgcatggaaagagaatggaacttgaagaatatgtgggtgcatccaaaatcgaaggaaaaaagtaaccaaggagtcaggagatctaggctcttgtcagtgatttgtttagttaatagtgttggcttgaatacaaatttattctcttgaacaagattttttagtttttaaaggttaggatagaatagtttatctttgcatttctcttagctctaaagctctttgactgtaccaggactgttctgttaaatgtcatgtataaccccaggtacctgtgtttgaggttgcagttacaattgagagttgcaagagtagtcataatttggacagggcctctatgtagccctgcttgtcctgaaacttgctatatagacctggctggacttacagagatctgtacgtagcctagcgtggtttcaagtttctgtgtatccaaggatgaccttgaacttgtgattatacaccccaccttcaccctcagtttcaatgtatagccctggctgctctggaactctctgtagaccaggctgccctccaactcaagagatccgcctgccttcccctccccagtgctgggattaaaggtgtgcgccattatccatgcagcccctccccacccctgactggccaggaatttgctttgttgcgcaggctggccttgaactttgagatctggttgcctctgcctcctatgtgctggttctgaaggctccagagctggggaatactttagaaatgttttgggtttgtgttcatggttatatcgagtgcaccatttataaagtaagaatatctgtaaggaaaaaaactgagactagaagatgtttgaaagtttgtagcccaggttctgtatgtcactttcttccccaaatatgacctacaccaatgtatagtatatccttcataatcttttctatctgttcacatagagcctttatttttatttttctttcagtactgggaacggaacctgaggcctgtgcctgctgggcaagccctctattactgaagtacatccagcacaaatgtttttattgttataaatttaatacggtttttgagacaaggtctaacaatgtaaccccggcttggcctggaacttggattcttctgcttttgtttcccaagagctgggatttataggtctgtgccagtgttccaaaccttttaaattattattttaacttttacagtgttggggtatcaacccagggttttatgcatattaggcaagcatggactatatttttagtcttgaaacttcaaataagtgtttagttactggtgacttatagaagaggcaagagacaaattttagaccattttcctgtttccagaggcactttgggttatatagacaccatctgattgagccagtttgtaatgaaacattaaattgtttgaaagcaccaggcctaaactgatatcatagaagctacaacgtctctgactagtgttgttacagtaatacttggagagaatgctgtggaatcactgaccttcagatagctcctacttgtttgctttttttcttcctggttgtcctgtaactcactgtgtagatcagactggcctcaaactcaagagattggcctgcctctgccttctgaggacgggatcaaaggcctgcactgctgctgccagtgccacccagctttttttgatggggtgccccacatgcatgcagaagaagcctgagaggtcaagaggaggtgattggattgttggaactggagctacatacagacagttaactgcaatgaggatgctgggaaccaaacccaggccttttttggttttttgtttttgtttttgttttttgttgttgttgattttaggttttttgagacagggtttctctgtatcaccctggctgtcctggaactcactctgtagaccaggctggcctcaaactcagaaatccacctgcctctgcctcccaagtgctggaactaaaggcgtgcactaccactgcctggtgaaacccaggtcttttgcaaaagcaacaagaaatcttaatactgagccatttctgtagcctccagaattgtttttttttttggttttgttttgtttttgtttttttgtttttgtttttttgtttttgtttttgtaattagttctggagagatatctcagtcagtgctggttaagtgtactcactgctcttccagagtgaccagattccaaccccagtacccacaaagtaactcacctatcactttaggtacatgatgtaaagacataattcaggcaaaaatacccatacatagaaccattaatattcaaaggaaagaaacaattatattttaaaaggtttgttttattactacttttaactctgtgtacttgtgtgctggcatccttggaagccagaaattttggatctctggaactgaaggcataggtagttgtgagctgctcagtgtgggtgttgtaaatttaaagtcttttgcaaaagcagattaccttctcaaccacggagtcatctttctagtcctaaaattatggattatgtttattagacaggggattactatgtaactctggctgacctagaactccctgtgtagactaaggtggcctcaaacatacagaactccatttgcttctcaagagatgagactaaagttgtatgccattaagtccaacttttttttaaaagatttatttattgtatgtgagtacactgtagctgtcttcagacacaacagaagagagcatcagatcccattacagatggttgtgagccaccatgtggttgctgggaactgaactcaggacctctggaagagcagcagccagtgctcttaaccgctgagccatctctccagcccagtccaaattttttttgggaggaacaaaacttaaattatttgtgatagagttacctatctcactatatagctgtgtagacaaagttggcctaagaattgccatttccctgtctcagcatcgtgggtgctgagatcacagtcatgcctggctgattttgtactcttgaggtagtgatgtgaaaaggaaaacctggaccagaagtgagagcatgtatgtatgtgagagcatgggtatgtatgtgagagcatgggtatgtatgtgagagcatgtatgtatgtgagagcatgggtatgtatgtgagagcatgtatgtatgtgagagcatgggtatgtatgtgagagcatgtatgtatgtgagagcatgggtatgtatgtgagctgaatccacagacagatacagtaaaaacagccacatggcccagttaattcactgtgtgacttgaggcaaatccttttactataccagctcttgtgtgtctgtgtgtgcatgctcgagtgtgtgtgtgtgtgtgtgtgtgtgtgtgtgtgtgtgtgcatgtacaccacgcttgttctaaacttaacaaagaatggccttgaattctgatctttctgcttctaccattcaggcgctaggattactgggtatgtgccatacacccaatttatgagatgctgctgaccaaactaggcttgtaatgtagggaagcgctctaccaactgaactgtatctctagtcctaaaataaaagatttgactgtgcttaatagattaatatcataattggggaagcagttcgtaagatttttataaaatcaaatttttgaagtaaaaatttgttgattatcctcagcttatttacaaatggataccctattttaaacagagtacatgtgaaagagcaagtcaccaaaagcagaaaaatacagtagttttgtgagctgaagttaaaaaagagtccatagaaggaaattttcttcaagtacccttaatgtatgatttgaatgaatttttaagatctcaagacaacgaagaatgagttagacgtgattctaagactggttggtgtttaagatcttgttatgtatgtcactcccccttacctgaatgtttgttacgttttacctgttttggtttcttagagaatctattctttctgaaggcttcatgtctattccgttctgttactcactttattttacctttgttttttcccccaggtttttcgttggaatatacgttgcacatttatggcgattctgagcgtgagggcagacttctgccaggctcagcacagcctttccgctgacaagtgagcttggggttatacgtgccataattaacattgccttgacgactctggacaccgagactggcctcagaagtagtaggcttttttttttttttttttaaattgcaagcgtattcttttaatgactccagtaaaattaagcatcaagtaaacaaaagtggagaagaacctacacttttaacttgtctcactagtgcctaaatgtagtaaaaaggctgcttaaattttgtatgtagttggatttattttggaagctgaaggtatccatctgcagacattgaggctcaagttgaatttggattcaagtggattcttaatacttctgcctgtgctgaagagagaagcttcctaaggaacaagcaagttgaatagagaaaatagtgatcaataataggcattttagtggtctttttaatgttttctgctgcggaacatttcaagatttattgatttcctcctccccccatttttttcccaccacactcacacacgcacgctcacactttttatttgccataatgaaccgtccagcccctgtggagatctcttatgagaacatgcgttttctgataactcacaaccccaccaatgcgactctcaacaagttcacagaggtaagattgtagcatagtctacttttgggattgatttttcttaactatgagtgtttatccttacgttgggttgagttgttaaaatagaatttttgaaagaatatggaatttggggatactatatatagattagtacttataattgtgtgttctttctgtgtttattagtagtactttttgtcatcttcagtaaaaaactcaacatttattgaccacagtatgtactcagcattgcagtaagcactgaatactcttccttttttaaggtcaaggtgcgcatctaaaaccacaggtccgattacttcctccctcctagaggtgataccactcagcttcaaagctgtttagtcatttgcccaaaggctcattgtatttggtggaactagcaccttaagcctgtcatacacactaggacacatgttaaggcgtgggtgagactggtaaaggaacttgtcatgtgtgacaacttgagttttacccttgggactatgagaactgacccccccccccccccccccgttgtcctctgacctctgcacaccataacacacacgtgtcccatatgcactaaatgaaaatgtaataattaaataaactcatacttcgactacaaactacttagtaacagtagttatcacaaatacaggaatccggaaacggggaaggaagtggtcaggagtagtaaaacatggagcctcatttcccctcctttaggtaatgatgacagtgtttactctttaggggatatttaaatgtaaagtttttaatcttttataggttataccatcacatgtggattctgttgctgtgttatggagtagagagagcagtagggggaaatcagtcatcagtcatgttttatgggtggcaaaactgaggccagatagttttaccataaaaaattgtaatggttttctgaccccccccccccaatttttgtggtgctggtgacagaacactgtgcaggtttgcatggactttaccactgagctaccaataccctcaacacataaactttgaagtcttttctcaacttgagtggcactggaaatggagcctggggcctcatacatgccaggaagcagtgccatcaaatatgcccccagaccttctgtgcttgctttttattttgaagtactcactacatttcttagcctggccttaacttaatcctgtagctcaggtggtcctgtggtccttctgtttagccatctaagtaggggagatgacaggtctgtgccactaaaaatactcatttttaaaatttgtagctgggagctggtgagatggatggatcagtgggtaaaggtcctcaccaccaaacctgatgacctaaaacccatatggtggaaggagaggactgaaacttgagtattgttcacaagcacaggcatggacatgaacaaatgtaaatcattggttttcgacgggatctcactatatggccctgtctagccttaaactccagagatcgcctgcctttgtcactggagaaccattcctggcctgtattaactgtttaaaggtgtaactggctacaattgtgtgctagcttttttttttttaagatttatttatttttattatatgtaagtacactgtagctgtcctcagatactccagaagagggagtcagatctcattacagatggttgtgagccaccatgtggttggggagatttgaacttcggacctttggaagagcagccgggtgctcttacccactgggccatcgcaccagccccccctttttaaaaatattatttatttaatatatacaaatacactgtaactgtattcagacacaccagaagagggcatcagatcccattacaggtggttgtgagccaccatgtggttgctgggaattgaactcaggacctctggaagagcagtcagtgctcttaaccgctgagccatctctccagccccgtgtactagctcttttaaaattaattttttgccgggtggtggtggcgcatgcctttaatcccagcacttggggggcagaggcaggcgcatttctgagttcgaggccagcctggtctacagagtgagttccaagacagccacggctacagagaaaccctgtctcaaaaaaacaaaaaacaaaaagcaataggtgattactgcaaaaaaaaaaaaaaaaaaaagaagaagaaaatagccagtctgtggtggtgtacacctttaatcccagtattggtggggcagaggcccatctctgaatttcgggccagcctgatctacagagctagttccaggatagccagagccacacaaagaaatactttctggggggtagggggagatacagaaaggcaaaaaaagctcaacagctgggagtcagacaggcaggtggatctctaagttcaaggaagcctggtctacaaatcaagttccaggagagccagggtggttaaacagaggccctatcttgaaaatagacaacaaaagcaaaataacagaaattaaaaacattaaattgttgttacataccttaggcttctagattttttccctcgtgtgtatattcagaaatacacgtgtaagatcataacacatatttaatatgtttcccccagtctcttgtgttatttctgtagccatcataggattcactgtgtgtgtgccacaccccttttgaagacagtaataaacaacatttctacctttaattattctgttatgtctatggtgaagatgctgtgtaagttgtcctgtctttaatacctgttatatgaagtcctaagaatacagtttttaggtcattgtatatatgaacttttaaaaagtttttgtgccatgctactgaagatgagtatttctccaaggagtctgtgtctgctgtgctcatgcagtgaggtcagtttggagctttgtctaaggatactccctagtttcagtttctcatagcacatttctaaaacccaggtttcagattccaaaagcaagttccctgataactgtttgtctttaaaggaacttaagaagtacggagtgacaactttggttcgagtttgtgatgctacatatgataaagctccagttgaaaaagaaggaatccacgttctagtgagtgtccagtgtctgtgtttgcttgtttctgtgagctcactgacattccaaacactggtgtttgtgaagctcggaactcaaaggcgaagttagtaggcagtttaatagcagtctcctaacggttctttggatcaatcgtgagcagtgttatccattgtgtcctttgagtctacacttgcagtgtagttttcaacaaatgaaaggcaaagttgagtgcacacttatttctaaactgtggaaattggggcctggggagtgcttgctgtcagctcgagcacctgagattgacacgcagaacccaagtgaaaagaccttgcctcaaaaaaattttagggggaaagagggtgggtatggcaacacctacctttaactccagccttgaggaggcactctatgatttcaaggtcatcttggtctacatagtgagttccagaccagctaaggctacaacagtgaggcctgtctcaagacccctcagagatgaagttagcaatagctgggtaggaacaacaggttgttctcagactccagcatgcctaaacacaatgaaatttttggagattcatgaagttacacaataatgaaaagaaaatgttataaaaaaattaaagcaatagctgcctcagtatttaagagcaccttactgtgagccaggcagtcagtggtggtgcacacctttaatcctggctctctgggcacctcaccccccccccccccaaataaatagcctggagacatagtttagttgggagagagcttgcctagcatacaggatgccctgggttcaattcctggaaactgcataaaccagaccaaacacacctgaaaccccagcactgggaggtagaggaaagagaatcaattcagtcaccctcagctacaaagtgagtttgaggtctgcctagaaacatgcgactgcctctaacagtcaaatcccagggctgcattcgccatgtcttcttacaggatctccagcccacagacaaacccagtgttacaatgccaagcaataaaacatttatttatttatttacttatttatttaatgtatgtgagtacactgtaactgtcttcagacacaccagaggaggtcatgggatcccgttgtaggttggttgtgagccaccatgaggttgctgggaattgaactcaggacctctggaagagcagtcattgctcttaaccgctgagctatctttccagcccttgactatgacagctcttataaatgacatttaattggggggcctgcttccaagttcagaggtttattctattattcacattgcagaagcatggcaatgtgcaggcaggcatggtgctggagaaggagcttagagtgctacaccttgatctgcaggcagcaggactagtctttattgagcttctaagaccccccaaagccagcttccacagtgacctacttcctccagcaaggccactccctgtggccaagaattcaaacacatgaatctgtggggccattcctagtcaaacaccacagtcgccaagaggagtaatccatcagtgcactagtgaagaagagaccagtgagactcatttggcatacgggaccagtgggctgaaagcataatagcaatcctcctgctctcagctttcagagttttctctgttttgtctggttgctaccctgaccatataagatttagggctggttaaggtagggctggggggagggggagtggtcagtggtggaatacttgcctagtgttatagatccctagactcagtttaaaatatttgtgtgtatgtatttgtctttctttagatgggtgtgacataagatttcatttgagaagacttacttgacagattcagattttggtcttggatagtttttcagcagtgatcaggaagttgttgagaatagatgtaccggggcagtggtggtgcacgcctttagttccagcacttgggaggcagaggcaggtggatttctgagttcgaggccagcctggtctacagagtgagttccaggatgggtagggatacacagagaaaccctgtgtcaaacacacacacacacacacacacacacacacacacacacacacacacacacacatttaagtaagtacctggttggtggtggctcatgcctttaattccatcactttggagacaggtggatggatctccctgactcgggggtggggggtagggggattaaaatggaataggtaaagtgttttatttagctaacattgtctgccctggctattttcagctcatttttattaggaagtttgtaagaagtcgtttcttttcaggattggccgtttgatgatggagctccaccccctaatcagatagtagatgattggctaaacctgttaaaaaccaaatttcgtgaagagccaggctgttgtgttgcagtgcattgtgttgcaggattgggaaggtaatttactttttctgaattcactctgatatctaaataagccaactcaaatttttaccttggtaggatttgcattcagcaattaaatgatactaaatcaccagaaaggaaatgaggaaatgccagtgtaataagctctaataagagccctttgggttgtgtctggttctacttctaatgccatactgaatgtaatgaaggtcaagaagaagagatttaggtcattaagcgggcaacaaaattaaaattgttttagagattaaattatctgtacatgtttgggtttggattgaaatgaaacaaaatgaagttagttaacaggtagaagattactttaaactcttgagcagaaatgtgtacacaatgaaaattgtttgtgtaaaacttttcactgagcattgcttctgatagttttttgcactttgatcatcagcaggctaaatgccaatttatggtgtgcactgtgcactcagaacataactgtgagatgctgttgcctcaaggtggtggtgacccgtgtcattagttctgcttagcactttagtatggcaaggtttctccataaggttggatgtttaagttcttctgaaggctgatggtggtgtgaggccttcctgggtggctttgtttctattgcctgtctcagtgtagttggaggcagtgctctaacaatgtgcttaagactagagagtaggactgggtggtgttggctcactccttttacttctcagcacttgggaagtagaagcaggtgggtctctgagttcaaggccagcctggtctacaaatcggggatggccagggctgcagagaaaccctgtctcagaaaaacaagaattgagaagctgggggctggagagatggctcagcggttgctcttccagaggtcccgagttcaaatccccgtaaccacatgatctgatgccctcttctgttgtgtctgaagacagcgacagtatacccacataacatacatgaaataaataagtcttttaaaacaatcacaagaattgagaagctgagtacagtggtactgggaggcagaggcaaggactgttgtgagtgtcacgccagcctggtctacatggtgagaccttgttttagaagaaaacattaggtttgcctgcctatcttccaaatgctgggactaaaggcatatatgccactacatccaacacaaactcaagtttgtaatgtgtaagcttttgattaaaacctaaaagtctctgattctaaaggctgtgggcacttacagatgacttctacctgcagggctcctgtgctagttgcgcttgcattgattgaatgcggaatgaagtatgaagatgctgttcaatttataagacagtgagtatgaagctgtatgttcagaaacttgaagcggggctgtgcgtgcggaaggggttatgggaggaatcatttggaagatgcaagcactggttgctttgggcttaagacactgaagattaaaaacaaaagggttaacgcaagtgatcgttgctgctttcataatagcaccaatgcatttccatgtgacagcaggcaaaagcaatgtgtatggagaaacagtcatcacttggtgttctctctctcaagatttatttattttatgtatgtgagtacactgtagctgtacagatggttgtgagccttcatatgattgttgggaattgaatttttaagacctctgctcactctctggtcccacttgctccagtcaagtccacttgctcactcagtccctgcttgctccggctcaaaatttattattatacataagtatactgtagctgacttcagacgcaccagaagagggcgtcagatctcattacagatggttgttgtgagccaccatgtggttgctggtatatgaactcaggaccttcggaagaacagtcagtgcttttaccctctgagcatctcgccaagtccccacttggtactcttgagtggcctgttgtcatacatagttatactggtagtatcccgacagtccgcgccttggtctgaaagaataggccataccgttctttcttagtaaagttaaagcatccctgtctgtcccgaacctaaacctgaggctttgtccttgtatgctctagtttccgtttcgttttgttttttaaagcatcctaatacttgtcattctcatctgaagaatctgttaatctaaaaggaaagagtgatctggtgttcaaaactctgctgatttctgttatactacagtaacaggcagagaaagaaacttgggagggcagaggcagaggcagaggcaggcagattctgagtttgagctgtttacaccacaaattccagaacaactaaggctacagagagaaacactttcttggaaaaacaaaaggaaaaaaaaaagttgatgtttcagctttgtaaagtaatgtgctatggaaactatgtaggctttcagctagggagagctaactagaagtgttattctagacatagctctttgctacatgatagtgcgctgttcttatgttttcagaaaaagaagaggagcattcaattccaaacagctgctttacttggagaagtaccgacctaagatgcggttacgcttcagagataccaatgggcactgctgtgttcagtagaagtagaagcaggctggctggatcgtggcattagagggaactcttggtacctggaaatgtgaatctggattcttacctgtgtcatcagagtagtaatggattcagtactcctcaactcctaatgattgagaagaaggcaaacgataaagaaatccctctattacacgaataaaatgtttaagaaaagaaaaaagaaaggaaaggggattaatttagtgaaagatgattttgctcctagttttgatttctgccaggattgaattatttcaaaatctcctgtgttttttaagctttttcaaaatagatgtctgaggaaaaccagcagaatattaaccagtgtggagccagttgttgggagcacacacttccattatgcttggcacataggtctccttgtggtgggtgggatctgggggaggtagattttcctcatctctcttcctgcctccctcccatctcctgatccacatagatggaatagaaagcagcctttgttgctgtagatgtgcgtgtgtctggcagccttaagcccacctgggcacttttagggaaaaaaacaaaaaaaacaaaaaaaaccaacaaaaaaataaataaaaataaaagcaaagaaaaggcagtggcgcatatattctgtggtccaggctgtttctagtctattgatgatggatgcttatattagttttttttttttttaacccccttgtgcccctgatctaccattagggtgtgagaggtagccaggaacctttggttttataaatggtgacgaaatgacatcctaaacagagtctttctcctgtaatttagctgagagaattctttttcccaacagtgaaacaagtgggcctcctagaaactttattgcagagatgactggaggccattggtgtttccaggagagctagcatgtttctacaagtgtaggactggattgtggatctgctatctaacaatgtcatggaaaagtggtatcttaaaattttaggaccgatttcagaaatagtcaaaggagcaacagaacattcattgtattttggtcttgagaaatgcctatagttttccaaattattcttgtacagttttatttgtacagttcagtgtaaccacctatcatcttgttaacactagattcttctgagattcaaaaagaaaaatcactgtcagagctagccttgcctagtgagtctgtgtccacaggctgtaacagggtggaagagcaacagtaggcagcccagtgagcagcatatgctcacggcatcatgtggcagtggtgtggggtctctgctcagtgtgttgatacagaaaagctgtttttccttgtttgcagaagttgaccagacaaagcaaatggaggggcacctctgtgtaccctcttcacctaagtgtttataaccagcagtaccctgctacaagccttgggtgcagccatcactggattttgatcgtcaggccagcaggatggatgacatctcattgatagtacccagatgttggtggctttctgagttgcctgtttactgttgatgcaattgttttgatttttaactaaatgcaaataccttcctgcctcatcccagaaaatgaaaaataatgcttttgacactgtttctagaattttaaagttgaaaaatgatgatataatccagaaattgttacttcggagcatgacaatagatttctttaacaaagactcaagatcaaatttcttacctaaaagtttaggttaactgttgactcctcaagggttttgatcaatatcacccaaaccttttccacttgacatgctagaattttggtgtgtgtgtgtgtgtatttgttcacgagcacaatagctcccatgggggtctgcacatgcaggtgtccaccagcatagcctgcctgagatagtgtcattcctggttctggggagaagggtgtgtgaaggagaataaagcagccctttgtcttaaagaagactaatgttaattgttctcagaactggatgttttttttccccccatcaaaattaaaactctttcttttggatttaatgaagtattgctaactgaagccagtttgacttgtgagagaggttagactgacagaaggtgtgcagcctgatttacaaccaaaccctgaacccttttgaagaacaataaaacatattttacatgctttttgtgaatttcttccccactcctaaacagttcatgtttgctctcctttctctgcttggcattctcaaggtctgatttgtgtcccattattaatggatacgttagagaggtgaagtgagaggtatttagtaagtatgtacttgaccaatctcattctaaggaattcatttttgttataggtttgcataatgtattacaacttagatttaaataaacctttttgggggagtggggtgggttggggaggggagggggctttgcaagacagggtttctctgtgtagctctttctgtcctggaactcactttgtagaccaggctggcctccaactcagagatccatcttgctcagagatccatcttgctcagccttctcctgagtgtgggattaaatacctgtgctaccactgcccagctctttttacacttttttttttttttttcttttctggctttttaagacagggtttctctgtgaggtctttaaagtggagaattagctgctttaatgtatcatagaatttctctttagtcactggtaaactagataaatttaagcaggacttcaacctaaagaaaacaaagttttagtgggtacaatgagaattttggtttctttaagaacaaatgtgtcaggaatgtttaatcccctatgtgggacttggagctgctttagagtgtccgcaacagctggttgtgatttgcttcatgctccagcaggggagcaattacaccagctgcaggtggtttctgcatgtttttgacattcgcagttctagggactctttgaaaggatatatatggtagatccaatcaaccacttttgctatttgtcaagtggttgtgggtaaagaaatgaaaagaaattggatatcctgactggaacaaacttgcaccaaggaacttggtgcctcaatgccctcttttccctagtgttaggggcttggaaggtagagttgggggtggagggagaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcctttccttactttagttctaattggtttttaaacccaagaaacaaggaacctggaaaacagctcagcgggtaaaaaggctgagctcatccctggagcccgtgcttgagagagagagctggatgctacggatagttgtcatcccagcactcctgaggagagagagcgagcagagccagcttgtgatagtgctggatggtctcaacaatgacagctgaaagctgtcctctcactgtcacagtgtgccctggccagtgtgtcccagcgctcacaccaaagctttgaaagaagcttgccaggttacaccttacccagccatctctggtgggcacgcaatgccactgtcttagttactactaccaacatacccagtgtaaagggtcccattctatagtatttctaagatttagaaaagaaaaatttgagtgtgtgtgtgccacatgtgtgcaggtatccatggaaaccaagagacagaattggatcccctggaactactgctgaagaaacgtgggccctctgcagaacctgcaaaagcactcacaccgccaaccaactctccagccacctcccttttatttttttagttttaaggcaagcatttccatcttcttaaatctcatcccttatttgattaaaggttcaaatttaagtgcctttttctgatacccttttcattaacttttctacataattcccaccaacttataaacatactatttattgcatgataagagtcagagctgaggctggcaagatggctcagtggttaagagcgccgactgctctttcgaaggtccagagttcaaatctcagcaaccacgtggtggctcacaactatccgtaacgaaatctgatgccctcttttggagtgtctgaagacagctacagtgtacttacatataataaataaatctttaaaaaaaaaaaaaagctggagttggtggtataaacctttaatcttggcattatttggatagcagaggtcggaagatcacttgagtttaagaccaccctggtctgtgaagtgagttccaaggtagccatggctttgtagagagaacctgtctttatttggtttgaggagttggcaagatggccaccatgcctgagtttgatccttggagcctgtgttgtaacacacaagtgtgtacacgtacaaaagacaaatcgttttgatttcacatctaccttgttctgacacagaaacacaccctgtactgggaattgaacactacagttaaatttctctttaatttacagtaaaactaaacttacattctcctttgagtctgttccagcatagattgttttgtggtttgggttttttatttttgaaacagggtctctataggctggtctataacttcttatgtagaccagacgtcttatttgggatttttatcctctggccccttttaagtgctgggtttcaggcatgcactgccctctctgtctcccagtgagaatttttatttcattgggattgctcctataaagaccaccagaagttctgttgcacttagtttagtggtgggttctcctagtgttggatttgtctacctggtgggattgatgccactgaagtcttcattgagctgggcagttgtgctgcatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctccctctgtagcttgctctactttgtaggcaaggctagccttgaactcacagagatccacctgtttctgcctcctgaatgttaggattaatggtgtgtgccatcacatctggctttaaaccttaatttttaaaattacatttaattcgtgtatgtgtttgtgggtaccccacagcatttgtgtggaggttagagaacagcttgcaggaattggttcctccacttttgagtcccaggaagtgaggttggattgtaggctgatgccaagccactctatctgctgaaccatcttgccagctttttattttttatttttattatacataagttacactgtagttgacttcagatgcaccagaagagggcatcagatctctttatgggtggttgctagcattcgaactcaggaccttcagaagagtgctcttacccgctgagtcatctcaccagcccatcttggcagctcttaagttttccttttttttttttttttttccctagttacgtaaccaaaagaaaacaaaaacctaggttggcctaggactcccagtggtcctgtctctacacacccagctgtggggctcatggtggcacacacttgtagctagcatttggatggctgaggcaggaggatctaggctacatagggagtccatgtatcaaaaccccaagggattaaacacagcttgttgagtgctgtgacaacctcctgtgagtgagcggtgtgcctgctacgtgtttacccactatcctagccactgaggataccaggggagggaacatgacaaactggcaagaaattattaagggataggagaagaacatttcagttaaacatcagtgcaataagagaacgtgaggaagagcctaggaattagtgattaatgcagtcagacggaatggccatgagaccgaggaagatgaaggaacccgctatatgctgagatatatgaagatggtaccagtatttcccaaggagtttgtgtaaacttgaaaaactgcttggtgtgggttggcatagcagtgcagatcctgaatatggtaaggaaggcaagcaaatttagtgaggttgggaaggtaggttggtgatgctaaggcagggatctcagtaaatgggcagtgtactctctctcacagggacagccttagccatgtgctttgttcaagagatcaatgtctcagcaccagcaatatcttgtttcgtctttgagacagggtcttacatctagcccaggctggctttgaactggctaagaatagttgaggatgaccttgaatccctgatcttcctgccaccgcctcctgagtgctggggtggaggggggacacacgtttgtaccactagtttttgagacaggattatgcctactttggcctggaattcccaccacctgcctcagcctccagagtgctgggatcacagcatcagaatgacacccagcccacacaagtcatctgagtcagagcctctaactgtagattgccgctttctgcagagcagaggcacggaaggtcagtcagtgatcagccgttgcaagatcaggtctttgtgcaaaaggttatgtaagagtcctcttgagttagaggctgtgtgtttaaagggtgactgactcgtactgtgcatgtgggatgtgtcatccaagtggaggagaatgaacaagaaaaggtagaagctgaggaatcctaatggctagtgatgggctgccgtggtgcaggacagaagtttcaggccttaaggaagggagcgagagatgactaagacagacttccttctgcaccattgtgcagatcagtgtgaaaggtcagcagtatattctcagtcagcagttcaaggagatagctgggatgtttggccatggaccgggggtggggtggggtggagtggtggtgagcccttcccacgcccacctatctctcatcctctccacagctcacgcagactgaaagcaattagaatacttcaggcttggcagctttgccatctgccctgcagaagagccactggcaggtgtagcacacagtggcactggttaagtcacttgtgtctgcttggttgttttgaagatagggattcggaaagatggagtagcaagggtctaacagtacccatatctgtctagttcccttgtgctccgggttgtgcctgattagatttagtcttcactggcctcaccaccagtcccatttttaaatgataaactacagcgtaaactgactctaaaattggcccttgactgcccagcttcctaggctgggaagatgtttgttaatgatttcttaggtatggcatcatgcaaaggggtccttgttaattgagctgtgtcgttacattaaatgcaggggcaggagaagggttagcatgcaggtgcacgtgtgtgtgtatagtgagtctgcctcgtcagtgactttaacttgtgtaaaccgtgtgtaatgggccttgccagtaacaaagcagggtatctgagccgagtggtttatagtttataattggcttcttattactgttggctgcctttcctacacatcgagtattactctaggattggtatttgatttaagaaattttcaaattgattttatctcagtgcattaatgcgtggcctcaattcctgcagaggcatcagataaaaccagcctggatgtgttttaggaatcataactggatctgagctgccagtggcccagctctcagtcagcatagataaatccctttgctgaaaaaaaaaaaattctaagtccatcggcttcttagggcatctcaaattgaggccccatgcaactggaaaaatttccccaaataatgctaaaacacataaatgagaatttgctgacatgaatagatctaatcactctcttccttctgggatccaacacataaatattcaaggaataccgtggaaatcagcctaactgtcaagggtgcccaattgtgatgctttccaaaatcaggaaatgcgaaatatgaccctagcaataaaaatgctattactgcggttgagtgcatgggaagctggagtgtgttctgtctgtaatttcatgaggattagcataggtaaatgtttgtaggttttatttttttttccatctctaaaagtgcagaatagattgcagctgtgtggaaatacctattaatcatcttctaatgcttttatgcaaatgcttatatttgactttaatttagagttgccattaacacctggaactctaagattgataacaggtaaaaatttaatgaatgcataaattaaatatttgagtcatatttaggttaatttatagcctctttgttcctggctccacagccccctgataactaaaactcacaggattaggcaggaagagagccctgagtttgtcttatcttttttcttttttcttttttttttttttccgtttttcgagacagggtttctctgtatagtcctggctgtcctggaactcactctgtagaccaggctagcctcgaactcagaaatccgcctgcctctgcctcccgagtgctgggattaaaggcgtgcgccaccatgcccagcgagtttgtcttatctttttgttgttgttaagatttatttatttttatatgtatgctttgctttgctggggtgtgtctgtgccccgtgtgtgttcctactgtccaagaagccaggagagagcatcgggtccactagaacagaactcacagatggctgtgagccaccaagtgggtgctaggaaccaagccccagtactcggcaagagcaggtgctcttgacctctgagtaatcctgtagtcctcccaaccctgaccccattggaagacaggatttcactgtgttgccctagctgggctagaacttgatttatagatcacgctggccttgaacctactacagagttccacctgcctctgcttccgttctttgcaaataaattagctatgctaggtatatgagtagcaagaagattttttggttgttttatgtcctatggatatagatactttagatctttttggggggtgggtttggtgtttgagacagggttgctctgtgtagccctggctgtcctggaactcactctgtagaccaggctggcctcgaactcagaaatccgcctgcctctgtctcccgagtgctgggactaaaggcgtgcgccaccatgcccggctttagatcgtttttatattacttgttttattacattattagtgttgaggtaggttttttcttttctttttctcctcttcctcctcccccctgctcctcccttcctttttgtgtcagagtcttgctttgtaagcctgacttccctctaactcactgtgtggaccagtcactgtggcctttaaccagctctctgtcttttaacctttaatctgtcctcctgcctctgcctcccacgtgtcaagaaacaggtatgtgccatcacatatgggtttttttaaataaaaagtaaaaaattatgtatgtctgtgtttctgtgtttctgtgtgctgttctagggccagaggtgggtgttggaggccccagagctagagttcaagcagatgtgagccagt

SEQ ID NO: 1416 - DNA, 723 bp, Mus musculus
agaagcttcctaaggaacaagcaagttgaatagagaaaatagtgatcaataataggcattttagtggtctttttaatgttttctgctgcggaacatttcaagatttattgatttcctcctccccccatttttttcccaccacactcacacacgcacgctcacactttttatttgccataatgaaccgtccagcccctgtggagatctcttatgagaacatgcgttttctgataactcacaaccccaccaatgcgactctcaacaagttcacagaggaacttaagaagtacggagtgacaactttggttcgagtttgtgatgctacatatgataaagctccagttgaaaaagaaggaatccacgttctagattggccgtttgatgatggagctccaccccctaatcagatagtagatgattggctaaacctgttaaaaaccaaatttcgtgaagagccaggctgttgtgttgcagtgcattgtgttgcaggattgggaagggctcctgtgctagttgcgcttgcattgattgaatgcggaatgaagtatgaagatgctgttcaatttataagacaaaaaagaagaggagcattcaattccaaacagctgctttacttggagaagtaccgacctaagatgcggttacgcttcagagataccaatgggcactgctgtgttcagtagaagtagaagcaggctggctggatcgtggcattagagggaa

SEQ ID NO: 1417 - DNA, 504 bp, Mus musculus
atgaaccgtccagcccctgtggagatctcttatgagaacatgcgttttctgataactcacaaccccaccaatgcgactctcaacaagttcacagaggaacttaagaagtacggagtgacaactttggttcgagtttgtgatgctacatatgataaagctccagttgaaaaagaaggaatccacgttctagattggccgtttgatgatggagctccaccccctaatcagatagtagatgattggctaaacctgttaaaaaccaaatttcgtgaagagccaggctgttgtgttgcagtgcattgtgttgcaggattgggaagggctcctgtgctagttgcgcttgcattgattgaatgcggaatgaagtatgaagatgctgttcaatttataagacaaaaaagaagaggagcattcaattccaaacagctgctttacttggagaagtaccgacctaagatgcggttacgcttcagagataccaatgggcactgctgtgttcagtag

SEQ ID NO: 1418 - DNA, 31236 bp, Homo sapiens
gcacataaactgaagtctttaaacataaaccccatagaaaagatagccatgatacttttgtcacaaaagtatggatgaatagaatccatttagtaaaactatttaatgtaatttttaaaagattaactgaaaacaattagattaatactcaatataaggattgtgctgttaggattttttaatgttattaccagtgctattccaatactttttaaagagaaagtcggcgttggccatagtgctgttaacctgcatttaaattttatttatgaaaggaaaaataccaattttagataagagattcattttgagaattggaaatctttagaggaaaaatggagtacaaaattgtaaagtaaatatttttaagtgtggcctgaaaatatttaatgcaatttttgtcttatagttatttgtagaggtagaaattactagaaaaggacaaccgttaatcaccggggtacatgcacatctaaaaccactcccttttcattttggtgggaacagggcccacaggacttcagtgaataactgtcactgttctcagaagcaggtgcgattgttgactaattgcttcccttatctttctgagtggctggccatgtatcttctactggttttgaaatgttaagacattttcccaccatcaaggtcatgatttctttttatagaactgattattgatttctgtactgggacttgagtctcaagttccctccttaaatgaggaagtggaaaagtgggaataaccaagggagtaactatgaaattttttttttttttttttttttttgagacagagtttcactctgtcacccaggctggagtacagtggcacgatcttggctcactgcaacttccgcctcccaggttcaagcaattctcctgcttcagccacctgagctgggactacagccatgcgccacaatacctggctagtttttgtatttttggtagagacagggttttgccatgttggccaggctggtcttgaactcctgacctcaggtgatccgcccatcttggccttccaaagtgctgggattacaggcgtaagccatcgcgcccggccaaaaaattttttttaacagtaaaaaaagcatcttatttttggcttattcactgacattttggatccttatttgtgtagaattgaattgatacctctttatcaccttcctaggactgtagttattgtgggtaaggagggatattaatattaatattatattgtatataattatattatgctatatattatattattatatttatatattataatatataaatatatgttataatatatatttgttatatataatataatattaatttaaatctaagtttcaaggactagattattttagtttgataaatggaacagtagagggataaacaaaggtaggtagtgcagaggatagatagaactgttgttctatctacttgatttgggagtaggttataagagatgaataaattttcagtttgagaccagttaatcagaagatgcgtgtttactaattaaacgctttactaattaaaggtgaggttttttagtttacaagttttcagacacttttttcccccaagtggtcaaaatacaataggtacagtagcattttacagaggactttccctactactttgatggttgagaagattttacaatctattgtctgaatagcctctgaatattaagttggactccacaagttctgtagttactcagagccttgactgtttttcataaactctatatccagtctgtggacaaatcccacgtcaaagtgtatcttgaaactgaccccttcttatcttccctactgctgttaccctggtctaagctaccattatatctacttgtctccttgcttccacccttaccatttttgtaatgtttccacatagcagatagagtgatcctttgtaaaacctaagttatcactctttttttctctcctttttcagcttttatgttaggttcagtgtgtacatgtgcaggtttgttacgtgggtaaattgaatgtcgctcgggtttggcgtacaaatgattttgtcacctcgtcaccagttagcaagcatagtacctgataagtagtttttcaagccccactctcctctcaccctccaccctcaagtggtccccagtgtctgttgttcccctctttgagtctatgtgtactcagtgtttagctcccacttataagtgagaacatgcggtatttggttttctgttcctgcgttaattcgcttaggataatggcctccagctgcatccatgttgctgcaaaggacatgatttcattattttttatggctttgagttgtcactcttgagtgaaacccttcattggcttcatttggagaggcatcattttctgaataaaagtcaaatgcttttagtggcctataaggctctcttttatttctctgactctattcattccattgtcctctctgttccagtagcattggttcccttgttcctagcatactctaagcttgtccccacctcataacctttgcagcagttaatcctctgcctaaaatgctccccaaatacctgtttggctcacactctcagctcttggataaaaagtcacttttttcagtgaggcctttcctgttagccttatttaaaattggaacccccctccctctggcactgctaattcccctacttctaatttttctccagagcagtgacatttttatttctttttttctgcccagtaaagtgtaagatccatcccaacagaaatttttgttttgcttattgctcttgcacctgtaagagtatgtgacccatagtacatgttctgtaaatatttgaattaatgaaagaatttgaggaaaatgcctagctcttcaggaggataaattctttactgttgacagattagattttttatacttattttaaggggaaataaaagtggctattgacatgaagggaatttgctttaggaaaaaaatgttgcaaggtgttagttgtatattacattattaggctttcatgttgactgattgttgaaaccaagctgactcaaatttgcattacttcctgtaaaatttctggtaagaaaagtagcagtaaatatatgcatactcgttttttttagacctttgcttttagactgtatttccttaaatctagaattcttttattgtacctttatattttaatgtgctgttttaatttggtgaatactggcgtagctcaccaaattagagggtttattgtatcatttaatttggaaatgtaaagggatgatttcttagaaatcctgatgtgagtggattgataggagagataaatatatatatatatatatatttttttttttttttaattttttgaaacggaatctagctctgtggccaggctggagtgcagtggcgcaatctcagttcactgcaacctccgcctcctgggttgaagcgattctcttgcctcagcctcccgagtagctgggattacaggcatgcgccgccacgcccagctaatttttgtatttttagtagagatgggccagtatggcttcgatctcctgacttcgtgatccactcaccgtggcctcccagagtgctgggattacaggcatgagccactgtgcccgccaattgataggaattttaaaaggatgcccggtaaaattgggttaaattaaatgaggctgcttttataaaattcccttatacttctaaattcaccttttttttttttgagatggagtcttgctctgtcgcccaggctggggtgcagtggtgcgatcttgggtcactgcaagctctgcctcccgggttcacgccattctcctgcctcagcctgccaagtagctgggaccacaggcgcccaccaccacacccgactaatttttttgtatttttagtggagacggggtttcaccgtgttagccaggatggtctcttatctcctgacctcgttcgtgatctgcccaactcggcctcccaaagtgctgggattataggcgtgagccacggcgcccggcctctaaattcactttatttgtagttagaattacagttgccaaggcaggacgtgaattttactcatttagcctctttaacaggaaagaaaacactttatggaattgtgtaggtacagacctgcctgggacagaggactagccctctggagcctctttctaatcctatgattatagaactgttaagaacgtagtttgattgtaaatcattatagggttcttatcaccttagaattttttttaaaggtaataccatatgtacatgggaaaagttaaaacagttcaaaaggtatatgttaagatgtagtaaatcgtgctgttgacctccagccttcagtcctgtgttcctggccctgccccaaccctaggaaaccactgttatctcttatctttgtaatcttccagatatcccatgtgcatgaatgcatacagtactcacacatatttctaagcacactgttgatactgtcatgtactgtgcctttttttacttattagtgtcttttagctgtcatttcatatcagttcatacagatgttttctttttaacctctggatagttttttctttttttttatcccttatctccctcctttcttaatttaaaaggacttctctgtcacagactatcctttctcatccttcattgaagttgtattcttttgttaaaaatggaaatgttgcctaggaaatggaaatatcccaaattcaacattttaaaagttaggttttatgataaaattaaatggagagagagtatttgggtgtatatttgaatttaccactgttatatgtcaagtaaactagcctttttcatcacttggtaagttaaaacaataatttatttaagtagatagagcagaattaatgtcagagagacaactttaggagaattttcctgtatggtgtacatgcactgaatttatgttaaaacatagggttctgcaacttttgagtactttctagctgtgataggttgtttatgattttttacacactgtttgctttgcattcctaagtgtgtcacaggaattaacattagtttatctgaattgacaggtgcaaaaatgtaactgttgatgtgtagttgaactcttgatggagggggagggaacagaagcttgtttttatcatgtatctgttaaaagtgctagaacatactgtttcttttggcagaaattcctttgctgggttctcagtattaagaattgaaaatcttaataatgaattatctttattcctggaaatggtctttccaaaatgaggttgggagagtaagatgggataaagcttgttctgtttgctgagcagacacacactggagactaggtagaaaacttaatgctggagctgtagcctttaagcctggctgtcactacaatgcaggtctttcagtgcctttactcagctgacacacatttgcagtgataacgtcattgaaccaaagggattcaaataggttagaatttccttgtgttttgctctgcattgcatgcaaactattgttctttgagtagttactttaataaactccacccagtctcccaccttattttaaggtcgcagagttggagatgaacatccaagcagatatttggaaaaaaaattatacttgtatggaagattgcaacttgaaaaatatgtggggctggacttagtggctcacgaggcctgtaatccctgtgctttaggaggccaaagctggaggatcgcttgagcccaggagttttagaccagcctgggcaacatagcaaggcccccgtctctccaaaaatactttaaaaatattagctgggcgcagtggcatgcacctgtagtcccagctactcaagaggttgaggcaggctgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcaagactccgtctcaaaaaaaaaaaaaaaaaaaaaaagaggttgaggcagaaggatcacttgtgcccagaagtttgaggttgccgtgagctatgattgcaccactgcattccagcctgggcgatagagcaagaccctgtctctgaaaagaaaagaagaggctgggtgtggtggctcacgtctgtaatcccagcactttgggaggccaaggtgggcagatcacgaggtcaggccttcaagaccagcctggcctttggtgaaaccctgtctctactaaaaatacaaaaatatgcctgtaatcacagctacttgggaggctgaggcaggagaattgcttgaacccaggaggcggaggttgcagtgagctgagattgtgccacttaactccagcctgggcaacagagtaagactctctctcaaaaaaaaaaaaagataaaaagtatttgggccgggcacggtgactcatgcctgtaatcccaagactttgggaggccgaggcaggaggttggttttcatccaggaattcgagatcagcctgggcagcatagtgaaaccttgttgctacagaaaatcaaaaattagcctggtggtgtgcacctgtgttcccagctcctcaggagcctgaggtgggaggatcgcttgagacaggaggttgaggctgcggtgagccatgatcgcgccactgcactcagcctgggtgacagagtgaaaacctgtctcaaaataaataaaagaaagaaagaaagaaagaaagaaagaaagaaagaaagaaagaaagaaacaaacctgggtttttgttcttaagctgctaccagttagcagtgcgatcatacttaagccattttaacctctctgagccccaaactttgttttaaattttttttttgacagagtttctctcttgttgcccaggctggagtgcagtggcacaatcttggctccctgcaacctctgtctcccaggttcaagcaattctcctgcctcagcctcccgagtaggtgggaatacaggcatgtgccaccacgcccaactaattttgtatttttagtagagatggggtttctccatgttgatcaggctggtcttgaactcctgacctcaggtgatctgcctgccttggcctaccaaagtgctgagatacaggcgtgagccatcacgcccggccaacttttttattttttaaaaggtcagggtagttgatgtttctgttggttctaaaatttcttgactgtacaaggagtactttatgaaatgttttcctctgtaatctaaggtggctatgttttggggttacagttagaattttgaggtaggaagagcgatggaatgtatttttgtttttagttttgagggtagacattttgtgtttttactgtagcgagtaactcattctgctgtagtattattgaagttcttagaatgccattttgaatttcatttgtgtcttttatattattttagttttatgtttgtgtccgtggttatataatcacaagtatgcaatttacacaataaaatgccataagagtatcataaaaaaagcttgaggatagatgaatagtgttgaagctttgtaggcctagctacttacctatatatttcagtttcttcctgaaaatggttccgtagtcattatctttcatacctatttctgtctggttacagctattttttagagacttctaaataagcctttattggtaacttagggaaaaggcaagtgaaagaacttaagctttgtccctttttccagaggaatttatgattatgttgatgttctctgactgagccagctgtaaagattactgtgtttcaaagcagcaggcctaaaaataataataaaaattctgtcacttcttgctttgtttttttggtagggattaatgtttggggagaagtgtgtgtgaatcagtgaccttcaaataattttgtattcttgaggcaattattatgtgacaaataataaaaaggtaaactgaaatagaaaggagaggatgaggtttatacattagttgagtcaggaggcatttgtggtacattggaaaaaacgggactaacagaagacttgggtttgaatttgggctcagttaaaaacttccattgtgtgatgttaggcaagtcacttcatttttctgatcttctttcctcattccttatatgttgtaacaactactcaagacttgtgaggaaaaggggaaatgatttttaaaaaatcaattctttatttacgtaacaagttggttatgtccactgcattgtgtgaaacattacagtatcatataggaaagtactgtcagtacagtgttggatcacaggattttttgagagtgccttatgagttagtctcatcattgagggccaacacatatactttggatagaaagaataaaatcctcaaagtgaaattttgattaatatcctctacccatttataggtacaccttattttaaccaaagagtatatgtgaaggacctaaccatcaaagcagaaaaataaggagatctttgtgaagtttatgaagagttcatgggccaggcgcagtagttcacgcctgtaatcccagcactttgggaggcctaggcaagcgaatcacctgaggtcaggagttcgagatgagcctggtcaacgtggtgaagccccgtctctaccaaaaatacaaaaattagccaggtgtggtggtgggcacctgtaatcccagctacttgggaggctgaggcaggaaaatagcttgaacctggggggcggaggttgcagtgagctgagatctcgccattgcacttcagcctgggtgacagagcaaggctccgtctcaaaaaaaaaaaaaaaaaaagttcatggaagttttaagtatctagtaatcatttaaaaattatttgagttaaaagtaatcgagtctctgattttttttgtttttttgttttttgagacagagttttgttctcattgtccagactggagtgcagtggcacaatctcagctcactgcaacctccacctcccaggttcaagcaattctcctgcctcagcctcccaagtagctgggattacaggcatgcgccaccatgcctggctaattttgtatttttagtagagacggggtttctccatgttggccaggctggtcttgaactcccgacctcaggtgatctgcccgcctcagcctcccaaagtgctaggattacaggcatcagccaccacacctggctcaagtctctgattttttttttttttttttttttttgaggcagagttttgctcttgttgcccaggctggagtgcaatggtgccatcttggctcatcacaacctctacctcccgggttcaagcgattctcctgcctcagcttcctgagtagctgggattacaggcatgcaccaccacacctggctaattgtgtatttttagtagcgacggggtttctccatgttgatcaggctggtctcaaactcccgacctcaggtgatctgcctgcctcagcctcccaaagtgctaggattacaggcatcagccaccacacccggctcgagtctctgatttttaaaactcttcataatacccctttatccaattcttcatagatggtaataacgtataattggtgacatttcacatcgctttgggcttataaagaatgtattttgacttcaggcatttgtgtttactgtgccatcagcctctagttcattttacttattcttttcttctccaggtttttcgttggaatatacgttgcacatttatggcgattctgagtgtgagggcagacttctgccaggctcagcacagcattttcgctgacaagtgagcttggaggttctatgtgccataattaacattgccttgaagactcctggacaccgagactggcctcagaaatagttggctttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggtaagattgtggcatggtctactttttggattgatttctaggtaaaatcccattaaaaaattctcttagcacaaagccatttattctgtatttggagtcatcctgccaatcctggtttgaattgggttgggttagttacagcagattttttcaagaacattttgtgaaatttggggactgtagagatatctagtactgttttctctgtgttctttctacatttattgacaggtttttttggtcaaacattcagtaatgataattaacatttattgaccacgatatgcacttagcattataacaaacaatgttacacattatgcaacgagcagtgtttgtgcttaaggtcacaaatacaaaaaccctatgaggtgtagctaccattatttccctcttaccaatgaggaaacaggttcagagccatttagtaatttgcctaatggcacatagtatgtggtggaactaatgtacttgcctaggtgtctgacactaaaaaccattctgtatgtacttcagatattctaaccacctttgatgaaaaggcacccccagactacttcgttgtaataatcgtatacaagggtccagaaacttgggtgaaggaaaggtggtagaggtagtatttttatgtcagatccttaatattttttctattggtaggagaaaaaactctttgtacttctttgagcaagcatttgaacataagtttttttttttttttgggagatggagtctcgctcttcgccaggctggagtgcagtggcactatctcggctcactgcaagttccccctcccgggttcacgccattctcctgcctcagcctccctgatagctgggactacaggcacctgccaccactcccggctaattttttgtatttctagtagagacgggatttcaccatgttagccaggatggtcttgatctcctgaccttgtgatctgtcacctcggcctcccaaagtgctgggattacaggcatgagccaccgtgcccagcccttttttttttttttttttttgagacggagtgcagtggcacgatcttggctcactgcaacctgcacctcccaggtttaagcgattctcctgcctcagctcccaagtagctgggactacaggcgcgcgccaccacacccagctaatttttgtatttttagtagagacgaagtttcaccgtgttggccaggatggtcttgatctcttgacctcgtgatccgccttcctcggcctcccaaaatgctgggattacaggcgtgagccactgtgcctgaccagaacataagctttttaatcattcttgggttgttgagtttaaatgatttttcttgctgtatttatggagtagagttagaaaggtgggtgaactcttagtgattttcattttatagatgggaaaactgagaccaaaagaggatttgacttgcttaaggtcacaaataccataaaaaattttatcgcaacttttcaatgaatggctattacagagtttattttaatgggattttatttgtattttgaaacatttttaaaattcctgacaatacttctacctttcttgagtctgtattataagaaggcctttttgtgaaaaatgaagtcctttagcaattaaaataattttacactttagataactaaatgatggacccttcttataggatatcactgtgcctgcttatttatacttataattccctgagcttcttaactttgtatacacagcgtacaagttgattctacgcctgtatgccctcagattgttcagtcacctttaagcctggctgaattatgtggtactattttcaacctgtggattccttggccatagtctccagaagtggcacaggccactgtcctcctgcaactataaaaaagatattggtagccccttgaagataggtagtcactgggttagggattcaccgtagggagagttttaaaggagcaaggcttctggctataactgcattagctgtctttttaatataccactttttttcttaatttcagaattttatttctttaaaaaaagcatgtttatttcataaaaatataaagatacagataagcaaaaagaatttaacaacatttaattgttaataactggcttctagatgtttttctctgcatatatctgtgtgtattcataaatacacatacagataggatcacactatatattttttaaaatctttccccatcttccttggtattgtttttatagctgtcatagtgttcactatatggatgtgccatacttctttaatcattcccttatttttggaccattaatgtggtttctaatttttcaccattccagtttgtggtgaatgtgctgttacctaaatatttgtatatgtctttaattatttcttttgtataaactcccagaagtagaatttttaggttgcagtgtatgtgaacttttgtgtaagttttcacgttatgctaccaaactgccctttagaaaggtgagtctcacactgccactgagatttcatgagtgtccattgaatatataaccacagtgagaacaattctgatctttgtctaaaaatgatatctcattgttttaatttataatagtagatttctttttttttttttttttttttttttttggagacggagtctcgctctgtcgcccaggctggagtgcagtggcacgatctcggctcactgcaatatctgcctcctgggttcaagcgattctcctgcctcagcctcctgagtagctgggattacaggcccgcaccaccacactcagctgatctttgtatttttaatagagacggggtttcactatgttggtcaggctggtctcgaactccttaccttgtgatatgcccgcctcaggcctcccaaagtgctgggattataggcgtgaaccaccccgcccggcctataatagtacatttctacatttttggctgtaggtttcaaaaacaagttccattataattttttttttttttaaaggaacttaagaagtatggagtgacgactttggttcgagtttgtgatgctacatatgataaagctccagttgaaaaagaaggaatccacgttctagtgagtgtgtagtatttaaatttttcaaaacaagttgtatctttcaaacataaatatttataaaactaggccaggtgcactggctcacacctataatcccaatattgtgggaagatcacttgaacccaggagttcaagaccagcctgggcaatgtggcgagatctcatctgtacagataattaaaaaactggtggggcatgttggtgcacacctgtggtcccagctacttgggtttttgaggtgagggaatcacttgagcccaggtggttgagactgcagtgagctgtggccacaccaccacattccagcctgggtgacagagggaaaccccgtctcaaaaaaaaaaaaaaaaaaaaattaaaaacttggtattaggtgggcacggtggcacacatttgtagtcccagctacttgggaggctgaagtgagaggatcgcctgagcctgggaggtcaaggttgcagtgagccttgattatgccactgcactccagcctggatgagagtaagaccttgtctcaaaaacaaaaacaaaaaaaccctggcagtaatacttttggatttttttaaggttgtagtggaaaatacattattgatagcaatctttcaaattcttttggattaacaaattggcagttttgttcatttgtgctcttaaagcctacaaatcatagtattttcaactaataaaaagcaaaatttagtgtgctcttattttaacaacatgtaaatttgcaagttttattttttaggaaattaatacaatatttagcttttgtttctaggctactaatttgaatataatgaaagtaatttccatcagacattcttaagtccatatggaactctgccactttgcaagtacaagattagttacttaatattttgtggataacttgtaggaggcaaaaaggtgggataagaggatgaggagaggtagaaggcatcctcctccagagtaatcagcatagtttctgatactttttgttaggtttctgaggagctttagtatgattagattttttgtctagctcaatttgagcacaaagtgattggaattattttaaattaagttcctttttagcatcaaaataggctgtttccttatagcaaatgggagcatcagattagttaacattttattctttcttccctaagtagttgtctaagttgtaggagcagcttttaggagcacgtaatgaaatgatcttgtaattttagatgtctttgagctgttggtttgattgtgggaaggttatgtagtaggaagagaactggagattttataagtagttaggaagaacgtaacaaggaagatactggtttaaggttatgttcctgcttcttattgagaggtagttctgtagtctttattatattggtcagtggttgggaaggcagttgatgcaaaaagaataatgacctattggtaaggcagtcctcttatatctgatccatagtttcctcatgtccattttggtgaaaataaaaactaaatagccaaatgtgttttaaaaaaatgtgttttagggccctgtgtggtggctcatgcctgttcccaccactctgggaggccaaggtaggtggatcacttgagtccaggagttccaagactagtggggcaacatggtgaaaccctgtctctccgaaaaatacaaaaattagctggacgtgatggcatgcacctatagtcctagctacttgggaggttgaggtgggaggatcacctgaacccgagaggtcaaggctgcagtgagccatgattgtgctgctgtgctccagcttgggtgacagagaccttgtcagtcaatcagtcaataatgtgttttaatagtttggcatggtaataatttgcttgcagtcaaatttctaaatgactttactgtccactgctggaaatcactgggaatgagtgtaaacatgtcaaatgcagccctgtgtttaaaaagtagtaataaaatttaaacttccgaaaataagctgcatacaagtttattttgctgcattatgaatatgttctctagtgagcaaaaatcaacttgttttgacagatggcagagtgagaaaatgactggattgaccatagtctgtttgagtcagtaatgttggtaaacatctttgtgaaatagaaatgaactaaagaacttgaactagtttgaggaagataatggtaggcctaagatttattccaggcctttaaatttaggtttttgttttgttttaaatagctgtgatctgggaaatgcaaatcaaaagcacaatatgataccaccttactcctgtaagaatggccgtaatcaaaaaattaaaaaaaaaaatagatgttgtcagggatgtggtgaaaagggaacacttgtacactgctggtgggaatgtaaactagtacaaccactatagaaaacagcgtggagattccttaaagaactaaaagtagaactatcatttgatccagcaatcccattactgggtatctacccagaggaaaataagtcattaaaaacaaacaaacaaacaaataaataaatagctatgatcagataaaatgaaaggtttaacttacacttgaaaaaacaagggcatttagccttaagcttggaatttccttttcccagacagagattttaagagttaatctaattttgctaggtgaggagggttttggaacatttcatggtaagaggatatccccaaataaggcctgtcagtcctctgaatgctcttgcaaaccagacacacattggaatagactaatggtggttttagctgtatcaatttgaggttcagatgtttctaaatgattaatgatttttttaaaaatagacactacttatatgagtaagtgaagcatgttttatattgtttcttaactaggtgcattttagggagtattagaggaagtaagctcttgactaaggtactggttttattgctatttacagttaaactctctagtgacatttataataacacagtcctttaattatggggcgtagttgtcaactcaatcatgtactgttttggctaatgggctacatgaagtgttctagtggtgccaataatgaatgcagaatcaatttaatgctctgtcacttttctctttttcctcccctaatatcttaaagtgtccttatccaatctcattagaatagccttatgtttttaaaaaaattcctaacagtgtttttgcatttctatctttgaagcttagatggcaggagggaaggcttgtaaaatgtcagcccccagtccccctcctccactccccatttgtgttggtttcttaggacctcttgctaagtagtgaggaagataaacccctgcctatactgtgaatgctcgtgggattagtcttaattgaaagatagcccaaataggtgaatacagaaagagaaagggatacttgacaaaatggtctccatttgcccaggaccctgtcatgcagccctgtccttgttaaatggggacatatataatttagtaagcactttaaaaatactcactgcttgccttttaataagcacaaagatggtagtttgtttctgttatgatttactaactattggagatttcttatcagataacctttctctaaagatgtcataacttagttatcttgaattataatcttcaattatctgtagagaccaatgagacaccagttggtatgctttgccagagtggacttttaaatcatgttgacatgtgctgtgtcctctgttactttgtcttggctttaattacagttttgtctattatgtctaattactactctattcagatatcatttttgggagaacactagctcttatgactctgatagagatttctgtaagtttttgtaaattcagatgtgtgcgacactgcattgagaagggtaatttatttggcaaactttaatttcaatcctggatcattttacagcaatgatcagaattgtgttaacaataggtatatatagtgcagttagttcagttaggcctgccgtgtgtactgtgtgcaggtattctgtattaggatgttaatcatggagaaaatatcaatttaatgtaaaaggtcatttcttttcaggattggccatttgatgatggagctccaccccctaatcagatagtagatgattggttaaacctgttaaaaaccaaatttcgtgaagagccaggttgctgtgttgcagtgcattgtgttgcaggattgggaaggtaaactcttacctttattaccctttttgtctgaattcattaccatgcctaagttagttgaaagtttcactttggtagacatttgcatatattatactaaataacattaaattacctgaaaggaaaggaaatgagaggaaaaactagtgtaatgatttctcaaaagagcctgttcatttcatctggttgtctgattctgatgccagcctggattgtgggtgttttatttttctccctatttcaagtaatcaaaagttcaggtcactgaaattggcaacaaaattaaaataattttagagtttgatgaatctatacatggttaattttggactgagatgaatgggaagttaatagatagcagatatctgaactttaaactcttgaaagaagatgtatggacaagaattgactttgatcttaaaaccttttcccctgagcattgcttagaatggtgttgcaacgctgtcatcagcagcagattaaatgccaatttaggatgcacactttgactcaaaacattagtgtaggctgccattgcctcaaggtggtgattactcaagctgttagttctgctctgcccttttgtttgctatttccttttttgtagtgtggtactgtttgttcataaggttagaagttttagtccttatcctgaaggttgaagataatgttgtaacgtgagttggcagttttataactagtagctatcctagttttaggtagcccaaaattggtgccctgtaatgggctttataaaaacatcatttcctttgttaaatttttttaaaaagatagaacttcttctagtcatcaattcttgggcattttcctagctcatcaaaaggattttcttgaaaacgtctagcacctttttagcatttgataaggaaatattaaaatcaattggtaatgaaaattctgacacattggagataagtaatatgtttggtcatttattttactgtgataatggctaaaggccaatgaaggatttttgatcatatctagtgatgagagaatttaatatataatgtgatgttttaaagagtaaagatttcttaaggtttagaatttagtgctttactaaaagtagataatcaggctgggcgctatggttcacgcctgtaatcccagcactttgggaggcggaggcaggcagattgcttgagcctaggagttcaagagcagactgggtaacacggagaaaccccgtctctactaactattaaaaatcaaaaattagctgggcatggtggcgggcacctatagtccgagctatttgaggaactgaggcaggaggatcacctgagctttgggaggttgaggctgcggtgagccgtgattgtgccactgcactctggcctgggtgatagagcgagaccctgtcccctgccccgccaaaaaaaaaaatcatagaattaatgatgatgagatatatttactgtattaggcagataccagctactttagtatacaggaaaaagaaagctcatgcgttgcattggtaatatgcagttacaggtttttaaaaatcctttcactccaagacttatggatacttacatacaggtttctttctgcagggcacctgtgctggttgcacttgctttgattgaatgtggaatgaagtacgaagatgcagttcagtttataagacagtgagtatgaagtttttgtgttcagaaacacagaaagcaagatcatgcatgaggaaggaattatggaagggatattcatttatagtatgggataatttgctttttttggcttgaagtattatttgaagatgtaaaaaatttagagcaagtgatagagactcagtacagctggtttccagattcaaaagttttctaatttggacattatagactgtgtccagtatattgttttgagtatctaggaatctcaaaaatgccccttttaatagattccaaataccttccaaatataattctctgttaggaggaggcaagaagaatgtgtagaggagcagttaatcacctgagactcttttttttttttttgagatggagtctcgctctgttgctcaagctggagtgcagtggctcaatctcggctcactgcaacctctgcctcctgggttcaagcgattctactgcctcagcctctcaagtagctgggactacaggcacgcaccaccacgcccagctaatttttgtatttttagtagacggggtttcaccatgttggccaggatgatctcaatctcctgatctcgtgatccgcccacctcggcctcccaaagtgctgggattacaggcgtgagccaccacgcctggcctcacctgggactcttaagtgatctattcagggacaaaatcaggatggtagtgcacagacaggatcttgacattgatctggaataacgaatcatgctattttgttatccagaattctttgacaatttttgtcttgccctttccctttcaacccttcctttaaaaaaagaaaacgaaagtagaaactattctgatctttattaaatggttaatagactataatgacagtcagcaagaaaaatttttctattccttctaggagggcttagaaagttcatgttgcaacttagctctttaagaattgttgtagtatgggaaatatgctggttttcagctgtgtggaattagaaaggctttaggatgtaaataatgcatttcagtgaatcagacagctctttttttacatgataaagtttgccattcttgtattttcagaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagataaaaaaaaaaaaaaaacaaaaaacaacaccaaaaaaacagcagtgatatatatatatatatatatatatatatatatatatatatatatatatatatatatatatatatataatataatatatatatatatatatatattttccaggtggtttttagtctttactgatgaaagggtgttcatgttagtttcttcaaaaccctatctaatactaggcaaagtagccaagagccttttgttttgtttttattttgataaattagtggagaaatggcattttaagaggagtctcttctcaacttacctgagagtcgaattcttctcttccctaaccaatgaagctaagtggttatcccagaaacttgtcttctaaaagggaggactccaggccatcaataaagatgtccaggcagtgagcgtactttttacaccctgtagaattgtgggctgtagcgttactctgattttctgtctagtatcagagaatgctggtagcttaaaatttttattttaggacttgtactctgaattttcaggaaccgtcaaaggagcagcagcaaattcacatattttcgacttgagaaatgcttgtggtatgtgttttccaaactgccccctatatgtaaagttcagtttaaccactgattgccttgttattactaggttttttgagattaaaaaaaaaaaatccctggtttaaaaccaacaatgatgcctagtgagtatgtgtccacaggccataacagggtagaagagagacatcgtgcaacccaatgagtagtgaagggactgtgttgcttgtgaagcggtgtagtagcatttttgcagattcttggctgggtttagtgtactgatctagaaaagctgtttttctgctcctttgtggaaggcagttatgatcaggctgcatggacaaagcaggtagaggggcaccatcaggggctcttgcactattttcacctctaaatattacgtactcagtagtgccctgcttctagggctctgaatacgggcttaaagtcatcttgtcctgctggaatttgctgtgcagagccataagcctcccattttgttagcgtcagctaggccaataggaacagaccgggaccttgtctcacactgatgatacctcacatgttgaccggctatgtgaactgcctatttcctatgctggagttttgatttttaactaaacgcaaatctgtagattctctcctctcccatcccagaaaacaaaacaaaataatgcttttcgaaattgtttctaggactttaaaacataatggtatatccaaaattctttatttcagaatgcaacaatagattccattaatatagactcaagatcaaaacagcatacctgctaagctaagatagatggtgttgattccactgggttttgatcaatacaataacaaacctttttcctttgacatactctgaattttgttgtttggggggagggggtgtgtgtgtgtgtgtgtgtgtgtgtgtgtatgtgtgtgtgtgtgtgtgcacgcgcagtgtccatcagtatcagtgcctgcctgagttaggaaaattacattcctggttctgtattgaggagaaggatgtataaagcaacatgaaacattagccctccttttattttaaagactaatgttaattgttcttaaaactggattttttttccttaaagcaatttttttcttttcgatttaatgaagtattgctagctgaagccagtttgacatagagagatgtcagattgatttgaaaggtgtgcagcctgatttaaaaccaaaccctgaacccttttaaagaacaataaaacatattttacacgctctttgtgcatttttttcctccatcctcaagagtttatgtctgtgcttataaagcggagtttaagctgggtgcagtggctcatgcctataatcccagcacttcggaaggccaaggcaggcggatcacttgagccccaggagttcaagaccagcctgggtaatgtgttgagtccatctctacaaaaaaaaaatgtttaataattagctgggcatggtggtgtgtgcttgcagtctcagctacttgggaggctgaggtgagaggaacacttgagcccaagaggttgaggctgtagtgagctgtgatcatgccactatactccagccttggtgacagacaccctgtcccaaaacaacaacaacaaaaccaaaatttcacttacatctgttcccctttctttgcctgctattttcaaggactgttttgggtcctgctagtttactgcaaggaggtaaaatagaggcttggaaattcaaagattttatgtcactgaggtgttcaggaagagccaacttaaccatagctgggatacatctagtacattttctggttcagttcttgtatacaaccctgtaggaattcagcatcttgtcaaaggcttggtttataccatagattattattttttagagacagagtcgtgtagtgcttcccaggctggagtgcagtggctattcacagagtcaataatcgcatatactatggccattctgagtagtctctcactgcacccagcttatttataccataggttttggtgaagcattgcaactttgtacttgaattcgtattaaagaacaatgaggaagtaacagctctgtattaatatatcaggatttgggagtgtggaatttccctttcactatgggtaagcatccatccacccaggtaacaacatgctcagatactaggaaaagatacgacactcatttcactttggagtacctcagtctggagggggtgtcagatatgtagacataaaacagttacagtgggtggttatagtactatttatagatcattgatccacagcctgggcaacatggccaaaccccaacttgacaaaaaatacaaaaagtaactgggtgtcgtggcgcactaccatctggactacagtcccagctactcgggaggctgaagtgagaggattgcttgaacatgggaggctgaggttgcagtgacctgatactgtgccactgcacttcatcctgggtgacagcgagacgagtctcagaattcattgatcctgccacttctcttcacctcttttcacttcttcatgtccttcattacctagcttaggttctgtgatgcactgtgacaatcagcttttcagccttgccccatctcttgttgcattgtacttccctggctaaaatccatttttggttaagttcagtactccactttctgtgcacttaagtacttacacaactgaacatgctgattcagtctctctaaggtcatgacctccccgggccaggtggtacgcgcctattaagtctcagttactcaggaggctgaggcaagagaatcacttgagcccaggagttttgaggctacattgtgaaatgattgtgcccgtgaacagccactgcactccatcctgggcaacatagtgagaccctgtcttgaaaactaaagctatgacctcacatgagcctcaaaacctctcaatcctagtacatttctctatcccatttacactttctcttaaatttttaacacctttgccatcctctcagcttatgactttttaaaacttagaaataaaattttcacaagctcctcccatcacatctactcacccacctgcatctgtgctactgtcttttagttactataggcagactgtccttgcccaatttttttttttttttttttgagactgagtcttgctctgtcacccaggctggagtacagtggcgcaatctcagctcactgcaacttccgcctcccgggagcaagcgattctcctgcctcagcatcctgagtagcagggattacaggcacatgccaccaagcccagctaaattttgtatttttagtagagacggggtttcaccatattggtcaggctggtctcaaactcctgacctcatgatctgcctaccttggcctcccaaagtgctgggattacaggcatgagccactgcccggcctgtccttgccctatttaaggcaagctcttccacttgtgtgctaaattccatcccttaacctgttcaaagggcccagaggtgtagccattttccttctctgtcctgctcattaacttttccccctactagatcattcccatgagcttataaacatgctagtattccatattttaaaaaaatccttgtttgaccccgcatctgccccttcagctgtcatcccgcttctttgctcttctctagtacaagttgagaattatctatctatgctctctacttctctcctttgagcttgcaccaatgaggattttgactccacagaacagcccgtgttaaagatcgccagaggctgggtgcagtggctcatgcctgcactttgggaggccaaggcagacagatcacatgaggccaggagttcaagaccagcctcccaacatggtgaaaccccgtctctactgaaaatacaaaattagctggatgtggtggcacacgcctgtaatcccagctactctgggtggctgaggcacgagaatcgcttgaacctgggaggcagaggttgcagtgagccaaaattatgcttctgtgctcctacctggtcaacagagtaagactgtctaaaaaaaaaaaaaaaaaaaaaaaaaaaaggatcaccccgatcgatggtcaattctcataacttttttttgagggtcttgttttgtcacccaggctggagtgtagtggcatgatcatagctcaccgtaaccttgaactcgggctcaaacgatcctacctcagcctcctgagtagctaggactacacgtgcatgtcactgtgcccagctaattaaaattttttggttgggtgtggtggctcacatctgtaatcccagcacttcgggaggccgaggcgggcggatcacctgaggccaggggttcgagaccagcctggccaacatggcgaaaccccgtctcttctaaaaatacaaaattagccaggcagggtgatgcatgcctgtagtcccagctactcgggaggctgaggcaggagaatcgtgccattgcactccagcctgggtgacgagcgaaactctgtctcaaaaaaaaaaatttttttttttttttttttttggagagacatagtcttcatagcctttatttatttatttatttaggacatggagtcttgctctgtggcccaggctggagtgcagtggcgcgatctcggctcactgcaatctctacctcctgggtttaagcaattctcctgcctcagcctcccaagtagctgggactacaggcacgtgccaccacgcccagctaatttttgtatttttagtagagatggagtttcaccatgttggccaggctggtcttgaactcctgacctcaagtgatccctccacttcggcctcccaaagtgctgggattacaggcgtgagctaccgtgcctggccaaaacatagtctttttatgttgcccaggctggtcttgagctcctggtctcaaatgatccccctgcctccgcttcccagagcgctgagatgatgagcatgagccactgtgcccaccttcataacttctttgacatgtcagcatatggtacagttgaccacttcctctttgaaatgcttcatttgcatgtaggaaaataatgcccttctcccctaaccccccctcaaatgtccaggttctaaatccctggaacctgtgaatgttatcctacatgtcaaagggactttgtgggtgtgattaagttcggaattttgagatgggaagaatatcttggattatcttggtaggcctgatctaatagcatggatccgaaaagcagagaacctttcctagctgaggtcagagggagatgtgtctaggatagaaggatcagagatttatttgaaggtggagggaaggggccaggagccaaggagtgacggcagcctcgaacctggagaaggcaaggaaacagattcgcccaacagcctccaagaaggaacttagcctgctaacaccttgattttggttgcatgtaggatttctacagaactgtagggtaaatctgtgttgttttcagccacaatgtttgagataatttattatagcaccaatagaaaacgaatacaggtttttgcctctagaacactacactcctgagttttcacctagtttagttgccacacctcagtttcggtttctggttcctcattagcttctacacttctgttctatctccctggactctattctctggattctagacccatatccaatacctccctctcatctctcactgatgtgtcatagtggaaacttaactttaattcttgctcaaatgttagcttgagtgaagctttccatggccaccctatttgtcccactaagctttagtgtcctctgtaatacttaccaccatctcacaagcttcttttttttttttttttttttttttttaaagtttcactcttgttgcccaggctggagtgtgatggtgccatcttggcttactgcaaactccgcctcctgggttcaagcaattctcatgcctcagcctcccaagtagctgggattacaggcatgtgccaccacgtccagctaattttgtatttttagtagagacagggtttctccatgttgatcaggccggtctcaaactcccaacctcaggtgatacgcctgcctcggcctcccaaagtgctgggattgcagacaggtgtgagccactgcacccggcctcgaccttttaattatttgtttcccccaccaaaatataagctcaacaaaggcatagctgttttttgttttgtgtttcgttcaccgtatcttcagcacctcaaatagtgcttggcatgcagcaggtgctcagtggatactgaatgaatgggtatggatagagacatagacgaattatggtactgtgatactagggggtaactaaaactgccctggagcacatcaggagatgctgcagtgggcatgtttgagctggattttgaaggatgagatagaaaaggttgatacacaatgagatagcatgttccatccatcagaatggctatcataaaaaagatggaccataacaagtcttgggaagggtatgaagaagttggaacctttatacattgctggtaataatataaagcgatggtgcagtcacttttgaaaaacagtttggcagtttctcaaaaagttaaacacttgccatatgacccagcaattccaatatgtacaattttcaattctacatatatacaagggaaatgaagacattacggttacatgggctagggcggggacagggtttctttctgtggtgataaaagtgttctgggattagacagtggtgatggttgcataacagtgtgactgcattaaatgctgctaagttgtacacttacaaaaaaaggttgatgtggggacagtacatttcaggttgaggaaataatacaaggcagtggaagtatgaaagagcatggtatttttgggagaaggggcaagatttggtctctctggagggtttggatttgtgctaggcaggtttggttgtcatcagagtagaagaggtactagacaccccttccttgtacctccccgtctacccccgaggccatagatgattggatcagggatagacagttgactcaactgctgacattggccagcagattctcgtttttttttttttttgagatgtagtgttgctctgctgcccaggtgggagtgcagtggtgtgatctctgctcactgcaacctctgcctcccgggttcaagcgattctcctgcctcagcctcccaagtagctgggactacaggtgtatgccacgaggcctggctaatttttgtatttttagtagagatgaagtttcaccatgttagccaggctggtctcgaactcctgacctcaagtgatccacctgcctcagcctcctagagtactgagattacaggcgtgagccaccgtgcccagcccagattctcaatttcaactgaggtagactcttggatgtgaggggccagtagggccatgtgtatgttgggtcatatgtgagacgagtagacataggacagaggaaggaggacggagaagcagcccaggggagcagagagaagagactgtggcctgggattaggggagcaatgcccctgaattcagagttctttttcataaagcccagctgcacgtcgtcccctgaagtcctttcgatggtttctgtcccttccctcgccccttgtttaaaatagcttgagtcagtttcttaataaccaagagagccttgactagaagggattatacaaatagcatgttaaatgctgtgactgaagctcctataggtagagtggtgatttatgctacatcctatacactattctaggcactgaggatatagtgggaaacaagaaacacgctctgccctggtagggcttacattctactggagaagacagagaataaacaggtacacaaattagtaatctattttcagatagtgattgcttgagctcaggagtttgagaccagcctggctaacatggtgaaaccccatctctacagaaaatacaaaaattagccaggcatggtggtgcatacctgtagtcccaactacttgggaggctgaggtgggaggattgcctgagcccaggaggcagaggtggcagaaagaaagaaatttgaaactttattgatcatttctcaatctggagaagacatcagattcaactatgtggtttattaaaaatgtccacgtccaggtaccacccagatcattctgaatcagtctctagttgtgaatccgctttgggcggtggggagccatgaaggttggtaagcacagcagctacgtggtcagatctattctcagaaagttattcaaggagctccttaaatcagagaccgtacctgttatgtaaacccagttcctgatttgtactatgcatgcaacaaatatcagctgaaggaatgagaatgaattggagagactagaagctgagagacatttatggatggtgggtggatgatagttgcagcagttcaggacagaagtgttggggccttaactaagggagcagcggatggatggggtagaagattctttccttttagccaccagatcccagatctacatgaaaaggtatccagcatatctacatgctaatttctttctttgtttcttttttctttttttgagacggagtctcgctctgttgctcaggctggatgcagtggcacgatctcagctcactgcaagctctgcctcccgggttcacgccattctcctgcctcagcctcccgagtagctgagactacaggcgcccgccaccacacccggctaagtttttgtattttcagtagagacggggtttcaccatgttagccagggtggtctcgatctcctgacctcgtgatctgcctgcctcggcctcccaaagtgctgagattacaggagtgagccatcgcacctggcctacatgctaatttcaaaggattaatttacagggatatctggccatgggaaagatttgtaaaaccgcccctacctcttattttctccacagatcacacttgcacatgaaagtaaatagaatcctcttcactacttgcaaccctgctaaccaccccaaacaggttaacagaagtgtgatattagccatgttacttctgtttcctttgctgttttggggtctggcagtcaggaagatagagaaataaaatgataatactggccatcatctgttgagtactactgtgctcagaatttcatgtgcatgatctaatttaatcttcataggctactacataggcttcatcattgctaatcccattttataaatgagaaaatcaggaggtgaagtaatagcaagttggtggcaggggcagtattagaatctgggcctgggccgggcgtggtggctcacgcctataatctcagcactttgggaggccgaggcaggtggatcacctgaggtcaggagttcgagaccagcctggccaaaatgatgaaaccctgtctgtactaaaaatacaaaaaattatctgggcatg

SEQ ID NO: 1419 - DNA, 1526 bp, Homo sapiens
gtttttttttttttttttaattgcaagcatatttcttttaatgactccagtaaaattaagcatcaagtaaacaagtggaaagtgacctacacttttaacttgtctcactagtgcctaaatgtagtaaaggctgcttaagttttgtatgtagttggattttttggagtccgaaggtatccatctgcagaaattgaggcccaaattgaatttggattcaagtggattctaaatactttgcttatcttgaagagagaagcttcataaggaataaacaagttgaatagagaaaacactgattgataataggcattttagtggtctttttaatgttttctgctgtgaaacatttcaagatttattgatttttttttttcactttccccatcacactcacacgcacgctcacactttttatttgccataatgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtagaaggaaatgtaaacgaaggctgacttgattgtgccatttagagggaactcttggtacctggaaatgtgaatctggaatattacctgtgtcatcaaagtagtgatggattcagtactcctcaaccactctcctaatgattggaacaaaagcaaacaaaaaagaaatctctctataaaatgaataaaatgtttaagaaaagagaaagagaaaaggaattaattcagtgaaggatgattttgctcctagttttggagtttgaatttctgccaggattgaattattttgaaatctcctgtctttttaaactttttcaaaataggtctctaaggaaaaccagcagaacattagcctgtgcaaaaccatctgtttggggagcacactcttccattatgcttggcacatagatctccctgtggtgggattttttttttccctttttttgtgggggagggttggtggtatatttttcccctcttttttccttcctctcctacatctcccttttcccccgatccaagttgtagatggaatagaagcccttgttgctgtagatgtgcgtgcagtctggcagccttaagcccacctgggcacttttagat

SEQ ID NO: 1420 - DNA, 504 bp, Homo sapiens
atgaaccgtccagcccctgtggagatctcctatgagaacatgcgttttctgataactcacaaccctaccaatgctactctcaacaagttcacagaggaacttaagaagtatggagtgacgactttggttcgagtttgtgatgctacatatgataaagctccagttgaaaaagaaggaatccacgttctagattggccatttgatgatggagctccaccccctaatcagatagtagatgattggttaaacctgttaaaaaccaaatttcgtgaagagccaggttgctgtgttgcagtgcattgtgttgcaggattgggaagggcacctgtgctggttgcacttgctttgattgaatgtggaatgaagtacgaagatgcagttcagtttataagacaaaaaagaaggggagcgttcaattccaaacagctgctttatttggagaaataccgacctaagatgcgattacgcttcagagataccaatgggcattgctgtgttcagtag

SEQ ID NO: 1421 - DNA, 67191 bp, Mus musculus
  misc_feature (47049)..(47068): "n" at positions 47049 thru 47068 can be any base
  misc_feature (54343)..(54461): "n" at positions 54343 thru 54461 can be any base
  misc_feature (60604)..(60623): "n" at positions 60604 thru 60623 can be any base
  misc_feature (62084)..(62482): "n" at positions 62084 thru 62482 can be any base
acatggtggctcacaaccctctgtaatgggggatgggatgtcctcttctggtgtgtctgaagacagtggcagtgtcctcatgcatgaaatagatatttctaaagaaggaggaggaggaaagaaataataataataatacagggcatatacagggctaacaggattgttcagcaggtaaaggtgcttgctctcaagtctgataactgagttttattctcaggatatgggggcttaggtggtggtggtaggtgaccaacttctacaggttggcctcttgcctccatttttgcatgggatgtgcctggaccccagcccctgtggctggttaaatgtaattaaaaagaaaataagaaactgggcacggtggtgcacatctttagtcccagcactccagaggcagaggccagcctggtctatatagttagttctaagccagccagagttgcacagaaaaaccctgtctctaaaaacaaacaaacaaacaaaaaagggctagagagctggctcagtggctaagtgttaggagtgcttgttgctcaggtttaagtcatagtgaaagaacctagtggagaaaccccccactcaattccgagttggtgtgcacccaaggaatcacgagagactgtcttgatgcaaacacatgaggtagtttaatgacggagctccgggccgacatgtatctcacacaggagattgcggttgtcgaccactaggcttgaaagctaggggtttttatagaaaagggtctggggctgggggaggaattggcgcggtttcacacgattggttcatttaaacatcagcagagtgtatgtgcagatggaggtaacagcagagcatctggttaacatttaacccatgtcagaagggtgggagatagggaggcgccaggccagtctggacatgtctttgcattctctttatctttatggccaagcagcctcaggaatgtcttaatgatgggcctgcccaggcatgtcctggcctgttctgctatgttctcagtcccaggcttcaaagctcacaaacaactctttgggctattacatgaatcacaggactcaagttttattttctttcaatagcaccacatggcaatccacaactctctgtgactccagttccaggatagtcaatgtcctcttctgacctccaagggcatcaggagtgcacacataaatacacacaggcaagatactcatacttataacattttataatcataacaaggcccaggtacatgtgaggtccacatgcatgcacgtgggcactgcaggctgtgtaagtatgggtatttacacacgctgtttacaaagcactgttcgctccgggagggttggatggttgctctctctcctccatctccaccccagcccatcaggtagagaagaatccataaagacagacctgtctttcagtgcgccttggggtgtggttccagagaaacttggttttgttaaaagcaccagttaaagagctcacataatttccttcctagatgatgtttctaacacgattttcctctcatatgattattgatctgatagaaggaagatatttggcagatgttttgtctcagatggcctggcaatgctgggctaacaaggaggaagtagcctgggagcatcctggctctgggagcaccatcagcctctggaagctatgggagtgtacatggacccaccctcacacacagtcttccccgtccctttcaagcctgctgtctgaggaccacctgtgggagactaaagagtctgagcaggccctgtagtgggcttagggggtccccagtgactcagggaaaagcttctcctggccatgccccttaacagtggtgacagggactgcaccactgtgcacaactttactctgagaagatgcacagtacgccccagagattttaaagatggctcaagtgtgtgagcggccaatccacagagtccatgaaactctcatcaagatcacaggccccagctggagagatggctcagcggttaagagcactgactgctcttctgaaggtcgagttcaaatcccagaaaccacgcagtggctcacaaccatctgtaatgagatctgacgccctcttctggtttatctgaagacagctacagtgtacttacatataattaataaatctttgggctggagcgagcagggccggaacgagcagaaatcctaagttcaattcccagcaatcacacgatggctcacaaccatctacagtgtactcatatacataaaataagtaaatcttttttttattaggtatttagctcatttacatttccaatgctataccaaaagtcccccatacccaagtaaatcttttttaaaaattaaaaaacatcacaggcccttcagggaagtgagggacgaaatgaaatctggaataaacacaaagtgaggaagccccaagtgaggatgctgtgcctcctggaacagggcagatagtgccccctcaggcttggagtcatcataacaatgtggctggactcagagacagctgctgaccaacccacagatttagggcagctgagcaacaggctgggaatgtggcagagccttgccaagcctgacaagatcctggattccatgcccagagctgcaaggtcaaaccaaaccaaaaacaaaaacaaaaaaaaaaaacaaaaaaaccccccaaaaaaccaaaaaaaccaaaaaccccaccaaattaaaccagaaataccaagcagagaaaaagggaaatagaaaaatgaagggcacagaagcagtcattccttaaggatgctcaaaggcgaggaaccagttagatggccgagaagaagggaacaggctggcataggtgtatatgcgggtacacccagcagaggggtcaggaaaccctatctaggttcaaggtccctggctacctgctgggaagactctcgtgatccagatttgcacagacatttgcatgttgctttgaactagacttcaggtcaccagaattccatgttccaggccttgagcagaactaccatgcctctaacagccaataggggagccccagtggcaggactacggtggcctgcaggatgtcagtgggatggcaaggctgacaaccagagttccatctctggggacaaaataataaacgagagagacatctccccccagctgaccaccccaccccccgcagtgggaaatgtgtacccacacatgacacacaccaaataaaatcctttttttttttggtttttcgagacagggtttctctgtgtagccctggctgtcctggaactcactttgtagaccaggctggcctcgaactcagaaatccgcctgcctctgcctcccaagtgctgggactaaaggcgtgtgccaccactgccctgctccaaataaaataaaggtcatctaaaacaattacaaacagcaacacagatgggggacactcctgactctctggccccaggagacaaggtctgtgggctgtcccgtggtgtctgcagccaacagcttaagaaaggcgagggcacaaggtgtccttttgggcttgctggtctgcaggcgcctcctcctaggagaacaggcttcagtgttctggcacgttcctcccacttcagggagacaaggcaatctgcccagactctacagctagaaacccaaagaagcacaagagcgtccatgtttcttctcttagaacgcctgattctgcttacaacagagtccgcatagatttctaatcagagtaagggctgacaggcacttccttggtacttggtccactcacagagtgaagctgtagtgtgggctgaggccctccagggcaacaggaccagcagagatccactgtggaggtaaaaaggccagcttaggaagtttgggaaggtcatgaaacacttgcccctccagaaggaagaggctaattaacatttctcagaccttagggcagaactgccctgtgggtggggacacatcctgcaggacaccttcagacaagggacgtccttgtcacttcattccctaaagaccaatcagtttaaagggtgcactgctccgccaatcacgttgtgcctagttgctgatgctctcttctgcccctggaaaccatataaaaactccctgaatgggtgctgggggtcgccgcctctccttcgggtctgggaagaccccagtgcactggaacaaaaattcctcttgctttttgcatctattccggctccacgtggtccactcaggggctccctggtaagcagaggctccctggagtcttgcagagggacgggactctgtccaacaagttctctgtctcaaagctctgtggcatcagtagaggcccctgctcaggggttggagcctagctcccgtgtagcggctcagctcctccagcaccagcttctcctggttgtacatctggaacacagcagagcacaagctctggagggactctggggacccttgtcccgagtccgagtcctcccagggttcacctccttctgaagcccccctagccgctcccccaggctctgcacaagtctatcagcagcacctgaacagagactcagagagctgtaggtagatgcaagatcaaaggacaggacagcagggagtgggctcccaaaggaagggggagaagctggggtacacatggggcccagggaagtgtggggcagggagggagtgggcatagacagggctgggtggtagcagaagcagactgcgatctacttttaatttgaaaaaaaaagttcattcatgggtgctggagagatggctcagcagtggagagcactcactgctctcacagatcgcctgggttcggttcccagcacccgtatcaggaagctcacaaccagctgtagttccagtttcaggggatctactccttcctctgcctctgcagataaccagcacacacattacctacaaacgtaacccaagcctattggacaacgtagtgggctttaagtgtggtacccattggccgttagaagaaaaaaaccatgacttagcattatttgttgccaactgatgggtaagggttttttttattattttttattttttgtatgtttttctgaacattaagtgtcccttgacccccatcgataatagctagcattcagggaatttaactttcacctgcctgtccagggtgcctttcaggagtgaagtatcatgaggagccagagccttcaatacaagacctcacctttccaggcaggatggatggaggctgtagttcggcctcttgccatggggtttcgaggtgggggaggggaatgctgggcagcagcctaagggttaagggtgtatctggggtagccccttgcacaggtacccctcctaccttttgccactcggctttggagctgtgggtgaagcccagcaggtgacagagtccatgggtggctgtgacctgttggagtaattgagaagtcagctcaggggatgatctaccagacggccgccccttcgggctcacagaggacccttgtaagactgagttgtcctacgccaggaccctggggcaggatacacagttgctgccctgggttggagttaatactcagttctctcctgtctaggcaagtgctaccagtgagctacatcccaacctctatcgcctcctgtctaaaacagaacaattcattcactcagttcacttaattagtgtggagcaacactgtttggggttgagaccaggtaaaaagagttgattgtccctggcagtattgggaatctgactagatagaattaagcaagggtgaatcacggttgtagtatcagtggtctagaaggttgcagtgaagtattgattgaatccaagagttcaagacctgggtggtatagtctacatcttttcatttatttacttattatttttaaattgtgtatatgtgcacatgagtacagacatccttgcggcctgagaggacatctgataccttggagctgggggcaggcggttgtaaaatacctgacccagatgctgggaagagaactcgtgttcaccagaacagtggctcctgatacccacggagccatccctctaggctagggcgtaaaacaaggtcagggcacctgtgcagagtaggcatggtggtcaggcaaagacaggacaggactcgagtaggtggagggagaggctggacgcagcagaatcagtgtcgcctgcttctaactgcagacaggattgggttatagcccgcacaagaaggggtagaacagagtccagcagagggcactgaagatctgaagagcccagctaatgaagagcctgcatgatgtctagctttggctgaccagaacaccaagatttatagagaggactactgcaagctaagctaaagttatctctagcaatctttagtaccctctaataaccatttactacgaaccttgggatctgccctaataccctcatgttgagcagatcacctcttggaaagcatggttagtctgacacacttctagcctcggccatccctaaagccagggacactcagtggttgtgtgggaaacctacagaattgccaccacctccctgtatactgtctgtctaacgtctgcactgaagtcactggtgacatgtgccttttgtctattccgggactatgagagttcacacaaccccttccatgttgtacagtaacccaaatctgttctttggcttcagtagccaccctcatttggctcagaataaactagtttcttatttcctttaaagcagaggtgttattttatgtcaactggcagtgccgctgctggctctgggccacttccttcacagcagagaattataacttccccaactctgtatagcacaggctgcactatccgagatcaaggagacagtcaaggccaaggccttaactctgggtcaccaccagggcctgctttgggtcactcttcaactctaggaggcccacagacagcaaggctgtgggtgttctgccaaagtggagctcttctactgaacactggtacatcgcgtctcttgttagtttcccctcctgccttcaaactctgaagtgtggaggctcctgttctgttctgggtagtgtaataagaagccaatccagcaaatttcaattagggaagcatggtcccatttctagagataaaagctgaaagaagtccctggggacaccaggcttccccccccccccccagtgtgttctccttccctcaagtctggagcttccagtcccatcaatacaagtggtatgtgtggatgctcgtgtgttaccaggagtctcctcttccaccttctctaaggttcattttgaagttcctttgcgagcgtatgtggctccgcacccgacttaccgtcaggacatcacagtaatcctcactttctctgcaatgctgaagaatgtactccacccctaggaaaatgtctcccagattataatcatccggtgagtgtggctgaggaaattcgccagctttcagattctgaaaaggagaaacatcaccaggttacaaggacctggctcacttgtttagcagagggcacgggactcttaaccacaggatgctcaagctgcataatgaaggctaaggaccatcaaagagtctgagggggtggaatgcagttatcacacagtgaccctcacgtgctgtttttatcaaattatctactcacccccccaacccctctcaaagtcacattcaatatcattgaattggcatatggacacaatcacactctttccccacttgtgtgcctgccattttttcctgttaagggaaacaggctggagagtggctcagtgggtaagaacactgactgctcttctgaaggtccggagttcaaatcccagcaaccacatggtggctcacaaccatcggtaacgagatctgactccctcttctggagtgtctgaagacagctacagtgtacttacatataagccgggcgtggtggcgcacgcctttaatcccagcacttgggaggcagaggcaggtggatttctgagttcgaggccagcctggtctacaaagtgaattccaggacagccagagctacacagagaaaccctgtctcgaaaaaccaaagggtggaaaaaaaaaaagagaaaagcagaaagaactttgctttgacaggggaagaaacgtgtgtatgctataatccactatatatatatatacagaaacaaatccttcattagctgtggcctcttcagacatgctgtagaccttcagtcccctctgctgggctctgttctacccatcttgtgcgggctatagcccaatcctgtctgcagttagaagcaggcgacactgattctactgcatccagcctctcccaacgcacacctcgagtcctgtcctgtctctgcctgaccaccatgcccactctgcacgggtgcctgaccttattttatgccacaatcacaaggcttaactttccagggttaagcctgcatccttggctctttccttctcttttctatcctttgaagcaccatttactaccaattcattccccaaaaggagtattcccatttcttctgctaacaatgggggaagctatttagacaatgtggttccttgtagctatctatcgcaagggaatctgttgataatgcttaccagtttttacttttctgtccaagcatttactactgaggtacacttaaaactgcagacactcttatttgaatttcctgagggcactgagttagtgagagtggtccctgcatagaggaattgtgatgtttagggctagacatacttaatgggtctatgtcatattgcttcatttctgttttttatttgcttgtttttgagatagagaggatttttttttggaccgagtttctctttgtagccctggctgtcctgttaatcactctgtaacaccagggtggacttgaattcagagatctgcttttctctgcctcccaagcattaggactaaaggtgtgtgccaccactgccacccggctgagaaaggggcttcttatgtggcttttgtctggccttaaactaaccaggcagaccaaaggtggctttgaactcacaaagattcgactgcctctgcctcttggatagatgggattaaaggcatgcacagtcacaccaggctagacttcagtgcatttccagaaaacttcaaaatcaaagataaccagatctgtaatgtaattaacaggaactattctggaaggaaggtaagctgtacgagaagaacatatatacatacatatatatttattttaaatatgaggtatacatatttacctcatgaaatgagaaagaaagcacgtcagttgggacatttttattcctgtagatcctattaatgttctgaatagtcttgttgtcaacacagatgatccccaggtcaaatttcttcactcctaagatactcctgactaaatccatcttcctgcgaagtggcactcttctgatggggaccacccgctgcagatttttaatcaccaaactcatttcgggaagaacacccagccctttaaaaaaaaaaaaaaatggttggaaggaacctgtggttaaagttcgagaaaagacccgtaactactagagagtgataagttatgtaaaaacacacacgcgctcacaataaaactttatttgatgggatttatctggtggcaatgctaagggaaatcacctttatttaccctaggaaactaataaacagggtagactgggcacaacgtgcagaataaggcaagtggtttggggcggttgcaatggtgcaggaccaggtgaggatgagtgtgggtgagcaaatggggtcgctgtgggtccagcgtctctcgggcactcaggctggaggatccacgcacgaacgaggggcttccacgccgcacaatgcgggatcgccgtgcacttaccgaatccgaccgtgaagaaggtcgggggtctggcgggccgcctgccggaagatcagcagcagcacaccccagagagcggaagccggatgcggaggaccggaagttggtcctacaaatttgatgtccgtagcgcacacccaagagcccgctccagtggccggtttgttgcggtgcggtgggcccggtagaggctgcacgcagactgtgggcgagcacaagcgctggcgacagtggccgtatctggcggacttgctcctccctccgcggcctccgctgtcccttgtgtctttgccgagttgctgaaggccttcactagtcttcgctcgaaggcgtctgttaacctagcggccggcttccggagtgttaagcatcggggataaaaagctattatttctagaccagggcatcgcaagttcgagttaccgggagaaaaatgagatggtaggaacccaaagcagtaacattttaaattacggtttttgtgtttttatttatttatttatttattttgccttggagatcgcaagaatctgataagtgatgtgttcccgtcttattactgaggttttgtttgtttgtttgtttgcttgttttttccccgagaaggtatcaattgaataaaatgctttgcatttttattttaatcataacggatcaggcttcacctaagcctgctggagcacacctgtggtcccagcagaagggagaccgaggcagaagaaaggaacttaaggttgtgcttgattgtagtaagcttgaggcaagcctgggctaagcgagaccttgtcttttttttttttttttttttttggtttttcgagacagggtttctctgtatagccctggctggcctggaactcactttgtagaccaggctggccttgaactcagaaatctgcctgcctctgcctcccgagtgctgggattaaaggcatgcgccaccaagcccgttttacgagaccttgtctttaatgaaaagaaaaagaaaaaaaaatctttaaacctcccttacaccataatccatttctaataccctgtgtccaaaacctgttgatctgtgagtggtcggcggcccgttgtgcccttgccttttaaataattgtcttagaatttctgtgatttaagagttggagcaaaatatgctgtgatgtcctaacctttttttttttttccaggtcatcctgaggatgaaggagagcttcccctggcaacagataatttaaagaggagagctacttgtgtatagtccatatttattgccttcagataattggcttgaagatgcacccggtgaaccccttcggagggcagcagcccagtgcttttgcggtatcttccagcaccacgggaacatatcagactaaatcaccatttcgatttggccagccttccctttttggacagaacagcacacccagcaagagcctggcgttttcacaagtaccaagctttgcaacaccctctggaggaagccattcttcctccttgccagcatttggactcacccaaacctcaagtgtgggactcttctctagtctcgaatccacaccttctttcgcagctacttcgagttcctctgtgcccggcaatacggcattcagctttaagtcaacctctagtgttggggttttcccaagtggcgctacttttgggccagaaaccggagaagtagcaggttctggctttcggaagacggaattcaagtttaaacctctggaaaatgcagtcttcaaaccgataccggggcctgagtcagagccagaaaaaacccagagccagatttcttctggattttttacattttcccatcccgttggtagcgggtctggaggcctgacccctttttctttcccacaggtgacaaatagttcggtgactagctcaagttttatcttttcgaaaccagttactagtaatactcctgcctttgcctctcctttgtctaaccaaaatgtagaagaagagaagagggtttctacgtcagcgtttggaagctcaaacagtagcttcagtactttccccacagcgtcaccaggatctttgggggagcccttcccagctaacaaaccaagcctccgccaaggatgtgaggaagccatctcccaggtggagccacttcccaccctcatgaagggattaaagaggaaagaggaccaggatcgctccccgaggagacattgccacgaggcagcagaagaccctgatcccctgtccaggggcgaccatcccccagataaacggccagtccgcctcaacagaccccggggaggtactttgtttggccggacaatacaggaggtcttcaaaagcaataaagaggcaggccgcctgggcagcaaggaatccaaggagagtggctttgcggaacctggggaaagtgaccacgcggccgtcccaggagggagtcagtccaccatggtaccttcccgccttccagctgtgactaaagaggaagaagaaagtagagatgagaaagaaggtgagtcctaaacatgtgtgtgccacaaaagtgtgctgccgagctcttgtgaggtcccttgtggtcacttgattttaagtcccacgatcttggcttttatcccgtggtggctccttttgcctggaagtgttgtccctgacagacttacttgtctgctctctaaattccagattctctcaggggaaagtctgtgcgccagagtaagcgaagggaagagtggatctacagcctcgggggcgtgtcttctttagagctcacagccatccagtgcaagaacatccccgactacctcaacgacagagccatcctggagaaacacttcagcaaaatcgctaaagtccagcgggtcttcaccagacgcagcaagaagctcgccgtgattcattttttcgaccacgtgagtactcccgagaacctgctgcctgtcgctttttctgcattgcaaagaatcacacccagggctctgagcaggagatgcaagctccgcccctctgagcctgtgttctcagtcctcaacttggtcacttgaaaaatacattttttaaaaaattatttttaatttttgtgtatcagtgttttgctggcatgtttgtctctgcatcacttgcatgtctgatgcccatagaggtcggaagagggcatcagatcctctagaaccagagtaacagatgattttacaatgggtggaaccatgtgggtgctggaaataaaacgcaggcctccgtctggaattgcagcaagtgctcctgcctgctgcctgtctatctctccagctccaacgtcgtcacttgcaaactcttttcccttttcagccataagtcacttgcttgatagatggtagggaaagcactcacgtagctttccttttctctttaaatagctcattctaggttcagaattagatttgtgtgactgtgtggggtatggatcatgatagagaaggagtttgagaggacgacgagattttaaagggaaggttgataaagaggataatggacatgtgacgtggaaacagaagggagacttgggggtgtaggggtataggtaaatagccagcagaggcccggggcatgatgtaagggaagggaaccaattagagtaaggtataatgatacatgcgtatgaaatgccatatgaaacccattcctaggcatgcttgctaaaattactatttttaaaaatttattttatgtatatgagtacactgttgctgtctgcagacacaccagaagaggctgtcagatcctattacagatgattgtgagtcactatgtggttgctgggatttgaactcaggacctctggaagagcagtcagtgctcttaaccactgagccatctctccagccccctgaaatttttttttttttttttcgagacagggtttctctgtatagccctggctgtcctggaactcactttgtagaccaggctggcctcaaactcagaaatccgcctgcctctgcctcccgagtgctgggattaaaggcatgcgccaccatgcccagctctgaaatgattttttaagaatctcttcttcacttgaggtcgggatgacatagtttgttttcctaacctgggcgtgtgcaggtctgagttctctggagagtatggtgctgcaggggaggaccgagctgtgcctgtggagtctggttcctctgaaaggtctgagagtcactgtagacacatagtactttgtttccctcttgagacagggtttctctgtgtagccctggctgacctggaactcactctgtagaccaggctggccccaaactcagagatctgtttacctctgcctcttcctctgcctccccagttctgggattaaaggtgtgcaccaccaccacctggcttgcataatactttttcaaacttgaattttctgcttttgcttttgtattacttggctaagttcatggttagtctaaacattcaaacaatacagagaagaaaaagtcatgatcctattccctagaaaaaactgttgggtttgtagcattggctatatgatttcaccttgtgtaaatttatatctttgttatttttctaagtattcatacagaaagaggaaactaataagaacttaaaaaggagaatgcatgttctcataactttcatttttgtggtgtgtgtgtgtgtgtgtgtgtgtgtggtataggggcagaggcatatgtctgggggtcagaggacaccttggtggaggtgtgtatgatgtgtgtgtgtgtgtgtgtgtgtgtgtgtgtggtgtaggggcagaggcatatgtctgggagtcagaggacaccttggtggagtgagctctctcattctaccttttttcggggtccgggtattaaccttgggtcagatgcttcactcactgacagggctcgctgttgtttgcccatacgtgttgtgtctggaagggtctgtatgttgcccgtgctctgtcctgcttctgcctcccaggccctgggagagcaggcatgggccaccattcctagcttacagcttctagtctgatttcccgggatagggtcttgctgtgttgcccagactcacttggaagtgcagggcccttacctcagcctttggaggagttcaggataagaggcatgctgcatcctatccaactaattgttgctgttttctgcagtgaataggaagcctgtggttactaaatactacaaagtgtttttgtctgtcttgtttatttgcttactcagctttctctgccttttggggggtggggtggggactgcgtttggctcttgagtcttcaggctagggattgaactgtgggccttgagcatgctaggcacacgctgtcccgccaagctgcatcccagtgctcaccacccacccaaccccgtaggtatgctaggatgtggtgttgctgtgtagctaatggtctatggcttggtgtgttgcccagcttagtcttgaaactgtgagcaatgtcagcttcccaagtgcttgggttgtttgtacatatgccactgtaccttgcttctttatgtatttatcggatagcttttgtccttagtacagatctcagagaacaacgtttttgtgccagaatgtattcagtttgagggattttattgtttatttcttcataataattaaaaatgaatggctttatattcataattatgtacattacagtcacttcctttggacacaaattctctagcctaagctggtctagaacttgaaaacattttgcataaattattatttattcaaaattattaaaataataatgattattccttctgtataagtattttgcctatgtgtatgtctgtgtactccgtgcatgcttggtgcctgtggaggagagaagaggatgttgaatcctagagctgggttacgggcagctgtgagctgccatgtggatgctgggatctgaggctgggtcctctggaagagccaccagtgtcataactgccaagtcatctctccaggccctggcctagaacctttggccttttccttccccttcctgagtggcctgattaaaggtgtgcacagccatgcctggtgatcataacacttctatttccagaatgttctcatcagaccaagcagatattctgtaatcagtaaggcgcgtctccactctctgaccagcctttggttacctctctttttctatcattatgaatttgcctagtctaggtatttcatggatgtggaaccatacaagttgtctttatatgtagctcatttcacttggcatgttctttctatattgttatatggatgagaacttgattcttttcgatgggtgagtactgttctgttgggttgtctacactttgttactattgttacaacactactcttgtgttgttgcaatgggctattgtgaatgcttggtgtattggtatctgtttgcagcgctgactgctgtaattttgtgtgtgtgtgtgtgtgtgtgtgtgtgtgtgtgtgtgtgtattcttggccatagagttgccatattttatgatccacattttaaaaaaatgttatatatggggctagagaaatggctcagtagttaagagcacttgctactcttatagagggctgaggttcagttcccagaacccagatggtgactcgtaaccagctgtaactccagttctagtggatccgggtattacatgtgaactgtgcacctacaaacccacaggcaaaatactcacgtgcaaaatgaaaaataagcaaaatctaaaatgttaatgtgtatgcatctgtgtgtatattttaatgcttgttgttttgggagacagtttcatgtagtccaggctgacttcaaaattgctatgttgctgacggtgaccttaacacacacacacacacacacacacacacacacacacacacactcactctctctctctctctctcttcctcttcttctcctcctcctcctcctcctccactccttccttctcctcctttttctcttcctcttcttcctccttctcctcctcctctcctcctccttctcttcctcctcctgtccctctcctactactccccccactcccacccccacccccgttttcttcacagggtctctctctctctctctctctctctatatatatatatatatatatatatatatatatatatatatatatatagtcctggctgtcttagaactttctttgtagaccatgctggcctcacactcccagagacccacttgcctctgcctcttgagtggtgggatgaaaggcattgggcttccacgctgttgtggatttgttacaccacacctagcctttttttttttctttttttaagttttgtgtgtgtgtgtgtgtgtgtgtgtgagtatccttgaaggggaagggggttggatctcttggagctggaattacaggtggttgtgaggcatctgtctggtagaggagcagagcagcaagttctctttaacgctaagccatctcattaggtcctaaggtttacataatcattttcattctgtgtgtttgcacatgtgcgtgtgtgcatgtataggtgtgtgcatgtaggggcaggggcatcggtgtacctcggtaatcatctggaggtcagagaacaacttttggaggtccattccttccactctgtgagtacaggagattgaaccgtcttgtgtcacggtgccaggttccagctcagccatcttgctggccctccttttatttttgagtagcctgttctgtctttcagcattttaacatagtgtctggtctctctgtgtccttacactttgtgttgtgaactgtttttcaggcatcggcagccctggctaggaagaaggggaaaggtctgcataaggacgtggttatcttttggcacaagaagaaaataagtgagttttccactcttgtgtccccagtctgatgctctctctctctctctctctgtgcagggcctttgacgtgcaggtgtgggttctttccctaagggcagcagcagtgcggctagctccagctgcatcccggatctcatagctgtttcttcgagttttgcaaaccttgttctgacacttgtgtcttcaggtcccagcaagaaactctttcccctgaaggagaagcttggtgagagtgaagccagccagggcatcgaggactccccctttcagcactcgcctctcagcaagcccatcgtgaggcctgcagccggcagcctcctcagcaaaaggtaggactcatctccctagtaactgttgatggaggagaagcaggggagagcttcgatggttgctatggggcaggtgtatgaagagctgcttttgaatctcctccctcacagtgcgtgggtcttcgcagttgccagtgttagcagtgacatggctttattctgaagttccccaggtcctaggtctttgaaaaagccctctttggagtgggactaacttcaagcagatttttttcttttagggaaagccttatcacaaagctgcaatttttgctctagtccttcatttatgttttaaaaaatgtagttggtggtggtgctgtacactctcatcccagcagaggcaagaactctaccaacagactaacatttctcatcccccatctcagtgtctataagatttgaaggatttcagaattactgattgctcactgctcagcctagcctcagatcactcgctcaagcaatcctgtgccagccttgttagggcaacatctcatttatttaggctttgtgctttttattgttttgttttattgggggaggggagttgagacagggtattaggactctgactgtcctaaaactcattatgtagaccaggctggcactgaactcacagagatccacctgcctctgtctttcttgtgctgggatcaataaagtcacgtgtaacaacgcctggctggcttctttagttttaacgctgtattttcttaactttgaggaccagaatgtcttgaaacattaagaagtgggaatgatacgaaggccccaaatgtgctgtcttctccatagctctccagtgaagaagccgagtcttctgaagatgcaccagtttgaggcggatccttttgactctggatctgagggctccgagggccttggttcttgcgtgtcatctcttagcaccctgatagggactgtggcagacacatctgaggagaagtaccgccttctggaccagagagaccgcatcatgcggcaaggtacgacgcacagagacacacattccagattccctggcaggattgtaccaggcagtttctagggagccacagaggctctcctaccgcgaagtcttgggatttctgataatctgttcctggtattactgcgccctggtctgctagagatgtgagctgtgtgtactaatgtgatgactacatatgcttatatgtgtatgggaggatgcaggggaattaactgattattggtagagaggaacaggggtctgaaatgcagaacggagaggggatgctccatttcaggattgttccccttcggaatgttaaactgtgaatgcattgctctcaaagaatgttaaaataatgttacagatacacagaacccatatggaaattcatggactcatttacaatttttaaaaatatttatttatttattggttttttttcaagacagggttctctgtatagctctggctgtcctggaactcgctctgtagaccaggctgacctggaactcagaaatccacctgcctctgcctccctagtgttaggattaaaggtgtgtaccactaccgcctgtctacaattttttttttaaagatttattattatatgtaagtacactgtggctgtcttcttagacataccagaagagggtgtcagatctcattatggatggttgtgagccaacatgtggttgctggggtttgaactcatgaccttcagaagagcagtcagtgctcttaaccactgagccatctctccagtcctcatttacaatttttaaacatttatttttatttcccttgcattggtgttttgcctgcatgtctgtgcgagggtgtcagatcctctggatctggagttacacacagttgtgagccaccatctatgtgctgggaattgaacctgggtctttggaagagcagcttgtactctaacctctaagccacctctccagcccctacacgtttctcttaagtttcagctgtgtggaatgtctttacagctattaagctcatactcgctttgaacttacagtgctcctctctcagcctcctgggattgtacatacctatcacacctgacaggatttgctatttaaagctgtgaattagtgtaccaatcacagagctttcttagcatggtgatgaaaactgtctctatgatttataggcttggtgatttgtacatttctaataaatttgttgtcttaggatttctcttgctgccatgaaacactatgaccaaaaagcaaattggggaggaaagagtttattcagcttacacttccagaccatagtccatcatggaagaagtcagggtaggaactcacacagggcaggatcctggaggcaggagctgacgcagaggccatggacaaatggcgcttattggattgcttccaatggcttgctcattctgcttatggaacccaggaccagcagcccagagctggtacccccactgtgggctgggctcttccttatcagtcactgattgagatgcactaactatagggcctacagatggatcttacggaggcattttattgattgagtttccttctcagatgacttttgtttgtggcaagttggcataagaatctccagtatacttattacaaggaaaacctgactcagtctcacatacctaccaccccagcacctggcccggttgtagcctagtgctctagtggaagcaggacagtctgctgtccacagtgagctccaagatagcctgagctatgttgtggtaccctttcagaaaagcaaaagcaaaaccaaaaaatttaaagacgcttatactaagtttctaaaagtggaactaaaatgtgtatatgctgttttgagaagttttgcttaaaacctttcattctgtgagtaaaaagtggtctgcttactgagggaacaggtgttcccagtaacagtgtacttaggtaacttcattatgcagttctgaacacttaacagaatcccagactgggatatttttacccctccctacctcagggtttctctgtgtactgtagaactggctattgtagaactcgctctgtagaccaggctggccttgaactcacagagatatgcctgcctctgcctcccggaagtgctgagattaaagaaggtgtgcgcgcgccactgtcgtccagcctgcagatgtactttttggttacactcctgcattagtattgtgatttttccaccgaggtcctgagaaccacagagtgctggcagagcacacttgtctaagtgaaagtgatgtaacgcttcgtctgcttttaacattttaaactttctttttattttatgtgtatgagtatcttctctacatttatgtctgtgtaccacttgtatgcccgatgccaacgacggccagatccccttggactggagtcatagacagttgtgagctgccatgtgggtactgggaattatgcctaggttctctagaagagcagctaatattcttaatctctgagctctctctccagttctgtcttccttcttgagtctgtagtgaatgtgtttgattattagagaggggtgtagccttggctaggggcttttgttagccaagatacccattgcctggcagggtgggctacgaggcctatctcagaggcccaaaatttaagaaacatttctttttatgtgtgactgttcaggggcagtgcacagatgagacaggatcttatatattctagactaaccggaactcattatgtggcccaggctggccacacatttaggatccctttgcctcagcctcctgagtgctgggatcacaggctgatttttttcccattttatgaaagtatacttcgtgagttcttttttttttttttttttttttttttttttttaagatttatttattatatgtaagtacactgtagctgtcttcagacactccagaagagggcgtcagatctcgttacggatggttgtgagccaccatgtggttgctgggatttgaactccggaccttcggaagagcagtcgggtgctcttacccactgagccatctcaccagcccccacttcgtgagttcttagtactcctgtggtgcacgcacccttacgtttggcttggtatcattcagctcgagtgaagaggacggacctggacaaagccagggcatttgttgggacgtgccctgacatgtgtcccgagaaggagcggtacttgagggagacccggagccagctgagcgtgtttgaagttgtcccagggactgaccaggtagaactctgtgtgtcctaatgatctctgctttttttcctgttgttttgattttgacttttaaaaatgtatttatttactctacaagtgcaaatgtgtgtgtgtgtgtagtgcatgtgtgccacaaagactagtgtacaagagcagcttctctccttccactgttctgaagactgaattcaggccttgtgtcgtgtgccctcacccacactgagcgatccagctgggctcctattgttttgtttctggctttggattttggagtcagggttcctctacatattcctggctggcctagagctcactgtgtgatccggctggactcaaactcagagatctgtcacctctgcttttgaccgctgggattgaaggtatgtgcaccgacaccaccactcagcaccatttttgcttttaagttgttttctcttcccaagatactaactgttaaatgaatgtgtcgaagggcatggcttcccctcacttgagttagagtgcgtgttctgagttgtttgccaagaatttgcaccagtctgcattcttgtgcccttcagatttgctctacccagggtccccagcccagcaacatgcctcaccatagacccaggactgatccacagagcagccagcagataagcaggggcctcatctctgcacctacccacgtttgttatcttctgtgtctgcgaattcctgggaagttgcacctgctccatcaggcctgacccacagggctctgccctaaccctttctggtctaaactccccacctctggtttatttatggtgtgttggtttaacttgacacttgaacacagatgagatctttcctgttgcctgagcccctttacctgtcacagctgtgctttgggcgggctgatgtgtcttcacttagatttctgttcctctggatgccttgttatatttgcccaactcaagtttcttagcttacattgtccttgaaatgtctcacgtttaacagaacgttttcatctaagagttacattctcaagcattgttctcatagggatgcatgtcttagggttttactgtcttgaagagactctatgaccaaggcaagtcttataagggacaacatttaattggggctggcttacaggttcagaggtgcagtctattatcatcaaggtgggaagcatggcagtgtccaggcaggcatggtgctggaggagctgagagttcttcatcttgagacttctatcttgattagagggcagtaaggagaagactccctctgtaggcagcaaggaggaggctctctcccatactgggtggaccctgagcataggaggcctcagagcccacctaagcagcgacacactcctctatcaagggcatgcctcctccaataatgccacaccctatggccaggccttcaaacctccacaatgtgtgtgtgatttcctcctgcgtcttaaggtccaaaaactgccataaagcagtttgtccctacttcttgcccccaggtggaccatgcagcagccgtgaaggagtacagccggtcctctgcagatcaggaggagcccctgccacatgagctgagaccctcagcagttctcagcaggaccatggactacctggtgacccagatcatggaccaaaaggaaggcagccttcgggattggtatgacttcgtgtggaaccgcacccggggtatacggaaggtaactgctccccactcagatgatggaaatgcgtgtagatttacaaagtgaacttcaaactttttgttttatgtggatatttttatctggaacaaaaatataattttatttgagccattataaaactgtatttcattgtttcgttgtgtttgtttcaagttgaaatgtagttcaactcataatcataattttttttctcaaagttgactctgcatgtatcttgtgtttgtgttttctgtgtgtgtgctcagtgcttgtgtgtgtatgtaattctcccctctaaccttgaacaggacataacacagcagcacctctgtgatcccctgacggtgtctctgatcgagaagtgtacccgatttcacattcactgtgcccactttatgtgtgaggagcctatgtcttcctttgatgccaagatcaacaatgagaacatgaccaagtgtctacagagtctgaaggagatgtaccaggacctgaggaacaagggtgttttttgtgccagtgaagcagagtttcagggctacaatgtcctgcttaatctcaacaaaggagacattttgaggtaggttttcagagtcagaagttgggctttgatgtatagaagtttcgtagtgcagttggcaaattgagtcaggtgtaaacattgggagcaagtactgagacccgtgtgctctgtataatccctccatgttcattcctgagtggaagcctcccagggatgcaggaggaaactaggcacgtaagctgagaagtcccttagagttgttggcagttcagctttcagactgctttgttagaaatactagaaggatgggttaaatgaaatcagagtagatcagttactggagtgaatggatttgaaatgcagacctgacatttcagtagatctataggtgagaaatacagggaaactaacatggaaagcgattcaggaagatgccaaacatcctttggccacctgtgtacatatgtgggtgcacataaatacacacagttatgttttctgttctgctgttttgctaacagctgccaatcagtcggctaaattattccttacttgtttatcatccttttaatttgtcattttatttatttatttattttgtttctttgagacagggcttctctgtgtagccttagctgtccttgaacttattctgtagctcagactgggtttaaaggcacatgccaccatgcccagctgtttattatctttttaagattttcatttagtattgtttttaattgtgtatagtatgtgtctgtgtgtgcacatgtggaaatgaatgcagggtcctgtcagggctggaagagggtgtctggtatcctggagctgaagttgcaggcagctgtgagccacctgacatgggtgctagcagtctaacttggctcctttgcaggagaagcaagtgcttttaacctttgagccatccttccagccccacagcttattatctctttaaagaaacacttttaaaaccacacatgtaaacctattagaagttcaaagccatccttgtgactacagagtgaacttgaatttcacctaggatacagaagattctgtctcaagtgaatggatggatggatggatggctgggtgggtgggtgggtggatgggtggatagatgatagatggacaaatggacggacagatgaacagacggatgaagactgtagagtacctgctgagtgtgaggatggcagctctggttatagagcttagactttagtggtttgtgtcagacttgctgtcacaggactgctgaaacccagttattatcagattgattaagaccagtgtcctgaccctctgccttcctaacttacagagaagtgcagcagttccaccctgacgttaggaactccccagaggtgaacttcgctgtccaggcttttgctgcattgaacagcaataattttgtgagatttttcaaactggttcagtcagcttcttacctgaatgcgtgcctgttacactgttactttaatcaggtgagtagagcccctgctaccaggtaagaacaggaacaacaatactgtagtgttgaagtgcttctctgtcctgcgctcttcccgtgggcagccagccagctgtcaactcatgcgacaggcacagcccagcgaggtgtttctgctttaatcttgtatgatgggataccatggctctccattaggaggggccatgcagtgtaaacatggttctgtgtctcacagaagcctttggagtgacaggtttagttcatgaaagcaaaccccaaaccacaaatcctatattgtacaaaagccttaactttgaagtcattagtattaataacatttttgagagaacagtagcatagaaagactttggaaaaaaacagttttggggggtgagctgtgtttccactctgccctgctgtgccttgggatgacagaggccttcagaagaccgctggctcctctgtggtgagaagtgtgagcagcagccgcagcagcagcagcactctgccttcccatgctgcctcgggtctgcaggtgtctgctagcaggaagaactgggagttattacagcctctgatcacaccaagtcctggaaatgctgaatattagcacagttatagtctaggcaaagaattcatttttaggagttgtattttttttttaactttttagtttttgagattataatacagttacgtcatttatctcctccctgtcctccctctaaactctcccatgttccagtccttactcctttccaaattcatggcttctttcttcataaattggtgtatatgtgtctatgtgtttatgtattagtgcatctgtctgtctgtccacacacacacacacacacacacacacacacacacacacacagacaccttaatataaggataccatgctcagtctggataatgtctgtagattttcggggctgaccacttggtgagctcttccctggggaagactgtttctcccacactcagcatcctttagctgcctgttgttctgtgtgtagggttggggcctcctgggctttcccctgtccgcattagcatgtctgttgctgtccttgttgaactcatgcttagacagtcatgccggtgagtcttcatgaaggtagcttctgactctgacacaatcttatggcaaaccgcctggccctccggcttctacagcctttcctcccgtctcccacacgatccctgagccttaggtgtgggagcggggttggagttgcaccctttggcattgggtccaacaactctgcattttggttggttgtggttttctagaattgtttccagcttgcaaagagacgtttccttgatgagggtgaggacgacacaggacagatatttaataaagtggcagttacaggaagatccataacttcaccagcctggggaggtggctaggtttcctgtatcaggaattgattgccctctgtccgagcaggccttaagtctagttggagagctattggttactaccaggctatgtgtgtcaccaacacacctggaaaggaggttgccactggggagctctgcatctacttctctgtgtcattacagtttatgtgtactctccttgcacacttgcagcgtgacagcggagaaagtcagggcagattctctaactctccagccacaggcctgcccttcacagccccaactctctaagctcctgctttccttgtggtcacttctgtttcctgtctctcaagtctttgcataatccagagaatcttaagtcaagccaaagtcacttgtctgtccattgcccaaatgttttcagtccaaatgacatctggtgttgtacattgtggtgagattttcccaaacttctgtcttctatactgttgccttctcaggcaatgatgtgcctgatgctgtctgccaccctgaagcagatgcttagtcatgaacttcctggtccagagcagtgctgtgtcatattagtggttgtcctcaagcagctaaggagggagagaatagtattactttttaaagtaatagtagtagtagtagtagtagtaatagtagtagtagtatattattggctactgtaggtagcttcaaataagtaaaattgggatttttttttagaattttatatatgcatatttaaagacttatttattttatgtatacaagtacactgtagttgtcttcagacacaccagaagagtgcatcagatcctattacagatggttgtgagccaccatgtggttgctgggatttgaactcaggacctctggaagaatagtcagtgctcttaactgctgagccatctttccagcacaaaccaggatttttttttttttttttttttaaagaagacctttccactggtggtgttctccctggtcctgagtcttaggccccttctccttgctctttcggcccagctctagctgccacagtgccttcctatttccttacttaccagagctcgccctgatctctctcagggctcgtattccctcagactgccttctttgttgtatataattttttaaaagatttatttatttattttatgtatatgagtacaccattgctctcttcagacacaccagaagagggtgtcacatcccattatagatggttgtgagccaccatgtggttgctgggatttgaactcaggaccttgggaagagcagacagagctcttaactactgagccatctctccagtctgtctataatttctattaagtgttctttacatatttaccatcattgctctagtctcttccctggcatgctagtagtgtggacacgggaactttgttggctttgtctgcattgtactctgagcattaagaatacagccaggcatgtatgcactctctctctctctttctctttttaagatttatttatttattatatataagtacattgtagcttcttcagacacaccagaagagggcaccagatctcattacagatggttgtgagccaccatgtgattgctgggatttgaactcaggacctttggaagagcagacagagctcttacccactgagccatctctttagccccttcatatgctctcttgagtgttgttggcaattaatgaccactgggaggaaacagcataagtgctcagaggccctgaaacctaaccagacttccgttaagattttcctgttttctttggttgtcttgttttcgttacactgctatgaatccattttgttttcatacttaatttaatgtcttacatttttttccccttgcattccatagattcccatagtttcattacctcagctacttctggttcaggggatgttggacacttggttttcatgccctttccttggtagatgcatgctagtttttcttacaagtaaaacttcgcataccatcttttcctttggggccgttttcacagtagtctttcctgagcatctgagtgtctgtaagagcgtgcacaggagctaagctgtagcaggggctcatggttgtgtggctggctggctgtggcttttctctgagcttgcattgacttgcttctttcagatccgcaaggatgccctccgggcactcaatgttgcttatactgtaagcacacagcgctctaccgtcttccccctggatggtgtcgtccgcatgctgctgttcagagatagtgaagaggcgacaaacttcctcaattaccatggcctcactgtagctgatgggtaagagctgaggctgtatctatagccttccgacttctctgccccctcccctcttttcctttttccttttctgataaagtctgcttgctgggctcttctgtgtgcagctttcctgctgtgaaactaggggcactcccaacagacaaggggccagaccaagtccattttttgtttaagatagggtctccctgtgtagtcctgcctggcctgaaccttgtgtgtagaccaggctggcctcactcagactcatagagatccacctgtctgtgcctcctaagtggtagaattaaagatgtacatacaagggatttgggaataaaaaaaccagaccaacttctttcttattcccaagtcattgtttttgatcagttagctgagaacctaaagataaagattaagacttttctattttcttcattggagattgactttgttcacccatgtttggcccctgcacacctgatagaggagctgggtagaccagtaggccatggcaaggccttctgttcctgtagtcagggtgagactggtgatactcacaaactgttgtcccaacaaatggcaccattacatttggcatcctctgtttcctcagcccacctgcagctcttccctctcgatctatcctcagggaagtgctgtggctttgaatgagtgggatgccatcattgaaaaaggagccctgggtcacgatttcctgagactggacgctttttcatctgatacctgtccagccttgctttgatcgggggatcgggtagttctgtgtgaggaggcttagccgtcttctttccctgctgactacttgctgtgctctttgtggtctgcgtagctgtgttgagctgaatcggtcggcattcttggaaccggagggattatgcaaggccaggaagtcagtgtttattggccggaagctgacggtgtcagttggggaagttgtgaatggagggccgttgccccctgttcctcgccatacacctgtgtgcagcttcaactcccagaataagtacgttggagagagcctggctacggagctgcccatcagcactcagagagctggtggagacccagcaggtgagtcaagtacgtttcccttcttggaagcctccctgtcactcgaagattctgtcttggccagatgcttaaatatctcttgctttgcctggatctggagttttgaagcccctgttagagcttgtgatagtgcgtttccacacagggcatctgtcatcctgtgccatgtccctgaatggttgtcaggagggcagtctgcccctcacgctacagatagctgtgtccttttctagagactgtagttgtgtgctctgctagcaagtgtcttcagcaccttgtgtctctttctaggtggtggcagaggagaggactgtgaggcagaggtggacgtgccaacattggcggtcctcccacagccgcctcctgcatcctcagccacgccggcgcttcatgtccagccactggccccagccgcagcacccagccttctccaggcctccacgcagcctgaggtgctgcttccaaagcctgcgcctgtgtactctgactcggtagggatcgtgcgtgttaaagcctcatgacgtctgtagcattctgtgtaagggtgctgtgttgcttggtctcgttagataggagcccgagtcgggagggggagggggagaggctggatctactcagtcagcctcaggtaccaacaggggcccatcttcatcatagtcagagctacacttgagtgcctccttccataccaagctgaaccctacatgtctgttctgctcatgtgcagcacccagcaaatggctgtccagggcctgtgggtcacgacactgctttgtacctgtcggcagagggaggctttggttttgagcagatcttgtttgttgcacaagtggggacttgattgtgtctcactggcctctcaggcagatgctggacactgtccctactggagggtcagagggtctagagggaaagttcataggtcacaggaattgaggatttaatgtgcacacaaaatgatggctaaaggtgctgttggggccacctacagggcagtcctcagcaggcttgcttgccctcacctctgtggaaggcatctttctgttgttcagagtcttcctgcagccctctacactaaggtccctgtgctttgctgggaacaccttcacaaatgtcactaagaagtcttcacgcaagatgtctctccttaggacctggtacaggtggtggacgagctcatccaggaggctctgcaagtggactgtgaggaagtcagctccgctggggcagcctacgtagccgcagctctggggtgagtggtgactagcgtgtcagcctttcttgcttggctgacaattgctttctgggcacagtcatgtccttcctaataaagctgttctctcttaccagcaagtccctgttccatgtgcttaagatccacggtgacaatttcagggactttgcacctctctgaggcctaaatgtttcttctggtctctagggaggtgcggtttctcctgtttctgacctttagttcttattagtatgtaatttccatttgtgattccttttttaaacggttcaagtcttaattatttgattgtttattttatgtgttgaagggtttagcttgcaggtatgtgtgtcctccatgtatacccagtacctgcagagggcagaggaaggcatcagctcccctggagctgaagttacagatggttgtgaggtgtcctgtgggtactgagaatcgaactcaggtcctcaggaatactcagtgctcctaactgctgagccgtctctccagtactgcccttttgttttagcttttgaactggacactgtagaccgtgctggcctccagctccctgagatcagcctgcttctgctccccctctgctggggctgaagctatacttcaccatgccagcctgtagccttgaactcctgactgccgcccctagcctcctgagcaccaggattgcaggcgtgcactgccagtctgtccgtccgtctgggagtggtggctctctgtctcccgttctttgtgacaggagtggcatctcattaaagcctgacttgtatgtccctcatggctggcggtgctgcttcttttctgtcctgtttgttcttctgttttcctggaactgtaagttaacttgttggcctctgcttgagctatttgtggtcgacttgtaggagcgtctttatattctggatgttaatctcttatcagacacagaagtgcatgtattttctctcattctctggatggtctttttcccctgtttcagcccccacctctcaagtacacctggcaggcagcgctgaggtgtgagcctttgggcctgttagacaagcactctacaaccgagccaccgccctggctctgaccccgcttctcttctcgcctcttgtaacgtctctaatgcatacaagagtcaaacctttttggagtctaatctttctaatgtttcttttgttacctgggcctttagggtcttacctagaaaattactgccaaatccaatgtcatgaaaatattcgtattttcttctacaagttttatagcttatgtttttttctttgctttgtctgtctgtttgtttgtgcatttgtttggacggtgtctcagtttggggccctggcttacctgaactcagtgtgtaaaccagactgtcccggggatgctcaaatgaccaacagggcctggagttgtagtgcaaactgtttctgtccttagtttaacgtactagggattctctcattcctgaatctaagcaatataccttgtgaaactagtttaccatttcatttacaaaaataagattatttatgataagagatatgataaactcacttatatattttttaacttagtttttaaacttgattactcttgaactcctttgtgaattatatcttttgagctatataattgcaaaagtcacagaatcatcatgtatatgtgtatgtgtgcatgtgtgtgtatatatgtgtgtgtgtgtgtatatatatatatatatatatgcgtatatattactatatatgtgtacagtattagtattaagacgattgcagctttgtgaggtagtaagtatagttgtatttctttactgtagatgcttttttagaagaactttattttgtttattattagttattactattgttcaggttacctgctagcacagcatggcagctttacggctgagccatcttgtccgcctgtgattggttttcatgtattgaggtctctgccttctagagacaagtctcccatggcaggagggaatggtggcttgctgttgtctgggtttgaatgccgcctgctttgttttgttaagcgtttccaatgctgctgtggaggatctgattactgctgcgaccacgggcattctgaggcacgttgccgctgaggaagtttccatggaaaggcagagactagaggaagagaagcaacgagctgaggaggaacggtgggtgtgtcttgctcctatagacgggcatggaggttagtttgccccagccctgacctctgacttctgatagcccttctgtcgtctgaccctgttggaccattcaccaccctaatgatttgactaagggaagggtgtgtgtgtgtgtgtgtgtgtgtgtgtgtgtgtgtgtgtatttgtatgtatgtatgtgtgtgtgtgtgtgtggtatgtggtgtatgtgtgtatctgtgcctgtgtgtgttgcagggtggatggcatattgatgtgtgtgcaggttcctctgggtgttaggtctctggagctgtagctacaggcaattatgagcagtgccatgtgggacctgaacctgcaaaaacactgcgttcttaaccactgaaccactgaactgaattctttaagtattatctttgtgcttttcttccgtttacccctaggttgaagcaagagagagaactgatgttaactcagctgagcgagggtctggccgcagagctgacagaactcacggtgacagagtgtgtgtgggaaacctgctctcaggagctacagtgagtgacatactgtgtcctgaatgtcaggaggaaggagggactgtggccaagctgttgtaatgatgtgtatgcatatcatggtctctctttctagccccggctgtcctgtagacaggctggtcttggcctcagacacagagagctccatctgcctagcttcccaagtactgcatcaaaagcttctagacagatgtagcatgctgttttctgatagggaggccctctgagtcagtgtccctatcaggaagcatgagatgtgtctgttggcagatttactagagaacctttgtatagtaggccatatgccattattcttcaactaagggagcctttctttcttttctttttttttcctttccctttccccatcttgctctggtccccgagagcagggatagggattgtttgtttgtttgtttgtttgtttctctctcattacggatggttgtgagccatcatgtggttgctgggatttgaactcttgacttccaggagagccctcagccctcttaaccactgagccatctcaccagccctaaggaagcctttctaaacttgtgtgtgaggcttccttggccttttcacttgagagctgttgaggaaggtctgccctgtgcttctgtcctgctgagagcattagctggacggagcacagtgcacggcacagcgcccaccgctcagaggcagtgtgtttgcagtccgtgttcttcctagtccgagacttgggagcctgtctctccagttgctataaggaagagatctcacaaaacgatgtcaaatgtccattctctgaggcaggatcatactttgtagcccagaatggcctagcacttactatgtagttcatgttggtcttgaacttgggttattctcctatgtgagccttccatgtactagattaatttagtatatcatttgttttgttttgttttgttttgttttgttttgttttctgagacaaggtctgactatgtagtcctggctggtcttgaactcactttgttacctgggtagtctcaaactcagagaaagccacttactgcctctgccttccaactgctgtaattggaggtgtgccactgtgtcaagctagtgagcttatttttatttttttaaaggagagggaagtttatgcctgtttcttttcaaatatttatgtgcatgagtacacagttgctgtcttcggacacaacaaaagagggcattggatcccattacagatggttgtgagccaccatatcgttgctgggacctgaactcagtaccttttggaagagcagtcagtgctcttaaccgctgagccatctctccagccctgtgaatttatttttagtcctaaataaaagcccagggcttgctaacgtgtgaggtaagtgcctgcggctctgggtgtctgagtctggctcggtctggagtgtctctggcactggcaaagatgggttattgggaaggggtctcctctgcttagggttacttctgctttaatggggtaggttgtttttttttttttttttttctgccttatttagtagaatccttttatttaaaagtttctttttttgggtgagagaaatacctcagtggttaagagtgcttgctaaacccagaggtcctgagtttaattcctagacctacgtcagttactcacagtcatgagtaaccccacctcccgggactctgctgtcctgatccagcctctgcaggctgccaaacacaggtggcatgccacaacactgtttctctttgtatctgggtacagcagtacttgcctgtcgtcccagtacttgtgaggctgagggaggagaacaggttttaggccacctcaggctacaaagcaaattctgtgtcagctggggttaactagtgagactctctttgaaaaagaggaaagtctgagatacaggtttacctgagggcaaccaccatctgaccagaggaagccattcctagtagccactagtatttatcatgtgtggaaggtacttctaattgtagataccacatattgctgataagactttgaagttgtctaagttgtcattaaaaataaaaattcagaatcacttgttgccgagcttaatgacctggagccagtctgcagaacccactcagtggagtaagagagcacttcctgcagcctccacgcacgtgtacccatggtgcactggggccctcacaccggacagagtaaagtttgtgtgtggcttcttgttatgttaggttcagctgctgtgctcaagtggtgctctcacctcaggctcctgggcgttagggttaggaagtttacgcaggccaccatagctttatgagttaaaactttatttctggattgttacagtggcctgtttggacttgatctggcacccccatgacatttttcgcttttcttcccaggtgatctgcttttaagtaaaaataaaagtcttgaactccctcttatagtggaaatgttatatttgttactgtatttccataggaagtcagactccagcttcttctagggtgggtgcagcagtcagaaccagggccttacacatgctaggcagatactgtcctaatttggttttcattgctgtgactaagactgtgactgaaagcagcttggacagggaagagtttattttttatttggcttacactgccacatcacagctcattatggaaggaagttgaaactgccttacggacttgcctattggcaattggatggaggcattttctcaattgaggtttctctttccgtataactctagctgtgccaagctgacattcccgacccagacgcacatttttaaagcaggcccgtaagtgtccatgccctttggtgtagctgcttctatggtaattgctctctattttaggagtgcagtagaaatagaccagaaggtccgtgtggcccgctgttgtgaagccgtctgtgcacacctggtggatttgtttcttgctgaggaaattttccagactgcaaaagagacactccaggaactccagtgtttctgcaagtatctacaacggttagtgctgtgttcctacagataacgtccacccacacaggagcttttatcgcgttcataatatgtgagctgtcaactccattagtcagacatgaaaggctcacagattgataggaatggagaactgaagtagagttagaatatcttgtatgtgaacagatatttatagagtacttgctttttattgtttgtttgtttattggctgtactggatacagggaaatgtctttgaatacattaaataattcgccatggcttcacgaatatgaatgaatctttcaaactggtattctcttacaaaaatctgatgttctctctaaaatcaaaaaatcaaaaccatgtatttttttagatttatttatttatttatttatttatttattttggttttttgagacagggtttctctgtatagccctggctgtcctagaactcactttgtaaaccaggctggcctcgaactcagaaatctgcctgcctctgcctcccgagtgctgggattaaaggcgtgtgccaccacgcccagctttagatttattttattatcttttttgtatatagtgctttgtcttcatgtacgtatgtatgtgaaccacacgcatgcctggagaccaaggatgtcagaagaggtgtcacatcctttggcactagagtcatagacagatgtgacctgccacagtgctaggaatcgaacctgggtcctctgcaagaacaacacgtactcttagccacagcactaactctccagctcctaatggcgatgctttttatgatggtgtttccccgtagtgactcattgtgaactacaaatgcatttactacccctgaccttcccagtaccatagctcagcaacagaacgcactcagcagtgtcgggtgactgccttccgggctgactgggcggtagctaggtgtagaggggtctctcatgatattgagagtattgtgtagcatatcacaagtctaggacaaactttcttgaatgtgggttctgtaactgactgtgagggttgcagagagatataataatgacaacagtaagaggctctgaacgtgcagtgaccaaggtcggttcacagtccaatgtgtaatgactgacacatcactgcagctggagacacagctgtggattctccgctgctgtgcccccatatgagtgaacattgtctgtgactcaagactggtctttcttgattttttttttaaagatttacttattattttatgtgtgccatgtgcatgcaatgcacagatagtgtagaaaaggtcagaggaaggctctcatctcctaaaacccaagtcacagactgtgggagctgccgtgtgggtgctgggaactaaaccctggtcctctggaagaacagccagtgctcttaactgctgagccatctctccagcccatgaaaaagctccagagacataatattttagtatcattatccctcagcagctatcaaattggtataattttgggttacattgtattagacaaaacaagcatatttgtgtccttagtatgcaaatttatattaatattcaatatatgataggattatatatatattccaaattgttgttttaagtaattctctttataatttattatcactaaatgtttgatttctatattttatatacctatataccaggggttttatacaaattttttgggtgaaaaaggaattgtaaattgaaaaagtttaagaaatcttaagctaggaaattaaattttaagtccatttttaaaaaatgaattcatatcactttggtgatgtcataaagttaaaaaaaaaagttcaggtattaagtttgagtttctctctccatagtagaaaatgatcagtttatgaagaaacatatacaaacagtatatatctaaactaaacagtgtagcccatttcaggttgggtaatggtgagcgtagtccaagcatggtgggggcacagagatgcctgtgtatcgctgtggcctctcagcagtaaggggcacccagtgtgtgctacttaggctcaccgctcatgttgtatgtgtgccaagggtgatccattttatactgaaatttaaagcaagtgataatggccttgatggtaacaacagtatcaaaaggaacacacccaggagaaaacttcctaggacagaccgccgtccttcagaagtagcagctgctggtacccttcaagaaactgtacccaataaaaggtgcaggcctgacctttgtagcatggtgtcaggttctcctgttactattataacagtgttgcagtatgctcttgggagtgtctgtgccttaagtgactgaccctctagtgactgtcacatggctctctgtggctgtggcagtgccttagcgacctctcttttattaacattttacatgtctgttcacacatgttgttgggacctacattcctggttgctggtctgagggatcactatactattaagtttgtgtccagattgcttttcagaggtaattcagtgtttgtacttacgtccagcagctcagagctcaccacttttgtttttcatcacacccacattttaattgagattaattttcattttaagcactcttgctgaagaaaaaaacttaagattgtcaaagccacacttttagactggagagatggcttagtggttaagaatatttgctgctcctgcagaagacctgtgttcggttcctagcacccgcttagtggctcacagaagttatgtacaaggtggacatacatgtacacaggcaaaacagtcacatacatgaaaataaaataaataaatctaaaaaaaatgataaacaaaaccaaatttccatatttatatactgaactatgtttttcgccagtggatgagccttaaacacatcatccaataaccgcatgctgttttgtcctctaggtggagggaggctgttgcagctcggaagaaattccggcgtcagatgcgggccttccctgcagcgccatgctgtgtggatgtgaatgaccggctgcaggcactagtgcccagcgcagagtgccccattactgaggagaacctggccaagggtcttttggacctgggccacgcaggcaaagtaggcgtctcctgtaccaggtcagtcccagtggcgtggcctcagggctccatgcccagctagttttagcttgagttagactgatgactttgcagctaaagatggatggagcctgaaagtgaggactgacacaggaatgcatcttgaaggctgtgtttcccacagttctgagcctgtgacttctctaccactaggaagggaggctctcgttctgcatgaccttgaaaggcttaggttctgtgggtagcctgccccagctctgcttccagacactgtcctactgtgctcctttcactgtgctccatccacctccatctcctctggcagagtcccttctttctgtgtcacccccatccaggccctcgttgctgttcctcctagtttccccattcaatgcagttcctgaggcccaaactgtccagtcatagcatctctggcttggtgtttctccgtaggcacagtgccagtgctgtcagtttgtttgtttgtttgtacagggggctttcacagctgtcctgcctcccagcgggcaggccttagggggcactatggaggtgtcgtaggcttaacctgatggggttatgtctcttcctctggtcatcacaggagattctcactgagcaattactcctaaggttttgtctggtcagttagatcaccaggtcatctttgtataactagagattatagtcaggcctatactctgaagtcagggattaggggccttactctgacccatgactgttgtgacacagtctggcttcctgaagtcatagttaactttggttttgtttgtttgtttgtttggttggttgttttattccgagacagggtttctccgtgtagccttggctgcctggctagccttcaactccgagatcacctgcctctgcctttcaagtgctgggaatcaaaggtgtgcgtcaccatgcctggtatgtaggcatgttctgtgagccacaccagccagcacagaggctcttctctcccatgagagcgtgctctaggatggcagggattttgtctgtttctcatagccagctcacagtgaatagtgcagcagatatttgatggggttgggtgacccgttattttatcagagtctattattctcccccaggaaacattgagcaattacttttcactcagaaatatcaataaatactatttattacttatttttaaatttttcatacagtatattttgattgtgttttttcctctcccctaacttctcctagattctttctctctcttaagaacaaaagataacaataacaaaacaaacccgtgaggtctgtttgtattggtcagctactgctgagcatgagacgtgaggtctgtagtccatttctggtactggggaagtaaatactactcgtttcttcccttttgtagtccttgtctttctttttttgttatttgtaggttgaggcggcttagaaacaagacagctcaccagataaaggtccagcacttccaccagcagctgctgaggtctgtccgtcattctcactgtttgagttgttcctgcttgggtactgcatattggctcatggtgatctgccccttccaggaatgctgcatgggcacctctggacctgccatccattgtgtctgagcacctccccatgaagcagaagcgaaggttttggaaactggtgctggtgttgcctgatgtggaagagcagactccagagagtcctggcaggtcagcagtttcctgtatggggagtgtggatactgatccggaggaggattgtgctattgagagtcgcaggcaggcaggcagaatgtttgtgggggtggacactaaaggtttgtgtctcagtgtactttgctcatatgtatttggatttttatcatttttccatgtactaggcattattccatgtaagtccaaaagctctaagattgaggattatttaaacctctgtatggtatggtgtcctgattagtatctacattatttaagattctgtatatttgtgcaccttgtgcttgcagtgcctaaggaggctagaagaaggcatcagattgtctggagctagagttagctgccatgtgtttgctgggagttaaacccaggatctttgtaagagcatccagtgctctttactgctgagccatcatctttctagccctgaggaatatttgtttgtttgttttgcatgtgccacagggtatgggggtcaaaggacagacttacagaaatctgctctcaaacttcctagtgctgtgactttagtacagctactcacactgtggtgaccttcaaccataaaactttcattgctacttcataactgtcattttgctgtggttaggaatcataaatatctgtgttttccaatggtcttaaggacccctgtgaaaggattgttcagtccccctaaaggggttgcagcccacaggttgagaacccccctgccttacaccatctgcattctaggggcagaactcagttggcaggtgtggccgcaagtgtcttttatctactgagctgtctcactggcccaggatcagaagtttgattctgtaaaatagttcggtggtggtggtggtggttgttttttgagacaaggtctcactcactatgtaccctgactggcctggaacttgctatgtagatcatgctggccccaaacacagagatccagctgcctctgcctcccaattgctggcattaaaggtgtgcgccaactcaccttactgaaatgggtatgtgtaactccagggatggtttctattgctcgggccctttcctcttcagctcacagttttcaatctcgttcgaatgagccaatttcacaactgtcctttgcacttacccaagtaaataacccagtagagggccaacctccattttaaaatgataacctgttttgtgagcttcacaattagatttggtgtctgggaccctgtatccatatggtatttctcttgttttcctgaggatttctgtaagtcattttaaaattagacattccctgaaatgttactttctttcatctacagaatactagaaaactggctaaaggtcaaattcacaggagatgacagcatggtgggtgacataggagataatgctggtgatatccagaccctctcagtctttaatacacttagtagtaaaggggatcaaacagtttctgtcaacgtgtgtataaaggtgagtgacagtcacttcatgtacatatctctaggtttcattttctctcctcagatgtctctgaaattataaattactatttattctcaaaggtggttttcaatgactctgagatgatcgaagtaaatgccattgtctgtttttctttacatcttgattaatataccacagccatctacttggtgtaaggttttagtacagattctgggagagcaatgtacttgccctctgtcgtggttacaaataataatatataatattatccagatataatccatttttttaagaggggaagcttactttcgctcatagtattgaaggtttcagtccatgactgatgcccttgttgcttttctgaggacgcacatagcagaagaaaagtgtacacttgacagccaggacacagctgaggaggttggcagcccacagtccttcaaagtcatgtccccagtgacctcatatctccacagatcccacctcttcagtatccctcccatctcccagtcatgccaagctggaggccaagcagtaaacacttggctcctcagggccagactacagcaagcactgagccttggctgccacattcctccttgagaatgtgatgcactctacaggattcctttctactttatcttttgcttgactcaagctgcagcctctacccaacagcagaccttaggcccctttttgttttattgcgagcactaatccctgttaatgtcattctcatagctctttgattttgtcaggtttcttagtccttatttcttttaaacacaatattcctactaattaaagttcccaacacggtgtatttcctttgctagggctctgcttagtaggcccttgggtttgaagtaaatttgtgcatatggtcttggaacaatggctagtacttgtgtgatgttggtgttggtgatagtaacaataccttttcttggtttagtcctttagatgattctgaggaaaggacatggaggggggaatttttctgattgctatcctcctgaaaatatatttaccttatattctctctctctctgctttttcttgttttggcttggtttggttctgtttggtttggtttggtttggtttggttgggcttctctgtgtagccctcactactcactgtcctggaacttgcaccgtagactaggctgcccttgaattcagagatccatctgagtgctgggactaatggcctgtgccgccgccatgcgtggcccagctttgtctttgaaggactgtccagggcacagtgaatagagctctgcaactgtccttgctgaggcagactgtctcctgtgttgtcctctggtacattcaccctgacatctttgattttgttgcaggtggctcatggcacccttagtgacagtgcccttgatgctgtggagacccagaaggacctgttgggaaccagtgggctcatgctgctgcttcccccgaaagtgaagagtgaggaggtggcagaggaggaactgtcctggctgtcggctttactgcagctcaagcagcttctgcaggccaagcccttccagcctgccctgccgctggtggtcctcgtgcccagctccagaggggactccgcggggagggcagtagaggacggtgtgtgaaggaagccccgttcctgatcccatacctttaagaagtgggtggggcatgagtgtgatggatggccagcagagcagtgtggggagctttggggttagtgccctatttgttctgtccacagcgcagggccacaactagcttgggatgtgtcgcatgtgcaaaatgagtattattacatgggtccttcctgtttctcttaaaggtctgatgttacaggatttggtttcagccaagctgatttccgattacattgttgttgagattcctgactctgttaatgatttacaaggcacagtgaaggtatggtttcaccttttaaaggtctgtcagggtacttgttggtttctctcctgagctacctatcttctcatctgtctggaatgtaatatatgtggttgtttggattttgagacactgtcatgtagggcaggctgatctcaagtttgctaggcagtcagggtaacctagaagtgatgcttcctcttcctcttctgtgagtataggcatgtaccgtcctgtccagcttatattagtgatctccattttaatcttatgttttacacacacacacacacacacacacactatttctaaagatacagcaggcaggaataaaaataaaatttaaaaaacacccatagtatggtttcagtaatatgttaaataagttttttggctttgctttgttttttttttctttctttttttttttgtttttttgttttttgttttttgttttttgttttttgttttgttttttcgagacagggtttctctgtgtagccctggctgtcctggaactcactcggtagaccaggctggcctcgaactcagaaatccacctgcctctgcctcctgagtgctgggattaaaggcgtgcaccaccacgcccagccttggttttgcttttatgaaattaaaatgaccatttatatattacatctgaatgtcagatttatctaattaattttttagaatgaatgcttttacaaaatataaagaagtgatattacctgagacttcctggaaaggttctgctaaaaatggtttaggaaaagaagtgtagggattgcatatggcctgaggatgtagctcaggggtacagtcccacttgacatataagaatgtcctaggttcaaaagatggcctagtcagctatcactggaaaaagaggcccattagacatgcaaactgtatatgccccagtacaggggaacagcagggccaaaaaaaatgggaatgagtgggtagggaagtgtggggggagggtatgggggatcctctgcgctggccaatcgatgctggcgtaatcctgcacatagagttcctaaagggcagggcagacctgagtgcctagcattagcagcagacacagaagctagactaaccctagccaggagtgctctcaagttgcctaggtcccacgccagtgcaaaccctgttcccaaagcccgtttcagggctatgtcccaagaacagtcactgcaggcacaggctagggctgcagcttctgaacgctccaggtcccactgcacaacggcagatgcccttcccacgannnnnnnnnnnnnnnnnnnnccattagacatgcaaactgtatatgccccagtacaggggaacagcagggccaaaaaaaatgggaatgagtgggtagggaagtgtggggggagggtatgggggacttttgggatagcattggaaatgtaattgagggaaatatataataaaaaaataatataataataaaagatataataaaattctcaataaaaggctttcttagttaaaaaaaaaaaaaaaaaaaaaaaaaaaaaaaaaaaagaatgtcctaggttttatctccagcactctatgaaaaccaaaccaaagctggacaggaagaggtaatggcagagcgtgaggaagctgcctggcgttcagtgacgaccctagttctaggaataagatggagtggctctgctcctgtgggtggtgaggaagccctcatgaggtccttggtccttccaggagggctctgcaggccccacttactaattagataagactcatggggccctctgtggtgcctctgggaggcacatccacaaggctctagaagcccagactcaggcacgcagaggccttgtgccctttcctgcagcggctgagattttgttgttggggcattttcctaaaacagccatgggcagagtgctaagcccctttcgaaaactactttttaaaacgagtgtgacttgtttgagcagatctctcccaattgtcttgaccctcaggtttctggagcagtccagtggctgatctcccgatgtcctcaagccctagacctttgctgccagacccttgttcagtatgttgaggatgggatcagccgcgagttcagccgtcggtttttccacgacaggagagagaggcgcctggctagcctgccctcccaggagcctagcaccattattgagttgttcaacagtgtgctgcagttcctggcctctgtggtatcctctgagcagctgtgtgacatctcctggcctgtcatggaatttgccgaagtgggaggcagccagctgcttcctcacctgcactggaactcaccagagcatctagcgtggctgaaacaagctgtgcttgggttccagcttccacagatggaccttccacccccagggggtatgtacccaccctgagggaggagtggagggctagcctcctcttcttgctacagagacactataccagcgggtggattccagggtgaagtctgcagtccacttcctctgtgtacctatctgcatcagcctttgggtttctgggttaggatgaaacaggattttatggagtgggagctgttgtccttttccccaggacagtcctgagactgccccacaggcgctgcttaccagaagagctaggccagctgaaaagcatgagacttctgtgcctgcctctgagctgctggccctgctgctatgacagcatttaagtgctagtgtaggtcactgttcatttaaagcctgactgtgcctgtgcctgggggatgaggcctctgggctgtttgatacagactccacagatagccaaggctgactcaaacctggtgctgcaggggctgctctttcctatgttaatggcactgggaaggagggagcctgcttaatattcagctaacaaagcttgtggacttacccactgtagccctctaccaagaaaacagcattaataatatttcgtgttcactgattcttggtcacacctgtaactctctctgcagccccctggctccctgtgtgttccatggtcattcagtacacctcccagattcccagctcaagccagacacagcctgtcctccagtcccaggtggagaacctgctgtgcagaacataccagaagtggaagaacaagagcctctctccaggccaggagttggggccttctgttgccgagatcccgtgggatgacatcatcaccttatgcatcaatcataagctgagggactggacaccccccaggctccctgtcacattaggtagtagtcattcagggtttggggactgaaagtcatgagactttcctaggctaattttacccaaaaaggggggggggagtgagattttagttagttagctagttagttagtttgtttattttaaatagggtcttattgtgtagctctggcaagccaaacaaacaaaaccatctccactcttgttttaaattagaccagaaaagtcttagaaacttttgaagcactaaggtttgactgggcatggtggtctatatctttaattccaacacgcaggaggatctcttgtgaatttgaggccagcctgatttacctagcaagttacaggatagccaggactatatagagagaccctgtttcaaaaacacaaacaaggccagatatgctgtgcatgcctttattccctgcactaaggatgcagaggcaaacagatctccaagtttgaggccagcatggtcagtctatagagcatgttccaggacagtcagggctacacagagaaaccctgtctccaaacaaacaaacaaaccaacaagaaaaggccctaggagagcacagacttccttccctggaacaggcctcctaggttagctcttagaggcacagctctgcgagctattcctgtcccttcacaatcttcaccaatgcatgtcccatccaagcacggaagttacattagcgaatatcaagtggtcatctgttgctccttatatatctgatttctaaaaatctgttcttgtactgttttctcagaggcgctgagtgaagatggtcaaatatgtgtgtattttttcaaaaaccttttaagaaaataccacgttcccttgtcatgggaacaggccagaatgcagacgcagcgggaactgcagctgagtcatggacggtgaggcctatgttgagtgtgttttctgtctctgttctggaccacagccccttccctgtcctagagcaactctggcaaccctgcagagtgcggggtgtccccaccgcgtagacacttgagagcagatgcaggcatctctctccatttatccgatgagctcaggccaaccctaattgcaggaggcagataaaaaagctggtatctcatctcataaacccagttcataaatacccaatgcagcacctgtgcacattccccagtagtcttccttccagaagaaacaggatcagcaagagaactctattaatataatttgctgttgcaatagaaaagccaggtggtcatttcaatacgtgttgaaataatttaaaatgtttatttatttcatatatatagttgttttgcctacatatatgtcagtgccccacttgtgggccaccgttgtattccctagacctggagttactgacagttgtgagccaacgtgcaggcaccggggagagggttctctggaaggccagcagccagtgccatcaacagctgactcagctctacagccccaaaatgaactttttaaagcttaagtcagggtcagatggatggatcaacatgttgggataaaggatggctcagcgggtgggagtacttactgttctggcctggcaacctgagtttgatccctgggatccactgagttggaaggaactgactccacagaactgctctctgacctctacatgtgcacttcccacggccctgagctactgtcttagtttcgtttctaagttttgctgtattggtaaaatactctgacaaaaagaaacccagtggaaagggtttgagtttctcactgggaaaatcagagcaggaacctgaagcagttagttgcagtccagagcgaataaagaatgtgcgcaggcttgctcacctcagtagagaatggcggccacatagggtggtttgagtcttcccacgactactgatgtcattaagacagtcctccacaggcatgtctgcagaccaagttcatctgacagtccctcaatgtgccttccttcccagagaattctgcatgctttcagactgaccactaaaactagccaccacagctacctatcataaatctattaaaacaaaaatgcaaaacacaccccagtaaaataaaagcaacaacaacaacaaagcatcatgctcttccataaagcattaggcttgaaggccagcaccagtctgtgctgcccgggttgtcactgatgttgcctgatggccactgatacggggcagataggcataaatatcaaaaatgagaatttccacacggtatagtgccagctcagaagaatcagcattgtagccctggttacggtccagggttcagcaagctaactatcagaagttcccacagccttgaaatatagaatcagtggataagaacactcgctcttttagaggacccaggtttgattcccagcacccatgtggtggctcacaaccactcatgactccagttccaaggatctggcaatcacttctgaactctttgggcacaaggcacacatgtaatacacatacacatatacaggccaaacactaacatgtaaaataaatctttaaaacaacaacaataaagatgtacttagtatatagagcttaagagatggctcaggagttaagaacatttgttgttcttccatttttagggatttgatgccctcttctggcttccatgtgctcgtgtattcttgtgctacacataagttcatcacaggcaaacattgtatgcataaaataaatcttaacatacacacatgagagacagagacagactgggataagaaacaaaggcctgatttaaagcagctctagtggaacgtttggaagcaatagctgtctttgtgtctgtctgtctgtctccctttttccctccctccccccaaccccctcttcctttctccctccctctcttttatgttatgtatccctggctggcctggaactcactatgtaggtcaggttgtctttgaactcacagaagtctgtctgtctctgcctctgcttccagaatgttgggattaaaggcacatgccagcaagcctgaccaacagtgtctcttgttttgtttgtttgttttttttttgttttgtttttggtttttcgagacagagtttctctgtatagacctggctgtcctggaactcactttgtagaccaggctggcctcgaactcagaaatccacctgcctctgcctctggagtgctgggattaaaggcgtgcgccatcacgcccggctatttttctgtttgttttgttttgttttgccaacagtgtctcttgatgtgtgtgtgtgagtcactatatagcacatagtatgagagctgccctctcttgttgccatagtctctgacttgagggaaatcgaggcaggcccagggcctgacatgggtataatccacccactagagcacttggatcttgaggcttttgttcatagagtgaagacgtgtccagctgtgtctatgtgctgtgcacaatgttgtcatcttctctcccatctttcttgactgtaagaactttcacccttgtgcttccagttcggggatgaggtccatccatcctcctacaagcacttttcctactccattgcttcatgtacaccagaaagggaagaaaaaggaagagagtggccgagaggggagcctcagtacagaggacctgctgcggggggcttctgcagaagagctcctggcacagagtctgtccagcagtctgctggaagagaaggaagagaacaagaggttggtctgtctgtccccttcctgggtactcatgcattctttctacttcctgcaagaggaaagtcaggacagccaaggctaggaaggggcggctgggctggcaagggttatagtgatgagactttatttaaaaagaaaatgaggaagaagagagaaaagaaaagaaaggaagtgagacatttataaagtgtaagtgtgggctggagtgcttgctcattttccagaggacctcactttggtacccacatccatagcaggtggctcctaaacacctctaactctagctccacggatctgacccctctggcctctgtgagcacttgtgcacctacacagatgttcacacacacacacacctacacataactaaaaataactttttaaaagtagaagcccttaagagacagattgtgctctagaaagaatattctaagttttttcatttgaaattggcttcattgcttattttaagtcttctagaggagggaatatgtgtagctaagtctacatagcttggtctgccatggctgaccactgcttcttggcccttgggaagcccaaggcttcagtgggtcatttcttactaggtgggtaggagctagtgcagaccttcctctgcttagctgactccctttcctttgtacctccctcttctggccattcacactgagaaatagaacggggaagacagaacttggtcaaggttgtcttcccaccatgctggtgtgtctctcctgatgctagagaggagcattgcattgtgtgcttgaggtcagctctccccctggggtgcagtgtcacctccagcctacacacagtgctccacccttagggctcacctgagaccttgcttcttcctccattaggacatggaggtcagcacacaaaccgcagccatactgacacatgctcctgacgcagctcctttgtctccagttgccactctggccctctgcatcctgcatgcttgagtctgctcacgagttcttgtccctgtcagtgaccaacaacttcttaaccttgttctgagtccctgaaaggatttaataaatccaagagcaccacagagcgttctctgacgtcatgtgggcatccacatctgttcacggatactcaggacgaggagttaacagcacgggagcgagtgccgcttaagctctgtcttcctcactttccgatctcatactgtctcaggtttgaagatcaacttcagcagtggttatcgcaagactcacaggcattcacagagtcaactcggcttcctctctacctccctcagacgctagtgtcctttcctgattctatcaaaactcagaccatggtgaaaacatctacaagtcctcaggtgagaacgagtacccttgccatttccagaattaaagacggggaatacgcctgcctcagtggaccacacctttaatcccagcactccatgagtgtgaggcagcctagtctacaggctacacaggaaccctgtcctgaaaaatgaaggaggggaaaaaaaagaaagaaaaaagaaaaaacaaactaaaaaccaattttaaataccttaaaagttctgtctctttagaatatccaaaagttcactctttctctggccttatcttctttctgccctttccctccccccttctcttctcccttccccctctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctaaaatttcaatgtctttttgaagttaaaatctctgaactatggctacttgtaaaataaataagttacctaggttcttgttctaagaaggggaataagggcacagtcacggtcaacttgcgagcacccagagtccagcagtgtaaagccaggtgtcacactactactgtctgacactcactctccctcttctgggctccttcaaaatgcctggtggctgtctgcagcacatgcagcttgtcctctaggctcaggctggctacatgccacagctgctgcgacccctggtggtcaggtcaccatggtactgccatacccaatgcttgagtccccattgcagctgagctgctcctgggacaataacatctctcgggctttcttcagggactctccacccctgccacatgataccaagcattatattgccatgacgccttcaatcctgagccttctactgcagggggagcatccgtggcctggcctggcctctcatggtgccaaagcctcagctgttcttcacaacccctatatgccttcaaaaccagtatagggagagccttccactaccaagttcagatgccaacatgaggtgcagcctcagctccctctgggccatgagcttctgtgtgctcatcctgaataaacacttgagaataatttacctcagtgctgctggtctcctaatctgggctgattctgcagctcccagctgaccagtatcacttgtctcagccttagagtacttgagggactcaagacttctctctcaaacatcacaagccaggccaccaccatctgcactactctttttttttttttttttttttttttggtttttcgagatagggtttctctgtatagaccaggctgggctggccttgaactcagaaatccgcctgcctctgcctcccgagtgctgggattaaaggcgtgtgccaccatgcctggtttgcactactactttcaccatttgctgcattcccacaattcattaaactctgaacactcgagtgcttttctagtctgaagttccagaggccatgcacaatcctccaaaatacatgctcaggtctgtcacagtaatgccccaaggcctggtaactaatttcttaattagagcttctattcctgtcataaaacaccatgactataagcaacgtaaagggtttatagtccatccaaagaagttaggacaggaactcaaacaaggcaggaacctggaggcagggactgaggcagaagccatggagggtcctgcttactggcttgtttccatggcttgctcagcttgctttcttatagaacccaggacaactggtctaggggtggccccacccacaataaggccctcccacattaatcagaatgtgccacaggtttacccacaggccagtcttatgggggcattttctttattgagattttcttttccataataatacctagcttgaaactaaccagcactgctaggcagtgggggcacacacctttaattccagcacttggaaggcacaggcagttgaatttggggctagtcttgtcaacaaaccaagttcaaggacagccagggctacacaaagaaactttgtctcagaaaatagaatgaaacaaaaacaaaccagcacacacaggaacagtagctcttgtctgtggggccacataactatctgaaccttgaccagactcagttctgggattaactttccctaaggaaattaataagggaagaaggtgagctcacagaagtaaatttcacattaggatagtgttttcaaagccagatcgtccaggccccagagcctctctatgtttttcttggcggataaggaagcagaaagagtttatctgaaggatcatgccgtggggcaggggcgaaaggtgtttccagaatgccttaggaagcctcacagaaggaaggcagagtacgatagcatactgtttccattgatgagtttgcttaatcctttaaaatactcttctctctgacttactgtgaggcatggtggtgtacactcgtaagcccagcacttggagatggatggaagcaggaagatcaggagttcaaggccagcctctactatgtagcaagtttgaggctatcccaaactatattccaccctttttcaaccccactctacctgctccccaaatttatattctgactaattctctctaaagacattgccagatagttaacaaagtttaatgtacaaaagtcttcacaatggaattgattatatgtcttatcaataaatgacccaaggcgggaacttggttaagctccgtagaatactggctatttgtgtgtagcagattaggcaggcaagatggaggagcgctaccaggcgagggttctgttgagcccaagaggctctgtgatgcgggcgtgagcatggatgtgatgtgacgccgccacacatgactactttttgctgcttttttactcaattagaattcaggaacaggaaagcagttgaggttctcagaggcatccggttcatccctgacggaaaagctgaagctcctggaaaggctgatccagagctcaagggcggaagaagcagcctccgagctgcacctctctgcactgctggagatggtggacatgtagctgtctgacgggagacggatctctaattcataatgctttgtctgtattcaattgtgttatagatgctgttggaaatgtgactattaattatgcaaataaactttttgaatcattccagagccgccttagttttatgaatgaaggctatgtgatgtctttagtaggtttggtttttttttgttttttggtttttggtttttggggtttttttttggtgatcttagacttttttctctcacacacaccggaaaatactcagagggagtttttgtgactttctggttttcagtacacacttattttgagactttcatgcgtgagtgtactgtaattagatcatttctacccctccccctccacactctgggattcatgacctagtcttctataattgttacatatacatacgtctactgagtctatttaatgttgcttgaatgtatatgtgcttagggatgaccatatgggattggagaacctatcagagatctacctggaaaaaaccgattctccctcccttggtaatccattgactgcttattctgtttataatagataattctcttagtaaagtcattgcccctgatatcttagctatcagaaatgcagggacaagtaagacacagggtcctcactgcaaggtcaaccctgcttatcaggagagccaacagacagacagacagacagacagacagacagacagacagacaaaaatacatatataagtcgtagtagtatacatagaatgtagtacatacatagaatgtagtagtgtccatgagagggcatgatgaactccttgaggcaccagttggttgtgaggccaaatggatggaacaggccagcaggctctcactacactcagagggccatggggatcagttgtggaaaaacattagaaagaagtgacctgatcctattttctcttaaaaaataacatgtggaagaggttggcgagatggcttgtcacattacacttgttcttggtgaagaacccgtggttcccagaagacctgacaccctcttatgacctctgtggcaccacacctgtctgtgcactacaggaatgcagaacacccatacacataaatatatcaaatggcattttgcaaggaatggaagatgtactaataaaattagcgatggtcatttctcttatattgtgcactaagcatttccagactatcatcctatagcccccagagtctattcaagaggagtatgcagtatctctggtccttccttgttcagttcactgtgtaaaaagccctggaagaaatctgctctggccatcctcaaaactaccagtaaggctccctccctaccccccgccccgtgaccctccaaatattacatcttttagactttacaatttttttgtcctatgtatattaatgataactttacattctgtatgtgtatgggcaagtgtgtgccagtgcacatgtgaaggtcaagctgtcctctgacttccatgcatatgaggcagcacatcacaggaactttcaggagtcagttctctccttccgccatatgcaactgggaatgaactcaggtcattgggcttggaggcaagcagccttaacccctgagccaccttgctggcacaaatctctgtgtgtgtgtgtgtattgtgcgttcttgcatccatgaagggcttagagaacaacttttagacttctccccttccgtcctcattgaggcagggtctctcatttatgtgctgtacagtatatctcaggctagctgacccttgcgcttccagccaattctttttttttttaaattcattttatatgtcttgagtgtttcacctgcatgcacacttgtgtaccatgtgcatacctagtacccatagaggcagaagagggtgtcagattccctgaaactggagttatatagagttgtaagccaaccacctgggtattgaggctcaaacccaggtcctccagaagagcagctagtgtttgtaaccaccaagccaggtctccagtccttccagccaattcttgtctctatctccattttcatattaggagtgccaggctcacaggatacacaccactgcttcctgtgtgtttgcaggatcacacacaggttattagttgtgtagcatgtacttttatctgagccatctccccaagcttttcccctcttcagtggctcactgtttatcaagaaagacttgatgttattttaagcatttctttattgcgtgtgttacttttctgttgctgtaataaggcaccatagtacatacatttattggggttgtttagagggtatttaggatgtttaggggtatagcaggcagtaggaaggcaggcatggtgctggagcagtagctaagggttttcatcttgatccacaagcagggaacagagctaactggaagtagcctaggcttttgaaaactcacccccctcaccccagtgacacacctcctccagcaaggccacacctcctaatccttcctaaacagttctaccaacaggggctccagtactcatgtgcagaagtcaagggaaactacaattttgtcctaccatgtaggttctgaattagcctacagcttttatggttgggggcaagcagttctgtctgctttgtcatcctgtaggctccttcatgttactccttaaccttgctttaattgtgacattcttttcctgcctccagcctcccagcccagagagggtagtggtggagtcacggagtaggactctggtgatggctttaaagtctgaggtctttctagctctctatctgtactgaaatgctgacaataacttctaaaaggtcctagaaactttcttgctttctgagggtaaagacttaggcgattaacacctgtagcctaacagtggaggattaagcaatgcggcctttgttctgtctcagcaggaactgctgggctctaattttcagcctgctagtcagaagtcaggaagaaggctgttagtcagaaggcaggaagaaaaggggacacttagaaaagtgattatagtacttattactaagttgtaaaaagtttcctatgaaagctatctaaggggaaaagcagaaagatcctagtctgggaaagggaaaaattcttctaagtgaggaaaggcaaaaaattctctcttgattctcttcatctctttgtcctcggtacttatacacctttcagaatacatgatcacatgtcacaaagttcatcacaaggtcacatacaaaatcaaatcataaattgaaatagaagttgacaacagtgaatgtgtacatgcatatccattaggagtaattatctggctaagcatccatcacctgtctcagctccacaggttcactggaggtttaaaaccataactaaattattagtgaagttttgtctagataagcccagtcaatattttatcttctgtcctagcacctataataaatcattagttccatttttttaattaggtattttcctcgtttacattttcaatgctatcccaaaggtcccccatacccacccccccaatcccctacccacccactcnnnnnnnnnnnnnnnnnnnngaaggtgcacagttatctggtgtttggacctcctcctggctgaagatgaaggcccaaaacaggatctttcccagaagctgtgttgctttggccaggaaggtggccagttgtctggagccgaagatggcgccacctcagaagctctgtggctctcgcctgtcccagaaactgctggcctctgtattccacaccctcacccgtgcagcctgccctcctcggagtcccggaaccaaggtggctcccgccggggcctgaggcagaaacctctcgggccgggcggacccctgtgttctcaccaggaaggtggccggttgtctattagttccatttttatggcctttggtgaattgttttataacctcttggaatgtgctctgagtaggagaaagtctggtaaccatctgagagcaattaactggtgacacttgagagactgagttctcactgcagttttgactatcagaaaaggacctgatagcagtcccgctatgaaagagcttaataatcacatataattttaggaattctttctttttttttttccgagacagggtttctctgtatagccccggatgtcctggtactcactttgtagaccaggctggcctcgaactcagaaattctcctgcctctgcctcccaagtgctgggattaagggtgtgtgccaccactcccggccaattttaggcattcttataagatcatcattaggacttaagtcatctatttgtttatatagcatcactacaagacagtggggtctgcagagtatctgctccaaaggggtgtgctactacttagtgattgttatatatgtttaataataacaggaaaagcatattaatagcaggaatctttcctaaaatgaatcccttatagccttgtttaataagggtgtacctgtcacagattatataataatccgaagcaggccatttcaggatgatcacctgctagttattagcttgtcccattatggctcctaacattttcctacaataaaagtactatctgccctacaatgtatatcacacatacatatatgcctatattttctctactacgtgtctttttcatcagttcaatgttggctgaattcgaagttcaggctgactttgtttcctcatagcagctgaatctgttactgagtcatgactttatttcactctggtgcaattttggctctccctgccttgttttattctatgttcttgccactacttcactcaaaactctcagtacatccaacacagccttgtttgtaaggtagagttctagttccgttttctcatgacaaccctttgggaaccatatctctctgtaacggcttttgcatccagaatgtctttatttctccttatatttgattcaatatttcagtgagagtaacattttagattggcaattattaccttttagtcttctttctttctttctttctttttttttttttttttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaatttgaaatgtaaataaagaaaatatctaataaaaatatttaaagttattttttttttattcctgtgtgtgtgtgatgtgtgatgtgtgtgtgatgtgtggggcatgcatgccactgagtgtatatggagatcagaggacaactttgtgtagtcaattcttctacccaggcttgtacaacaagtgcctttacccatacccactaagccgtcttgcaggccctttcttcaaatttttaagattgtttctgggggtggtgtgtggacttctagaaattggggcacaaagtgaggatgagtatgatcaaaacacatcatatacatttgtgaagttaaaatttaaaatactgtattacatcacttctgtccatggtattctcaaatgtctcaactctctgccctcgattaggttttttccctaacttatattactattaaacaaacttattctaaacataatagctttaaaatgaggagtcccctgggcagctttttcttggcacttgtcttgtagtttagtgaggtaatgccgagacacagacgtctgatggttctgttgggcttcatgtccatgggtgggcagagggaggggttcttgctgggtttccctctactgcttgctcatgcatgctgacaatggagctctgaatcagggagcaaagtctacccactgaggatttctctagtttttctactagtccccaatgcctggaggtcttttcttctttttgtgtgtgcatgtgttcatgtgagtatgtgcatatgtgtacgcgtgcatccttacatgtatgagggtcagatgtggaccaggaagtcttccttgtttgcttgtttgtttttggagaccgggtttctcactgaccctgagctcaccatctcctttaggctggctggctaacgacttgttctgcttctgctcctccagcactgggtctgtagagatgtgctactcggtttggtttacatgtggatgacagggatccaaactctagcccttgagcttgtgagccaggcacagaactgagctatctcatcaaagcactccctgccctccctctctctcctccctcccacctctgtctttccctctggtgatcatgctatgtaactcgggctggccagaatcacaattctcctgcctctgaagtgttgaaattatacccacgtgccaccatgcccaatgcactacagaccagttgccttagagaaatcttgactcctgtctcaggctagctgttggaatgtgagagggaggactggattcccctacgagtgcaaattttcaatttctctggttttgatgatatccagctatgcctcatctgccttttactcagctgctcaaggcttccacccagtcagaacactaaaactatgataatggggggctggagagatggcttagcggttaagagcactgactgctcttccagaggtcctgagtttaattcccagcaaccacatggtggctcacaaccatctgcaatgtgatctgatgccctcttctggtgtgtctgaagacagttacagtgtactcatacataaaataaataaataaatttaaaaaaaccctatgataatgttccttcaaggttttcactgctccctccagactctgttaattcaagggttcgttccctggcgagaactgtcatttcttgctggctttatctacacatagaggttttcattttctctgctttgccgaatcagtcattcctccatctacttctagtctttataattttctttaaaatattttctaaaatccagagcttcaaacatgcatatagtgtgttttgattgagtccacccctcattccctcccttctggatcctcccctctcccccgttccttttcacttctgtcctgggtttttaatgtctttgtctttggactgggacatgggcaggaaacagaaatcaacatctatgtccagcctggtgtttttaaatagaaatatctttcttttcctgtcatctctgactcctaaggcagctcctaggtcagtaactaatcatttccccacgtccaatcagcaagtaccatcaaccccattttatagtctccccagagtcagtaactaatcacttcccccacatctaatcagcgattgccatcaactccatcttgtactcccttcagggcttcacttgctttctttgaccctagtcccttagttttcctcctcgatggaccaggaaagtcgagcttctctgttcagtttctagttgatcttatcgaatctcatgatttcaaatgccacccgatgactctcagatttctttatctagccttgttctcttttctgaataccagtctacttaaaactacttaaactcggatgcctaatatttgtcaaaatgaattctccgtgaaatttccaagctcctctgacctttcctaacttctacatacagataaggcttttccccttggcctgtcttgaaacccttaggctccagggtctttgtcagccaaggctttcccaatcttcatatagctaagaacattgccttccttgtcaatggaagctcactctacacccagttgtccaggtcccaaaccctagagtcttctgtatttagtttatagaataagctcaatatggtacaagccaagcagtgacaaacatttcttacaactgtctctagaaatccatctatgtgaattggcaggaggatttcacacttttcttccttagatattagaaagcatattactttattcataggatgtctagtccaggaaaatatcaacctaacttcttttgcagctgatatctctgccatctgtctagctttgccattcaagtctggggttccgtacggaccagaattctttttttccaatttttcatgttctgacacaaaaaggacttccctggaaaacactctagcttttttctccagggaaagagagtggcttgtttagtgaatttgggagaacagcatccagtgtgctaggcttccctgggcatcgttttttgggtcttcttattggcatactgtgcttacatggttcttggtgggtcagctcccaaaggcttcagttgttcgcttggcttagaagctgagacatgtgtaagggaaaagcagtcattatgaagcagttagccagccctgttcaaactgacttttttttttttttttttggcttttttgtttttgtttttgtttttcgagacagggtttctctgtatagccctggctgtcctggaactcacttttgtagaccaggctggccttgaactcagaaatctgcctgcctctgcctctggagtgctgggattaaaggcgtgtgccaccacgcccagctcaaactgacttttctattgtgaattttaaaaacttaatgtgtacgggtgttttaaccagcatgtatgtacttacatctcacacatgcctggtgactgaggaggtcagaaaatggcattagattccttaaaactgaagttatagatggctgtgagtcaccatgtgggtgctataaaccaattccaggtcctctgaatgagcagcaagtgctcttacgcactggacttaagtattggcctccagtccccaaatcaatagtctgaggcaaggctcagttaaaatgccttgtcttatatctttacaagtttctaaactgggcaaagaagaggttagtgttcttgactagccatctaaaattccgattttccatctagggaaggtgtgtgagtgttctttgcctcttacttcttccttctctgatttgtggttcatggccccttccttggcagcgttttgagggctaggtgcagggaggctatcgggtttgggtagttgtaagtaagtcggcactctgtaggacacactgtaccgctgggagttcttggaattatatttttctgatctctggtcgtcattcctgcatgccagcaatgcttctcaaatactatctgttcaaatgttcttcattgcacgtctctactagattctgccggcataccacaggctttcctgcttccctctctactgtcaaacataatcaaggcttttccccctttaacttgtaggactccaagctccaggtatcctgagagtagtgctgtggctagggaagtggaactctacctgctaatgggagtcaggacacagccctctgcacactctgcagctgctccctgtgaggagcctgtgcccgctttctgagaacactactctgaccctcttcccaactacgtgtcatcatagtttcctcctcccttcactcgggtcaaggcccctgccccatgatggtccatgtggtgcctcggatcaacgctagtttcacctcaggtcactcatgcctcttccgtacttctgaagcactcgtggtttccgcggcctctttcctgcatgtcggaggggccatttttcaccaaccctgtaggtatcccggctcagaacacccagaccagaagtccaaggctgtcatcaataaggatctagaggggccggccccgccccccatcccgccccgcccctccaacgggcctgcccctcccacaggccgtcctcgcccacaggccggcctctttcataggccccgcctccaaagcgcttcccgccccgcagccacgccccctggtgccctcgcggcgtcgggcggccctgcgcccagccactgtggtcgcggtgcgtctctcgtgcccacctggtgatgctctgattggccgagctcgcatcggcccacccag

SEQ ID NO: 1422 - DNA, 6429 bp, Mus musculus
gttgcggtgcggtgggcccggtagaggctgcacgcagactgtgggcgagcacaagcgctggcgacagtggccgtatctggcggacttgctcctccctccgcggcctccgctgtcccttgtgtctttgccgagttgctgaaggccttcactagtcttcgctcgaaggcgtctgttaacctagcggccggcttccggagtgttaagcatcggggataaaaagctattatttctagaccagggcatcgcaagttcgagttaccgggagaaaaatgagatggtcatcctgaggatgaaggagagcttcccctggcaacagataatttaaagaggagagctacttgtgtatagtccatatttattgccttcagataattggcttgaagatgcacccggtgaaccccttcggaggcagcagcccaagtgcttttgcggtatcttccagcaccacgggaacatatcagactaaatcaccatttcgatttggccagccttccctttttggacagaacagcacacccagcaagagcctggcgttttcacaagtaccaagctttgcaacaccctctggaggaagccattcttcctccttgccagcatttggactcacccaaacctcaagtgtgggactcttctctagtctcgaatccacaccttctttcgcagctacttcgagttcctctgtgcccggcaatacggcattcagctttaagtcaacctctagcgttggggttttcccaagtggcgctacttttgggccagaaaccggagaagtagcaggttctggctttcggaagacggaattcaagtttaaacctctggaaaatgcagtcttcaaaccgataccggggcctgagtcagagccagaaaaaacccagagccagatttcttctggattttttacattttcccatcccgttggtagcgggtctggaggcctgacccctttttctttcccacaggtgacaaatagttcggtgactagctcaagttttatcttttcgaaaccagttactagtaatactcctgcctttgcctctcctttgtctaaccaaaatgtagaagaagagaagagggtttctacgtcagcgtttggaagctcaaacagtagcttcagtactttccccacagcgtcaccaggatctttgggggagcccttcccagctaacaaaccaagcctccgccaaggatgtgaggaagccatctcccaggtggagccacttcccaccctcatgaagggattaaagaggaaagaggaccaggatcgctccccgaggagacattgccacgaggcagcagaagaccctgatcccctgtccaggggcgaccatcccccagataaacggccagtccgcctcaacagaccccggggaggtactttgtttggccggacaatacaggaggtcttcaaaagcaataaagaggcaggccgcctgggcagcaaggaatccaaggagagtggctttgcggaacctggggaaagtgaccacgcggccgtcccaggagggagtcagtccaccatggtaccttcccgccttccagctgtgactaaagaggaagaagaaagtagagatgagaaagaagattctctcaggggaaagtctgtgcgccagagtaagcgaagggaagagtggatctacagcctcgggggcgtgtcttctttagagctcacagccatccagtgcaagaacatccccgactacctcaacgacagagccatcctggagaaacacttcagcaaaatcgctaaagtccagcgggtcttcaccagacgcagcaagaagctcgccgtgattcattttttcgaccacgcatcggcagccctggctaggaagaaggggaaaggtctgcataaggacgtggttatcttttggcacaagaagaaaataagtcccagcaagaaactctttcccctgaaggagaagcttggtgagagtgaagccagccagggcatcgaggactccccctttcagcactcgcctctcagcaagcccatcgtgaggcctgcagccggcagcctcctcagcaaaagctctccagtgaagaagccgagtcttctgaagatgcaccagtttgaggcggatccttttgactctggatctgagggctccgagggccttggttcttgcgtgtcatctcttagcaccctgatagggactgtggcagacacatctgaggagaagtaccgccttctggaccagagagaccgcatcatgcggcaagctcgagtgaagaggacggacctggacaaagccagggcatttgttgggacttgccctgacatgtgtcccgagaaggagcggtacttgagggagacccggagccagctgagcgtgtttgaagttgtcccagggactgaccaggtggaccatgcagcagccgtgaaggagtacagccggtcctctgcagatcaggaggagcccctgccacatgagctgagaccctcagcagttctcagcaggaccatggactacctggtgacccagatcatggaccaaaaggaaggcagccttcgggattggtatgacttcgtgtggaaccgcacccggggtatacggaaggacataacacagcagcacctctgtgatcccctgacggtgtctctgatcgagaagtgtacccgatttcacattcactgtgcccactttatgtgtgaggagcctatgtcttcctttgatgccaagatcaacaatgagaacatgaccaagtgtctacagagtctgaaggagatgtaccaggacctgaggaacaagggtgttttttgtgccagtgaagcagagtttcagggctacaatgtcctgcttaatctcaacaaaggagacattttgagagaagtgcagcagttccaccctgacgttaggaactccccagaggtgaacttcgctgtccaggcttttgctgcattgaacagcaataattttgtgagatttttcaaactggttcagtcagcttcttacctgaatgcgtgcctgttacactgttactttaatcagatccgcaaggatgccctccgggcactcaatgttgcttatactgtaagcacacagcgctctaccgtcttccccctggatggtgtcgtccgcatgctgctgttcagagatagtgaagaggcgacaaacttcctcaattaccatggcctcactgtagctgatggctgtgttgagctgaatcggtcggcattcttggaaccggagggattatgcaaggccaggaagtcagtgtttattggccggaagctgacggtgtcagttggggaagttgtgaatggagggccgttgccccctgttcctcgccatacacctgtgtgcagcttcaactcccagaataagtacgttggagagagcctggctacggagctgcccatcagcactcagagagctggtggagacccagcaggtggtggcagaggagaggactgtgaggcagaggtggacttgccaacattggcggtcctcccacagccgcctcctgcatcctcagccacgccggcgcttcatgtccagccactggccccagccgcagcacccagccttctccaggcctccacgcagcctgaggtgctgcttccaaagcctgcgcctgtgtactctgactcggacctggtacaggtggtggacgagctcatccaggaggctctgcaagtggactgtgaggaagtcagctccgctggggcagcctacgtagccgcagctctgggcgtttccaatgctgctgtggaggatctgattactgctgcgaccacgggcattctgaggcacgttgccgctgaggaagtttccatggaaaggcagagactagaggaagagaagcaacgagctgaggaggaacggttgaagcaagagagagaactgatgttaactcagctgagcgagggtctggccgcagagctgacagaactcacggtgacagagtgtgtgtgggaaacctgctctcaggagctacagagtgcagtaaaaatagaccagaaggtccgtgtggcccgctgttgtgaagccgtctgtgcacacctggtggatttgtttcttgctgaggaaattttccagactgcaaaagagacactccaggaactccagtgtttctgcaagtatctacaacggtggagggaggctgttgcagctcggaagaaattccggcgtcagatgcgggccttccctgcagcgccatgctgtgtggatgtgaatgaccggctgcaggcactagtgcccagcgcagagtgccccattactgaggagaacctggccaagggtcttttggacctgggccacgcaggcaaagtaggcgtctcctgtaccaggttgaggcggcttagaaacaagacagctcaccagataaaggtccagcacttccaccagcagctgctgaggaatgctgcatgggcacctctggacctgccatccattgtgtctgagcacctccccatgaagcagaagcgaaggttttggaaactggtgctggtgttgcctgatgtggaagagcagactccagagagtcctggcagaatactagaaaactggctaaaggtcaaattcacaggagatgacagcatggtgggtgacataggagataatgctggtgatatccagaccctctcagtctttaatacacttagtagtaaaggggatcaaacagtttctgtcaacgtgtgtataaaggtggctcatggcacccttagtgacagtgcccttgatgctgtggagacccagaaggacctgttgggaaccagtgggctcatgctgctgcttcccccgaaagtgaagagtgaggaggtggcagaggaggaactgtcctggctgtcggctttactgcagctcaagcagcttctgcaggccaagcccttccagcctgccctgccgctggtggtcctcgtgcccagctccagaggggactccgcggggagggcagtagaggacggtctgatgttacaggatttggtttcagccaagctgatttccgattacattgttgttgagattcctgactctgttaatgatttacaaggcacagtgaaggtttctggagcagtccagtggctgatctccggatgtcctcaagccctagacctttgctgccagacccttgttcagtatgttgaggatgggatcagccgcgagttcagccgtcggtttttccacgacaggagagagaggcgcctggctagcctgccctcccaggagcctagcaccattattgagttgttcaacagtgtgctgcagttcctggcctctgtggtatcctctgagcagctgtgtgacatctcctggcctgtcatggaatttgccgaagtgggaggcagccagctgcttcctcacctgcactggaactcaccagagcatctagcgtggctgaaacaagctgtgcttgggttccagcttccacagatggaccttccacccccaggggccccctggctccctgtgtgttccatggtcattcagtacacctcccagattcccagctcaagccagacacagcctgtcctccagtcccaggcggagaacctgctgtgcagaacataccagaagtggaagaacaagagcctctctccaggccaggagttggggccttctgttgccgagatcccgtgggatgacatcatcaccttatgcatcaatcataagctgagggactggacaccccccaggctccctgtcacattagaggcgctgagtgaagatggtcaaatatgtgtgtattttttcaaaaaccttttaagaaaataccacgttccctcgtcatgggaacaggccagaatgcagacgcagcgggaactgcagctgagtcatggacgttcggggatgaggtccatccatcctcctacaagcacttttcctactccattgcttcatgtacaccagaaagggaagaaaaaggaagagagtggccgagaggggagcctcagtacagaggacctcctgcggggggcttctgcagaagagctcctggcacagagtctgtccagcagtcttctggaagagaaggaagagaacaagaggtttgaagatcaacttcagcagtggttatcgcaagactcacaggcattcacagagtcaactcggcttcctctctacctccctcagacgctagtgtcctttcctgattctatcaaaactcagaccatggtgaaaacatctacaagtcctcagaattcaggaacaggaaagcagttgaggttctcagaggcatccggttcatccctgacggaaaagctgaagctcctggaaaggctgatccagagctcaagggcggaagaagcagcctccgagctgcacctctctgcactgctggagatggtggacatgtagctgtctgacgggagacggatctctaattcataatgctttgtctgtattcaattgtgttatagatgctgttggaaatgtgactattaattatgcaaataaactttttgaatcattccaaaaaaaaaaccat

SEQ ID NO: 1423 - DNA, 5916 bp, Mus musculus
atgcacccggtgaaccccttcggaggcagcagcccaagtgcttttgcggtatcttccagcaccacgggaacatatcagactaaatcaccatttcgatttggccagccttccctttttggacagaacagcacacccagcaagagcctggcgttttcacaagtaccaagctttgcaacaccctctggaggaagccattcttcctccttgccagcatttggactcacccaaacctcaagtgtgggactcttctctagtctcgaatccacaccttctttcgcagctacttcgagttcctctgtgcccggcaatacggcattcagctttaagtcaacctctagcgttggggttttcccaagtggcgctacttttgggccagaaaccggagaagtagcaggttctggctttcggaagacggaattcaagtttaaacctctggaaaatgcagtcttcaaaccgataccggggcctgagtcagagccagaaaaaacccagagccagatttcttctggattttttacattttcccatcccgttggtagcgggtctggaggcctgacccctttttctttcccacaggtgacaaatagttcggtgactagctcaagttttatcttttcgaaaccagttactagtaatactcctgcctttgcctctcctttgtctaaccaaaatgtagaagaagagaagagggtttctacgtcagcgtttggaagctcaaacagtagcttcagtactttccccacagcgtcaccaggatctttgggggagcccttcccagctaacaaaccaagcctccgccaaggatgtgaggaagccatctcccaggtggagccacttcccaccctcatgaagggattaaagaggaaagaggaccaggatcgctccccgaggagacattgccacgaggcagcagaagaccctgatcccctgtccaggggcgaccatcccccagataaacggccagtccgcctcaacagaccccggggaggtactttgtttggccggacaatacaggaggtcttcaaaagcaataaagaggcaggccgcctgggcagcaaggaatccaaggagagtggctttgcggaacctggggaaagtgaccacgcggccgtcccaggagggagtcagtccaccatggtaccttcccgccttccagctgtgactaaagaggaagaagaaagtagagatgagaaagaagattctctcaggggaaagtctgtgcgccagagtaagcgaagggaagagtggatctacagcctcgggggcgtgtcttctttagagctcacagccatccagtgcaagaacatccccgactacctcaacgacagagccatcctggagaaacacttcagcaaaatcgctaaagtccagcgggtcttcaccagacgcagcaagaagctcgccgtgattcattttttcgaccacgcatcggcagccctggctaggaagaaggggaaaggtctgcataaggacgtggttatcttttggcacaagaagaaaataagtcccagcaagaaactctttcccctgaaggagaagcttggtgagagtgaagccagccagggcatcgaggactccccctttcagcactcgcctctcagcaagcccatcgtgaggcctgcagccggcagcctcctcagcaaaagctctccagtgaagaagccgagtcttctgaagatgcaccagtttgaggcggatccttttgactctggatctgagggctccgagggccttggttcttgcgtgtcatctcttagcaccctgatagggactgtggcagacacatctgaggagaagtaccgccttctggaccagagagaccgcatcatgcggcaagctcgagtgaagaggacggacctggacaaagccagggcatttgttgggacttgccctgacatgtgtcccgagaaggagcggtacttgagggagacccggagccagctgagcgtgtttgaagttgtcccagggactgaccaggtggaccatgcagcagccgtgaaggagtacagccggtcctctgcagatcaggaggagcccctgccacatgagctgagaccctcagcagttctcagcaggaccatggactacctggtgacccagatcatggaccaaaaggaaggcagccttcgggattggtatgacttcgtgtggaaccgcacccggggtatacggaaggacataacacagcagcacctctgtgatcccctgacggtgtctctgatcgagaagtgtacccgatttcacattcactgtgcccactttatgtgtgaggagcctatgtcttcctttgatgccaagatcaacaatgagaacatgaccaagtgtctacagagtctgaaggagatgtaccaggacctgaggaacaagggtgttttttgtgccagtgaagcagagtttcagggctacaatgtcctgcttaatctcaacaaaggagacattttgagagaagtgcagcagttccaccctgacgttaggaactccccagaggtgaacttcgctgtccaggcttttgctgcattgaacagcaataattttgtgagatttttcaaactggttcagtcagcttcttacctgaatgcgtgcctgttacactgttactttaatcagatccgcaaggatgccctccgggcactcaatgttgcttatactgtaagcacacagcgctctaccgtcttccccctggatggtgtcgtccgcatgctgctgttcagagatagtgaagaggcgacaaacttcctcaattaccatggcctcactgtagctgatggctgtgttgagctgaatcggtcggcattcttggaaccggagggattatgcaaggccaggaagtcagtgtttattggccggaagctgacggtgtcagttggggaagttgtgaatggagggccgttgccccctgttcctcgccatacacctgtgtgcagcttcaactcccagaataagtacgttggagagagcctggctacggagctgcccatcagcactcagagagctggtggagacccagcaggtggtggcagaggagaggactgtgaggcagaggtggacttgccaacattggcggtcctcccacagccgcctcctgcatcctcagccacgccggcgcttcatgtccagccactggccccagccgcagcacccagccttctccaggcctccacgcagcctgaggtgctgcttccaaagcctgcgcctgtgtactctgactcggacctggtacaggtggtggacgagctcatccaggaggctctgcaagtggactgtgaggaagtcagctccgctggggcagcctacgtagccgcagctctgggcgtttccaatgctgctgtggaggatctgattactgctgcgaccacgggcattctgaggcacgttgccgctgaggaagtttccatggaaaggcagagactagaggaagagaagcaacgagctgaggaggaacggttgaagcaagagagagaactgatgttaactcagctgagcgagggtctggccgcagagctgacagaactcacggtgacagagtgtgtgtgggaaacctgctctcaggagctacagagtgcagtaaaaatagaccagaaggtccgtgtggcccgctgttgtgaagccgtctgtgcacacctggtggatttgtttcttgctgaggaaattttccagactgcaaaagagacactccaggaactccagtgtttctgcaagtatctacaacggtggagggaggctgttgcagctcggaagaaattccggcgtcagatgcgggccttccctgcagcgccatgctgtgtggatgtgaatgaccggctgcaggcactagtgcccagcgcagagtgccccattactgaggagaacctggccaagggtcttttggacctgggccacgcaggcaaagtaggcgtctcctgtaccaggttgaggcggcttagaaacaagacagctcaccagataaaggtccagcacttccaccagcagctgctgaggaatgctgcatgggcacctctggacctgccatccattgtgtctgagcacctccccatgaagcagaagcgaaggttttggaaactggtgctggtgttgcctgatgtggaagagcagactccagagagtcctggcagaatactagaaaactggctaaaggtcaaattcacaggagatgacagcatggtgggtgacataggagataatgctggtgatatccagaccctctcagtctttaatacacttagtagtaaaggggatcaaacagtttctgtcaacgtgtgtataaaggtggctcatggcacccttagtgacagtgcccttgatgctgtggagacccagaaggacctgttgggaaccagtgggctcatgctgctgcttcccccgaaagtgaagagtgaggaggtggcagaggaggaactgtcctggctgtcggctttactgcagctcaagcagcttctgcaggccaagcccttccagcctgccctgccgctggtggtcctcgtgcccagctccagaggggactccgcggggagggcagtagaggacggtctgatgttacaggatttggtttcagccaagctgatttccgattacattgttgttgagattcctgactctgttaatgatttacaaggcacagtgaaggtttctggagcagtccagtggctgatctccggatgtcctcaagccctagacctttgctgccagacccttgttcagtatgttgaggatgggatcagccgcgagttcagccgtcggtttttccacgacaggagagagaggcgcctggctagcctgccctcccaggagcctagcaccattattgagttgttcaacagtgtgctgcagttcctggcctctgtggtatcctctgagcagctgtgtgacatctcctggcctgtcatggaatttgccgaagtgggaggcagccagctgcttcctcacctgcactggaactcaccagagcatctagcgtggctgaaacaagctgtgcttgggttccagcttccacagatggaccttccacccccaggggccccctggctccctgtgtgttccatggtcattcagtacacctcccagattcccagctcaagccagacacagcctgtcctccagtcccaggcggagaacctgctgtgcagaacataccagaagtggaagaacaagagcctctctccaggccaggagttggggccttctgttgccgagatcccgtgggatgacatcatcaccttatgcatcaatcataagctgagggactggacaccccccaggctccctgtcacattagaggcgctgagtgaagatggtcaaatatgtgtgtattttttcaaaaaccttttaagaaaataccacgttccctcgtcatgggaacaggccagaatgcagacgcagcgggaactgcagctgagtcatggacgttcggggatgaggtccatccatcctcctacaagcacttttcctactccattgcttcatgtacaccagaaagggaagaaaaaggaagagagtggccgagaggggagcctcagtacagaggacctcctgcggggggcttctgcagaagagctcctggcacagagtctgtccagcagtcttctggaagagaaggaagagaacaagaggtttgaagatcaacttcagcagtggttatcgcaagactcacaggcattcacagagtcaactcggcttcctctctacctccctcagacgctagtgtcctttcctgattctatcaaaactcagaccatggtgaaaacatctacaagtcctcagaattcaggaacaggaaagcagttgaggttctcagaggcatccggttcatccctgacggaaaagctgaagctcctggaaaggctgatccagagctcaagggcggaagaagcagcctccgagctgcacctctctgcactgctggagatggtggacatgtag

SEQ ID NO: 1424 - DNA, 44030 bp, Homo sapiens
ggatgctcctgtagtcccagctactcaggaggctgaggtgggaggatcgcttgagcccaggaagttgaggctgcagtgagccaagatctgcactctccagcctgggcaacagaggccctctcaaaaaaaataaacaaaaataaaacatagttaatgttgtatacacgatgattgagcgttagtagaatgttgaccatttttaataactttatttatttatttatttagagatggagtctcgctctgttgcccaggctggagtgcagtggcatgatctctgctcaccgcaacttctgcctcctgggttcaagtgattctcctgcctgagcctccctccccagtagctgggactacaggagcccgccaccacgcccagctaacttagtagagatgggatttcgccatgctggccaggctgatctcgaactcctagcctcaggtgatccacccacctcggcctcccaaagtgctgggattacaggcatgaaccaccttgcctggccgtttttaataactttaaacaaaagagatattcgggtatttttctttagaaaagctcttcaccggcagtggcgcacagaggcagcctcctgtccccgcagccctgtgcactcctgctcagaggctttgtgcttgctgtttccactgctgttccacactcgcagagccgcacggcgctgtctccacctccctgaggccaggcgaggcttggctgccgccctcagcagggcccccaccagcgctccctgctctccctgcccatctgccgcactaaatcaccattctgtgtgtttgatgtgtttgttttctgtggcattggtctctcccctggcatgtcagctatgtggggacagggattgtgtttttgttcactgttgtactctcagcattaaaaacggtgccaggcacagagcaaatgcttgatcagtgttggttgaattaaagaacatcggaagaggactaacagcttaggtaccaaagtcccagcactcaagcagaatttttgttcggattttcatgtttttcctttgtctatttttacttttatttttatttatttatttttttgagatggagtctcactttgtcacccaggctggagtgcagtggcatgatctcggctcactgaaacctccacctcccgggttgaagtgattctcctgcctcagcctccctagtagctggtattacaggtgcgtgccaccacacccagctaatttttgtatttttagtagagatggggtttcaccatgttggccaggctggtctcaaactcctggcttcaagtgacccgcctgccttggcctcccaaagtgctgggattacaggcgtgagccaccacacccagccccattgtcttttttttaagacactggttctcactctgtcacctaggctggagtgcagtggtgtgatcaaggcttactgcagcctcaacctcttgggctcaagcagtcctcccactttagcctcccatgttgctgggaccacaggtgcatgccaccaagccccactaattaaaacaaatttttttttatagagaataggatgtagctatgttgcccaggctggtcttgaattcctgggctcaagtgatcctcccaccttggcctcccaaagtgctgggattacaggtatgagctactgcacctggtctctgtcttctttttttttttttaaggctcttgttagaatgccgtgaacagttgtctccaactattatatgtcattccacgggattggtttcctgctggcattccatggtctccggggtcctctgcagcaccttcctggccttttgtcatgtggatgctgcacagctgacttcacctggtcttgttgatggacagtttgtttcatgatttctcttatgaataaaaccttcacaagccatccttctctatgagagtgtttgcttggcacgcattcctgagcactgcccctgagcagaccgcctatgatctctaagcttgggttccgtgttgccaaagcgccttctggtggactcagcccaggaggagcccatgtgccccacgctggccatggctgtggtcatgggctgactgcatgtgtctgactgggccttcgtctgagactgcagtgatttcgctcctcctctcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacgggtaagagctgagaatggaactgtggggcccctgtctccttttttcttgttaattctgatgaagggctgtgaagggctggctgcttgcctgacttgaagaaggtgcattccctctgccatgcaggtgaacacacgagactcagaatggctgggggtgttcccaaggtcacatcctggctgtcagcacattgagggctcagaccaagttctttgtgactccaaaatcagtccttttcatgacttgctgacaaacctaaagataaaagttagggccttctttattctttcccttgactgcctttgccagccaatgacggacaacctctgacggctgggatggaggcacccgcaggccagccggagtcttctccggtacttaccagtcagagtggtgagactcacagacgctctctcagaaactggcagcttacactcaacacccggtgcctagttccccaccctgtctcctctaactcctcacctgcctcctgcctgtctcctccttccagttctgtctccttctagttctgtctcctccttccagttctgtcctcagaaaattagacggttttgggtgagccagcaaggaggcaggagtgagtcagcgtgcgtctgttaacacgctgggcttagtggttctagggacctacagaggctccagggtgggcggcagtgggacctggcgcctgtgctttctgttatttacacatggctgtggtgacacccaaggggcttgcagtactcggcagggcactgagggcgaagctgtcttctcccctggtgacacccctcgggggtcttttgtggtctgggtagctgtgtggagctgaaccggtctgcattcctggaaccagagggattatccaagaccaggaagtcggtgtttattactaggaagctgacggtgtcagtcggggaaattgtgaacggagggccattgccccccgtccctcgtcatacccctgtgtgcagcttcaactcccagaacaagtacatcggggagagcctggccgcggagctgcccgtcagcacccagagacccggctccgacacagtgggtgagtgaagctgcagtcgtagtgaggggactagctgcattttcccaccagaacgcctcccaggagcctgggcatctgcattttctcgccaggacgcctcccaggagcctgagcacctgtcttgtcttggggcccaggggtgtggctcttcctcatgctcagatggttctcactgggagtggactgagggctttgaagccctcctcctggctccctgacatcctggggcttgtttttcatgcaaagcgtatgttgtcccacgtagctggtctcctggagggcaggccagtcctcagggtcactgtgggtggcctggggctgtccctgcacagacctcggtccccgtggtgccaggcaccctgtgtctgcagctatgttttgtcctgtatgtttccttccaggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggtagggactctttttttctaggtctggactctgggaagcccattgtgcgcaaacgtccttagtcatcaccccatgaggtggggctgtggcgcctggtctctcaggagagtccagagaggggtcctgcctagagtcactcagcctcaggtagggcccacctattcaggctcattctggagtccgtcttcatctcaggagcttcctgtcacagcaccggcctgagcccgtgtgtctgaactcaacacccgtctattcctgacgggatcattggcagcattgtgcgccccctgatgggtgtgacctggggtggcgtgtccgcctggtgggtgtggcctgggtgggtgtgtccccttgggtgtggcctggagtgggcatgtccccctgatgggaccccaatatgcatggactgagtgtgggtgtgtcccctgaagggcatgtcctggggttgggtgtccccactgatgggtgtgacctgggatgggcgtgtcccctggcgggtgtgccccctgatgggcatggcttggggtggctgtgccccctgataggcgtggcctcggggtggtcgtgtcccctctggtgtgtgtggtctctggctgtgcaccctgatgggcatggcctgggggtgggtgagccccttgaccagcctggcctgggggtggatgtgccccttgatggttgtggcctcagggtgggcatggtcccgacaggtgccttgatattgagtagagcctgtcgactccatggttgtgagactggattgtgccactctggctgcttcggggcaggcactgggcaccagcccatctggggatcagggagtgcttagggggagcatagagtggtcacagaaacagaggctgcttgacgtagactggagatggctaggccagggcgctgtgtggccatccgcagggcgccttcctctccagatggcacctttccattcgctaggggacacctttcctgcaacagcctagccgaccccgtgtcaggggttgtgcttctgtcacgagacgcctgcagactgtccggtgacaacatgttacccagcatttctgccctgggtgggacgttccattacaccccatgctggtctctccacaggacctggcgcaggtggtggacgagctcatccaggaggccctgcagagggactgtgaggaagttggctctgcgggtgctgcctacgcagctgccgccctggggtgagtggcatctcgtgctcccctcctgctacgtgctgcggggagctgcacccagtcctccagaagtttcctctcataaagttgcctgcgtttttggagtcataatccaataagttattgccagatacagtgtcaggaagattttcccctacattcttctttttcaagatggttttgctatttggggtctcctgagataccatgcgaattttaggatgagtttttctgtttctgcagaaagtgctgttgggattttgatagggattgcgttgaatctgtagattgttctgggtggtactgtcatctttttttttttttttttttttttttttttttgagatggagtcttgctctgttgctcaggctggagtgcagtggctccatctcagcctcactgtaacctccacctcctgggttcaagcaattcttctgcctcagcttcccgagtagctgagattacaggtgggcaccagcctggctaatttttttattttttgtggagatgcttttcgccatgttgtccagggatggtctcgaactcctggcctcaagtgatccacctgcctcagcctcctaaagtactgggattacaggcatgagccactgcacctggccagtattgtcatcttaacaatattaaatcttctaatctgagaatgtgggatgtctttccatttatttaggtcattcttaatttctttcgacaatgctttgtagttttcaacgtataaagtttttgcctcctaggttaaattgtttttttgtttgtttgttttgttttgtttttgagacggagtctcgctctgtcgcccaggctggagtgcagtggcacaatcttggctcactgcaacccccacctcccggattcaagcgattcccctgcctcagcctcccgagtagctgggattacaggcacctgtcaccaagcctggctaattttttgtatttttagtagagacagggtttcaccattattagccaggatggtctcgatctcctgacctcgtgatccgcccgccttggcctcctaaactgctgggattacaggtgtgagccaccgcacctggccttgttgaggatttttatatccatattcatgagggatattggtctgtagttttccatttctttttttttttttttttttttttgagacggagtctccctgtcgcccaggctggagtgcagtggcgtgatctcggctcactgcaggctccgccccccggggttcacgccattctcctgcctcagcctcccgagtagctgggactacaggtgcccgctacctcgcccggctaattttttgtatttttagtagagacagggtttcactgtgttagccaggatggtctcaatctcctgacctcctgatccacccgcctcggcctcccaaagtgctgggattacaggcgtgagccaccgcgcccggcctcctttttatttctttattccttttttttttcttttttgagacagggtcttactttgtcacctagacccgagtgcagaagcacaatcacagctaaccacagccttgatcttctaggctcaagccatcctctcacctcagcctcccaagtagctaggaccacaggcgcatgctaccatacccggctaattttttaattttttgtagagatggggtctctctatgttgcccaggttagtcttgaactcctgggctcaagcagtgctcccacctcagcctcctgaaatgctgggatgacaggcatgagccactgtgcctgctcagtctgtagttttcctatagtgtctttggtctgtctttggtattagagcaatgctagcctcataaaatgagttagtaaatattccctcctcttcagttttttgaaaggatttgaaaaagattggtggttagtttttcgttagtgtttaatagaatttaccagtgaaaccttctggtctcatacctttctttgtttggaagtctccttactagttataggtctactcacatttttctgtttcttcatgagtcagttttggtagatggtgtgtttctaacagtgggcttaatttttctgctggcagccaaacaagtacaggttgcatatcccttcttcaaaacgcttggaaccacaagggttttagatgacagatatttttggattttggaatatttgtattatatgtaccagttgagtatctcttacctaaaaatctgaaaatctgaattctaaaatgctccaatgagcatttcctttgaaaagcatgacatgttgtgctcaaaaagtttgagattttggagcattttggatttcagatttttggattagggacactcaacctgtgtgttttttttcccttgtcaatgacttggcttttttctgatatttttctttctttttttttttttttttgagacagagtctcgctgtgtcgcccaggctggagtacagtgacgcaatcttggctcactgcagtctcccgctcccaggtccgagcaattcttctgcctcagcctcctgagtagctggggctacaggcgtgtgctgccgcgcctggctaatttttgtatttttagtagagatggggtttcactgtgttggccagaatggtcttgatcttctgaccttgtgatccgcccacctcagcctcccaaagtgctgggattacaggcgtgagccaccgcacccggccttgactctgattttgaatgctatcccctttgctccgtttagtgtttctaatgctgctatggaggatttgttaacagctgcaaccacgggcattttgaggcacattgcagctgaagaagtgtctaaggaaagagagcgaagggagcaggagaggcagcgggctgaagaggaaaggtaagtgtgtcttgtccatgcagccgaataaggagctcagtgtggacacaggcaagaactgaccctagccacgatgctcctgctattgtccactgtgctaccattccacccctgctgacccactcatgccctcctatgcttcagcccagggggtggatggagctcctcaggccacacctacccgtgagcagtggcccttcccagccaggaaaggcaggggaagggaggtggtgtcaggggagctggagtaggggtggcctaccgactcaggcagcacacctcaatccctgtctgcgtggccagggagtaaaacaaacagcacttatttttattcttaaacattacccttgtgtattttttctcttccctgtaggttgaaacaagagagagagctggtgttaagtgagctgagccagggcctggccgtggagctgatggaacgcgtgatgatggagtttgtgagggaaacctgctcccaggagttgaagtaagtgaaacgctggtgtcttgctgtgccaggagagtgagctttggctctgccctaggctgtgtcttgcaccactgaggatgggctattggaaatggatcttgcctgtctaagctactttgattttgtgaccaaatgtatttgatgcagtcctctgtgctcccttggctaatagaattttattataaaaaattctcttttatatgagggctgccaccacatgatcatagtcagccatccttattagccactggcatttatcatatatttgagacacttccaattgattgcacaagtcagatgttgctgatgagaagattttgtggttgtctgcatggtaatttacaaattctacgccaggcacctgtagtcccagcaactcaagagactgaggtgcaaagatcacttaagctcagaagttccaggtagtgtgctatgactgcacctgtggtggccactgtactccagcctgggcaacatagtgagaccctgtctctaaaataattaaaaattctgactattttattaagataaaggtttatttcttaactgttacgagggcccctatggacctataatttggcaccctgttccacttaattctttttaccctgtctttctaggtgtctgtagtttaagtattaaagcttcttttacaatgaagatagaattacattttaatactgaggatgcagactcttgcactttttttttttaaagacggagtcttgctctgtcgcccacactggagtgcagtggcgtgatctgggttcactgcaacctctgcctcctgggttcaagcgattctcctagctcagcctcccaagtagctggaattacaggcatgcaccgccatgcccagctaattttttttttttttttttttttgaaatggagttttactctgttacccaagctggagtgcagtggtgccatctcggctcactgcaagctccgcctcccgggttcacgccattctcagcctcctgagtagctgggactacaggagcctgccaatatgcctggctaatttttcatatttttagtagagacggggtttcaccgtgttagccaggatagtctcgatctcctgacctcgtgatccgcctgccctggcctcccaaagtgctgggattacaggcatgagccaccgtgcctggccgccagctaattttttgtatttttagtagagacggggttctaccatgatggccaagctggtttcgaactcctgacctgaagtgatttgcctgctttggcctcgcaaagagctaggattacaggtgtaagccactgtgcctggccgactcttgcacttttcttttttttttttttttgagacggagtctcgctctgtcgtccaggctggagtgcagtggcgcgatctctgctcactgcaagctctgcctcccggcttcacgtcattctcctgcttcagcctcccgagtagctgggactacaggcgcccgccaccacaccaggctaatttttttgtatttttagtagagacagggtttcaccatgttagccaggatggtctggatctcttgacctcatgatccacccgcttcggccttccaaagtgctgggattacaggcgtgagccaccgcgcctgactgactcttgcacttttcaagcaagccctcagtgtctgtgggccccaagtgcagtgtcttccatgctgattgccctgtttctaggaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtgagtcctgtgttcctacaggcaaaatccacacacacggggaagagtcttttaacaaattcaaaatatatgagctattagtttctgtattcagtggtaaaaggatgagggaaaatgttatagcaatgaatacctaaaatagactaattggattatactgcatttcagaaatacttgattacacacacacacacacacacatacaatataaggggaaaagtcaggagttagattgggacgtggtggctactctgtatgtcaactgatatttatagggtgcctgccatttgcccactgcactaggtgctgggagacagctatgaacaagccagattatggctgcatgcaccaataagggtgaattctcaaaatataagtagtggagaaaaagcaattaatagggaatatacaaatagtgtatattcaaactaaataggttgtttcagatttatatatagtggtataaccctaaagaaaagaaggaaaataatgatcataatctcagcatagtggttacttttgggaatgggaggtggtgcctctcatggccacaacttctcaactgggtgtaagtgcacaggtgcttgatgatttattaatcttataactgggcatatatgtgttacgtatgttgtatgattcatttcataataaaatttaaaatcagtaatagtgtccttggtagttggaacagtataaaagggagtatggggagaagtgagtcttccttctacaacagacccctgtccattgtgcgagcagcagctgcttgcgaaaccatccagagactttctgtcctttcttgtggctcttggcacagatgggctcatgatccctgctttgctctgagccttcctttgctccatctgatatgaggtggaggcttggctgtagcagcatgctgagctgtccccgttgccagtggtcttgaggtcagtgcgataatgtaccataaatgaccttcctggtcttctgttgatggactttcatgtggctctttttttttttttttttgagatggagtctcactctgtcgcccaggctggagtgcagtggcgcaatcacagctcactgcaacctccacctcccaggttcaagtgattcttctgcctcagcctcctgagtagctgggactacaggcgtgcgccaccatgctcggctaattttgttttttttatttttagtagagatggggtttcaccatattggccaggctgctctcgaactcctgacctcgtgatccgcccgcctcggcctcccaaagtgctgggattacaggcgtgagccaccgagcctggacgtagctctttttagctctggtaaagactgttgcagtgactgttgttgtacagacagacatctcacccgtttgcacacaggcacgtgtgtggagataaattcctatcagtggtggctgtgggtcaagggatatatgtatctttttttttttttttttttttttttgagacagagccttgctgtgtcacccaggctggagtgcagtggtgtgatctcggctcactgcaacctccacctcctgggttcaagggattctcctgcctcagcctcccaagtagctgggaccacagtcgcccaccaccatgcccggctaattttttgtattttagtagagattgggtttcactgtgttgcgcaggctggtcttgaactcttgagctcaggcagtccgcccgccttggcctcccaaagtgctgggattacaggcgtgagccactgcacccagctgggtatatgtatcttaaatctgtatccatattgccaagtcagcctccaaagctcattcagtattaactgttaacgttcggtagtttcattgctcaccacactcatttgatgtccttccttccccatgcctgagttctgactgcaatgtgtttctcagtttgaagaccctgaagacactctgtgatgatacattttcatgtccccaggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcctgcaccaggtcagcatcagctgtcgcctgcctcgtcagggctcccctgcccccacttggttttaccaggagcggaattaatgtgtgtgtttggagggtgaagataggtgaagcctggaggcgaagataggtgaagcctggaggcgaggacaggcacagggttgcattttgaaggttgtctcccacagttgtggacatgtgacttgttccactggcaaagcagagctctgagttcaccttgaaagactcagcgtcctggtgcctgagtctgactctgcatcacgtgttcttttcctgctcgtcccagtttaagtacctgccacttccatccttgttggaggagccggaggtccacgctggcctgtgtcttccgatcccatccccgccccatccctctgttcctcccgccgtctccttcacacactgccccctttctgtggcagcatcttccagactccacctccaccctccattatttccctcttgaggccccttggtgtggccctggtcctccctgccactcctcctggttaccccgagcagaaccggctcctcagggccatgccaggacccccctcagcctgcattcctggccatgctgggcttggcctttatttagaacccatgtaggtgccacctcttgcctggcctcagggctccctggcctcccagtgggtggggactggggaggcagcctggagggcctagcaggcacaccgctggggcctcatgtcatgtcttgtcctcctcctggtcatcactggatgttccctctgaaaactgtcttgtgggtttcatttagccccatcaggttctgcgccggcagtggggtggcagtcccagcctgttggaggcatgctgtgaggccagggctgggcctggctcctctgacccatggctgccttcacatagtgacctggccttctcctggagtcatggcttcttgtgtcccccctccgtagctgcccttgtcagcctcagtctccttgtctgagccctccaccctgccccctcagcccagacctctgccctctgcccttctgcgcaccccctggtgatagccctgtcacccctgtctgtcactgacagcccccatcatgcatctccaactgaggcctcttccctgagttccagacttggtttccagttggcagttcaacctctaaacctgatttttccccaccctgccccttcctgctcataggatgccgtcctgtcctcctgcgcttagggcacaaacctgggcttgcatctctctcagacccagcaccgagggcatggcagttctctccacctcactggaatgttgctgcagcacctgtctgccagcttccaccctgggccccaatcgtgtcctcagcaccacaacagagggatcctccaacagctcagccaggtggcgttgcctctcggcggcgtccctagcgctccccgagtctctgcattgtggacccaacccctccctcgctgccctcactgctctccccaaacacaccaggtccagctatggcctggcatagccatgccctctgctgtttccagaagttgtcacgctggctccccctgtttccttcaggtctttgctcacatatcacctgaccaccctgagtgagactgcaacacgcaccctgcctggctccagccccacctggcagcatttgcccacagtgccgacacctcacacatgccaggccagccacttagagatgctgttctctccccattagagcctatgttctcaaagggcaggattttgtctgtttattgctgaatctcccatagccagcacacagtggatacttaacatgatatttgtggaatgaaggaatcctctaacccgtttcattggcagaaaatgtgtttttcagtctcctgagtattccccaggggacactagccagtacttctcactaagctcctgcggggacactgtcattctgctttcctttgcaggttaaggcggctcagaaacaagacagctcaccagatgaaggttcagcacttctaccagcagctgctgaggtctgtcatgctgcacccttctgcgcaccccctggtgatccccgttccccaatctgtcacactggcagcccccttcatgcatctccaactgaggtctcttcgatgagctccagacttggtttctagtttgcagttcaatctctgaacctgattttcctccaacctgccccttcctgctcataggatgtgtgtgctgctcctgcaagggtctcacacactggctaatccacggtggtctgttcctcccagtgatgtggcatgggcgtctctggacctgccatccctcgtggctgagcacctccctgggaggcaggagcatgtgttttggaagctggtgctggtgttgccggatgtagaggagcagtccccagagagttgtggcaggtcaggaagggttttcccctgtggggtttccaagaggtggagtgggcagggcagggttgtgggccagggccgggtattcctcttatgtgtgatgggaactcggaagtgtaggtttatgttttaatgcttggatttacagtctgttttgctcatgattttaagttgaaactttagatttgattatttcaatttttattccataaacttggtgtattagtccgttctcacactgctttaaagaaatatctgagactgggtactttataaagaggtttaattggctcggctgtacaggaagcatggctggggaggcctcaggaaacccacaatcatggtggaaggctaaggggagggaggcatgtcttacatggccaaagcaggaggaagagagagagaagggggagatgccacatgcttaaccagatctcgtgagagctcactatcatgagaacagcaaagtgggaggtgccacacacttctaaacaaccagatctcgtgacagctcactgtaatgagaacagcaagggggaggtgctgcacacttaaccaggtctcgcgaggctcactttcatgagaacagcaagggggagtttccacacacttaaccagatctcctgagagctcactatcatgagaacagcgagggtgagttgccacacacttaaccagatcttgttgagagctcactatcatgagaacagtgagggggagttgtcacacaaccacatctcgtgagagctcactatcatgacaacagcgaaggggagttgtcacacacttaaccagatctcgtgagagctcactatcatgagaacagtgagggggagttgtcacacacttaaccagatctcgtgagagctcactatcatgagaacagccagggggattccacccccatgatacaatcacttcccaccaggcccctcctccaacattggggattacagttcaacatgagatttgggtagggacacaaatccaaaccatattacttggcaacagtcttagaccaaaagcatttaagagttgattgttatttcaagctgtgttaaggtacattgatagacctgcttcattttagactcttcagtaagatagtttatagtctgtttactatagttccatttttttccccttaaagaaacttttggcattttaaaaaagaaaaaattgacatgatcttattttctgtaaccacatagcatacagaagtcatatttttaaagcaactacagtctctttgtgtttttttgagacagggtcttgctttgttgtcacccaggctagagggcagtggtgtgataacagctcaccgcagccttgacctcctgggctcaactgatcttctcacctcagcctcctgagtagctggaactacaggcgtgtgccaccatgcctggttaatgttttttttttaaagatggggtttcactatgttgcccaagctggtcttgaactcctgggctcaagcaatctgcatgcttcagtctaccaaagttttgggattacaggcgtgagccaccacacccggcttacagtttatttttaaaatagctttattgaaatgttattcacataccataaacttcacccatttaaagtgtacatttcagtgatttttagatatattcacagggttttgcaaccatcactgttaataattccagaacaccttttcacttagaaagcctgtattcttttttttttttttagatggagtctcactctgtcgcccaggctggcgtgtggtacactttgttcactgcaacctccacctctcaggttcaagcaattttcctgcctcagcctcccaagtagctgggattacaggcgcacaccaccacgcccagcttagttttgtatatattttgtagagacagggttttgtgatgttgcccaggctggtctcaaactgggctcaagcgatccacctgccttggcctcccaaggtgctgggattacaggcgtgagccactacgcccagctggtgagtcatttcttaaaatagctgtcttctcatttgctaagttcgtatgtcacttaagaattcttaaggtctcaggtatgagaaatttgatctgtaaaaaacatgtatttcaaactctagggatgttttctattgctgaaaatcttaatgcttcagaattttaagtcacattagaatgagccagttccattctaatggaatggagtgccccctcctcctgcccaattaagaacaagtagaagccgggagcagtggctcatgcctgtaatcccagcaactggggaggctgtggagggaggattgcttgagcccaggagtttgaggccagcatgagcaacatagtgagaccctttgagtgacactctacaaaaaaaatggaaagattagctgggcatggtggcccgtgcctgtagtctcagctactgaggcaggtttgcttgctgcggtgagccaagtttgtgccattgcactctagcttgggcgacagagcgagaccctggctcaaaaaaaaaaaaaaaaaaaaaagaacgagtacagatcgttgctccattttaaaacaacagcctgttttgtgcagatcagcttcatagtaagatgtggtatttgtggacctaggtctgtgtgatatttttctttcttcttttcctgaaagtctttataattcaaatatagaattagattcttcaagtgttttttttgttttttgttttttttaaatctgtagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtgaactataattactttgtgtttacttctgtgttttcattactttcacttactcccagatatcactggaaccatgcaaatactgcttattccctaatgtggttttgaaagactgggaggctcagaagcaagtattatgtctgtccgtacatgtcgtttaaaaaatttttttaagccagtcaaattgagtagtgggcaccaagcccagcctgcttctttactttttctgttttaatactatatattggatttcctaaatgtaatatgtacacaaaacttttaaaaaatgaggaaatgtaaaagaagtataaagatgatgataagagccatccatgctcttgccattctgaggtaacagtaacttcttggtgcaaattcttcccttttcctgggattacaaagtcacatttcatctactggaaattagtttactgctgctgttaccttcattttcatttaagaaagtaacacttccgtgtacttaaaaagaagtcaaataatgccacccacgtgatttaaaatgagacatagtagctcctccttcctctcttaactcctttcttcagggctgcatttttctcctgtttccagatcacacacttacacagccatttctcagtttatccatttaaatgttctctgctgacttcccattaatataaatgtattagttaccttattcctaaataactaattactcctaacatagcagcttaaaataatgtctgttatcatggtatctgtgggtcaggaatccaggtgtagcttagcttgggtcttctggctcaaggtttctcatgggtggaaatcaaaatgttggctaggattgtggcctcatctgaaagcttgactgaagggtatctacttcccagctcactctagtgagcttgtgtcaggattcacttccttgcaggctgtggccaaagacttcctcagttcctgccacatgggcctctccccagctgacagcatggcagctggctttcatcagagtgagcaagaggtgagcctagatggaagtctgagtgtgtttataacctaaacttagaagtgacatcctgttgcttttgttggcttctgtctgtcagaagtgagtggctaggcccagctcacggggcaggagatcacacgtgggcatgaacactaggtggaatcaggggggtcctcttggccactgcataccatactaggtacagcgtggcctcttgtgccatggtccttgctcggccttccacgtcttcccgggatagctacactagcactttgtattacttcagtgagtggggtcatattttgatggctctgtgactgctattcacctcagaaccagtagtgttctataaccacaattatttttttcctgcaagaaatagagttgccttattgtctcacttaatgtagttctctttatctctttaattttactggggggccgtatatatctcggtagagttttccaaatgttctgtcacttcacttgatccatccatgttccctctgtcctggaactctcatctgtgggctggtctccatccaggcaacatgtgccttagtgccatcattgtgagcatatgtgtccctgctcctccacttggaagctctgtgaccttgggcaagttccctagcgtctctgccacctgtgtatgggtactgttacttattatccctattttactcagagacggtaaaataaactgcccaagcctctgcaggtgctgtctggtggagatgctcatctggctcttgaggataaaatgagtgcaaacacagactgcacaggacagtgcctggcacaggccaggtgcttgctcagtgttgccattagcagcagctgcagtattttttcttggttcagccccttgttggatgttatatgtcatgcgaggggaattttctgagtcttttccattatgaaaatgattttattaacaaaataccttaagctgggggaaagaaaaagaaaatgcatttatttcattctgacatttgcttcatagtttagctacgtttgtaaaattataggtagaaaattattttcctggccgcgcatagtggcttatgcctgtaatcccagcactttgggaggccgaagtgagcggattgttttgagtgcaggagttcgagaccagcctgggcaacgcggtgaaaccctgtctctataaaaaatacaaaaattagctgggcatggtggtgtgtgcctgtagttctagtagcttgggaagctgaggtgggaagattgcttgaacctgggagttcgaggctgcagtgagccgtgatcgcaccactgcactccggtgttgacagaggaagaccccgtctcaaaagaaagaaaattatttgccttccagttttgctccactgtcacctagcatccattgttgctgtaccattcctgttcctttctgtgtggcctggttttctctgtggaagccttttctctctgttcatggcgtcctaaaaattcactttgttacactggcactggactagcttcactcactgtgcagggcttagcaggtcctttcaggctagagactcctatttcacttctgggacattttcatgtctttatgacactctgtcttttttctgttctctcttgaacttctattagatagatgttaggcctcatcaattgatcctctgagtttcttatcctattttctatcctattttcaatctcatctcttcctactgtgttctgaaagagttccttgactttattttccaattgtcctactgaattttttattccatatatattacttatttcctctttctttttatcatgactttttcatagcatcttattttttggatgcatcatcttatctttccaaggaaattagggtttttggggtctaagttttctttggttcacgtattatctggttcctcttttttttttttttcctctctgttactccagtttatctcttttatgttggaggccctcctcagatgccttacccaaggctatctgtctatatctgagtgaggccctaaaaggctagccaagaagttctgtgtttggggtggggtggatggtagctaaatggcaagccaggctttttggagggactcccaaatgtctggatctggatggctgttccctagactgttcagtttttctggaaaggacttgtgccatctgctttctggggagctgctggtattctcagggtagggttgggagtggtttggcgctgagtcccttccactgtgcctgaccatggccctgcatctggatcctctcaggactcctgttcaggggcccagggggactggttttgcatagaggttgcctgcagtggtgggtgccgccaatagggtcaggctctgaacttcacctttggctcctggtgtctgcagcgcctgggtatacagggcttttgcaggctcagtcaacctgactccttacacacccacatctgcagcctttaggtatggcatcctctgcttccctaacccagggattggtcacacctatttgctgctttctagaaatgtatcagaatccctcatctgctgctggcttgccttccctctttctattattatgggcttatatttttgtttatttttgtagagatggggtcttgctatgttgcccaggctggtcttgaattcctggctcctggcctcaaacagttctcctgccttggcctccccaagtgctgggattacagtcatgagccactgtgcctagctttaacttttttatacctgtttaaggttaattaaagttatagtaatatggtcaaacacaattctagctggaggctaaattacctgttgacctggctgtttcttgcactaattctgttgcatttattctcatttttgtttctataaatttaaaatatgaacatgggtgggcgcggtggctcacacctgtaatcccagcactttgggaggccgaggcaggctgatcacttgaggtcaggagttcgagaccagcctggccaacatggtgaaaccctgtctccattaaaaatacaaaaattagctgggtgtggtggtgggcacctgtaatcccagctactagggagggtgaggcaggagaattgcttgaatccaggaggcagaaattgcagggagctgagatcgtgccactgcaatccagcctgggcgacagagtgagactccatctcaaaaaataaataaataaaaataaaataaaatatgaacatgccttatatctgaagggcagatatagaaattatttttctagggtgattgtcctctgaatatatgaagaaacaatgttatttgacgttttctttaaaaaggaagtctgaagctaggcatggtggctcctcgaacctgtaatctcagctactcaggaggctgaaccaggaggactgctcgagcccagcaattcaagaccagcctgggcaacataataagacccccttctcaaaaaaaaaaaaaggttgaggggagtctttgctaacaattggatttagggaaagaggggccaggaattaaaataactacaggaagtaagataactacagggtatgcccagctgtgcccttggaggcctgtctggagtacagtcagtatttagtgcacggagagctttggctgcacttgctctggggcagatcagtcactgctgatgcgtcccatggtgcatctctcctgatgatcttgatgctgttgcaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtttgtgaaggaagtctcgtttatgaagcagcattgtttaataaatgggtggaggccctgggtctgaggatggtccagtagtgttggggtcaggaatcactgagacagcaacccctgtggtgactgtccactgcaggactgggtggggtcagcacagtgagatatgttagcaggtgtgctgacagcagaatgcaagtgaccttcatctatgtctgtcttaaaggtctgatgctacaggacttggtttcagctaagctgatttcagattacactgttaccgagatccctgataccattaatgatctacaaggttcaactaaggtaaggtttcatcatttttaatggtctgtcaagatattttgttttttccccttttgctgtatcttgaattgagtgtatattagcgtttgcattgtctttttcttaagagacagggttttattgtcacccagtatagtggcatgatgatagctccctgcaacctcaaactacagggctcatgcaatcttcccacttcagtctcccaagtatatgggactactgtggtgtgccactgcgcctggcagcagttgtatgttttatacagataactttctaaaaacataagcagaaatcaaaataaaagataaaatttgcccacagtcctgctatctgcaaattaaattgttcatgtaaaattttttagtgtttttgtttctatgaatttaaaatatgaacatgtcttatatctgaaggtcagatacagaagttatttttctagggtaattgtcctctgaatatatgaagaaataatgttatttgatgtttcctttaaaaaggaagtctgaagctgggcgtggtggctcctcgcacctgtagtctctgctactcggaggctgaagcaggaggactgcttgagctcaggagtttgagaccagcctggccaacatagcaagacccccttctcaaaaacaaaaaaaatagggcagggggagtctttgctaacaatttagagaaagaggtgccaggaattaaaataactataggaagtaagataaccatagggtgtgaaggcaccttggcacatagtgaagctgttagtccttccaaaaaggagaagactccatttctgtgcatggtgaaggggatgttcagggctggtttcctgagggcctgggcctttccatggggcaaccatgcaggtcacactcctcctcaggccaggtgggatctgggggctctctttagtgcccctactggacatgtctccagagccctagaaggctaaactcaactgcataggacacttctgttccccttcctaccacagttgagagcccagtactctggtattacctgctgtgggcaaccttgggggatcaagccctttcagaaagctgtttttgaaaaacagtgtgaattgttcaaccaagtctcttctttcttctcaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctggggggtacgtgcttgacctggggaggtctggtgggtggctgcagccaagtctcaggcttccttctcactgtagtaaccgtctggcaggtgttgggcaccagtgtgagggctgcacgtccacctccgtgtgtctccatgctgtgctcgcctgcaccttcctttggtcctttgggttcatgagccagaacaagctgggttttgtggagtgggggctgttagcctttcctgaccagcaaggcagtccatgggagttcactcagcttcaggagaaaagtgacaagtggtactgggaggaacaccaaccctgatcctgtcctgcctgcccacagggtccctgttttcagaacagacaaggggcaaagagcatggggaccatgtagccctgtccccaagccgcagccatggcactcagtgctgatttaacattctttctttgtcaaagaggccttcttctatggctctggctgtgcccctgttcctggctgaggtctttgggctgttttgacacagatccgacaggccatctggctggctcaagcccagtatggcatggggctgctccttcctatgcactcagaagggaatgagctgcttatctggcagaagttgtggcattagcacagacactcccctttgggcctcaggcgcccttctaaattgtggtgtgtggtctgtagtaggtctaactcatgctcattattgaaggaacccaaagggaagcaaaccactcagcacaagccctcggtgctctggttaggttggggttccccaaaataagctaagactgcttataccagactcatctgggtgcttgttaaaatacagatttcctaggcacaaccacaggcctgtacagtcagaacttctgggtagaacttggctagcaacactgttaagggggactgtctgcatccctcacctagaccctgggagcaagctgctcttccccctcaacaactgtggttctgctgtgtttagaaagcagacttctcaacttcacagttgccttctcctgagaaaatgttttcatgtacattttcacctgtattttggccaaacctgtaactaatgaggcactttctccccagccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcaggtaattagagcttgatgcaatgggatcagctcctcacgagactttcctggtccagtttctgcaaaggaagatgtttagttgatgttgctgcttttcttttgggtctctatccttcctttccttaggacttccctcttcaagtgagtgacttaaaaacattgagacaggctaggaagtttctggtagagcctgaactcacctccctgaaacaggccccctaggatggctcttagagaggattttgtggcttttgagtagtcattactggccctgccagtctcgatgtaagcttgtctggactttgagtgatgcatggaccctgggagcctatttaacccaagtgtggaagtcacataattgtgtgactttaatcaaaggtcttgcacttaaatcagtgaatttaagcacatgccacctgtcgctgtttaaatattatttgtacctgtttttgtttttttgtgtgtgttttttttttttttgagacagggttggccaggctggcctctttatctgtttttgtattgttttctcagaggcgctgagtgaagatggtcagatatgtgtgtatttttttaaaaacgatttgaaaaaatatgatgttcctttgtcgtgggaacaagccaggttgcagacgcagaaggagctacagctgagagagggacggtgaggttcatgttcagtatgtttctgttgcttgctaaactgtatttttcttgcaaagtaaatagaaattaacatcctacatgccaaatccagtccactgtgggcagactgtgacaaatcctcaaggaacagatcattcccatgcagtagaaactattctagaacaaagttaaagcatctcacttcatttatcaggcatacctgaccctgaaatcatacctaaccaggagagtacagctgacatttcatctcacttccaaatttggttccaaagcacagtacctaaaaaagttcacaagtatgctttctcccaggataaacaataacagtgaaaatctattaatgtaatttgttgccataatagaaaaataagtggtaattttagcaggcgttgaaatacgtttcttaaaatttatacctgttcctgataaaatttctttattttgggtactttctttagcttgggttaaaaaaaaaaaaagtcctaacttgataaggctacctaacataaaactaccaaaatagaaaaaaaacatgcttcttggtagaatgttaggaacagtggaatcagaaccagcctgttgtcccgactattattcactattgtcctggaaatcctgaccagtacagggatgtgggatagacaggcacaaatactgaaaggaaggagaaactgtcatttccagacagtacagttgtcagtccaagaaaagtcaagtccatagaaccattctcagttcaataaggtgatcagatagatagatccacaacatgttaaaaaaaaaaaaattctcattcacaacaataaacctgaacagaaagggcacaggatggtggaactttgctgttccttcttgttccccatagagatccttgaagtaccttctccaactccatgatactctaaaaactgttcatcttcataataggagtggagcctaatccttggtctcctcacctcctggtttcccggaatgtctttctcattaacatatgagttctcagggcctgtatgtgcaaaggaaacctgaaccattgaggttcagactaggttgttgacaggatacaatgctgtgaagatgtcagtactggtaagttctaaaattcatcaggataaacaaatatgcatcaattgctgagaaagttttaaataagactaacatggtttgcttggcctgataccaagacatacagtaaagctccagtacttaaaaccatgtggggatgccagagtagataaatggatcagaataaagagtcagaatatgtgacaaaagtgttaggccaaattattgaaattagtggggaaaagacaaacattggcatgtgtttagaaaaaaatgtcagatgccttctctctcaccatttgtaaacattacttccaaatgtatccaagagctatctataaaaaaccttgccaatactagggaagaacagaatctggaaccctagggtgggaagcaagacatgaagcagagaaactccaaaaacctagctgcctcttgagagcagaagcttccaagaggaacaggcagtctcaatgcctctgtgcataagggtccctacagtgcaggggctgccttccctctttgctccactccctgacttgatggaagcttggaagcaggcatggggccagcatgagctgttccaggagggcacatgtgtctgaggcacatgttcttacatgttaatgcacatgtgcaaatgtatctacatgctttacatgatgctgtagaaatattttctcttgaccataaacatttcaaatcatgtacttacagtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtgaagcccacttccttctaattcatgtgtgtttagtctgctttatgctgtgaggggagactggttattgcttgattaatataagacagccaggatggagaagggcaggtggattattagcaacagttttagtgatgtaactatttaaaagctctttgaagacagaagcagtgccctagatagtatgtttctaactgtttatattgaagtgaatttcatttattatttattattgaaagtcagtgttaagtttttctgggaaattcatgtggttaagtctgctcagaagatggtgagtgctgaacactatggctggccacaggcaccctgcccttgggagcctgaggcattggtggatcatcccatgctgtgaatggacaggagctggggctgcccctcctctacattgcccacttccctccctcccatgcatacctttcctttgctttcatttgatggccatgtttaccattttactgagtagaatcaggaataagggaccttccacaggttgtcctctgccttccctgccctcccagccacatccagcatcctccctatatccccttcctgacgcctcttgttgctggaaacgaaccatgcagctcgtagtcagtcagcccttccctgggctgggatctcatctcccacctacccaaggacattcattcaatgagtatctctctcgtgctaccacccctccccatattaggtggtgcccatcagcagcacacagacatgaaacatgcctccctgtcttggtcccacttccctctttagccaccacttcatgtttctgccctcttaatggtaaaactcctcaaaaacgcttgtgatactcacttcttcagccttctttcccatggggatgaaggcccagggttgaacatgaccgtgaatcccagtccttggtagcatcccatacttgatcctcccctccttgctcctaggatgtccgtggtccccctcctgccctgctggttcctcctcatcccccagctgccccctggattcattctctcaacctctcctctgcatcgtctgtacctactcctcagaaatttcatccagtttcatggatttttaagtaacatcactattctgacagctccaaatttgtatctcaaacctctgaactccacacttgaacatgctactgcttccttgaaatcttcattagacacctattggatgtctggtagccactgcaaagttaacatatcccaaatccagttcccggctttcttccaaccaaccccttcctttggtggtcatctctgttgatggcggctccatccttccagctgcctagatcaggtgccttggaatcatcccctcacatcagcccattcacatatcctattggctctattgaaaatacattcagaattggaccacttgttatgacttccatggccaccacgtggctcaagccactatcatcttccttctggattattacagtaggctgcagtttagtcttggtagacctggtgggtgcctttcaagtgagttaagatggaggtcgtgtcacttgcttgcttacagcctctcagtggtttccctctttcacctgcaatcaaaggcaaactttgcaggggtggccagggccctgagtgatctgccccccatttcctctctgacctccgctccttccttgagcatggtaggcagttcacagttgggcctctgagtttgctgttccttttgcctaggactgtccagcccctccattctccccagcatccccatggctgatcttgtactcacttcagatctctactcaaatgtctgcttctgttaggccctgcttgcccatctccgaccttcttgtttccatggctctgctttgtctttctcatcttcaaaccatgtttctcttgttatgtgttccttgtctgtctctcctcactaaagtataaattgcttagggcagggcctctgttttgtttcagtgcaatattccttgtacctagaatgatgcctagcatctggaggaggcttaatgaatatgttttggaagggtgaatgaatgtgtccgattactaaaatcagtctctataatttaagtggtttgggatgagatttttttttcctttttattagatagagtctcgctctgttgcccaggctagagtgcagtggcacaatctcgactcactgcaacctccacctcccaggttcaagcagttctcctgccccagcctcccaagtagctgggactacaggtacccatcaccatgcctggctgatttttgtatttttagtagagacgcagtttcaccatgttggccaggctggtcttgaactcctgacctcaggtgatccacctgccttggcctcccaaagtgctgggattacaggcatgagccactgcacctggccaagattgtttttcttgaaaagaccggtatatggaagtagacagctctagagtatgttaggtggcagtgggatattattttgagttaattttaagctataagcagcaatccactcatttggaaaatgtcagaagaattaattatagatgcataaaaccaaagtaaattaaataagataagccaaacaagacaattacaagtaatgttaagtaacacatcgaagcagttgtttttggattaataccacctttttcattaaatataaattggaattggatttataaattaaagggaagtggtttctctaatttttttttttttttttttgagatggagttttgctcttgttgccctggctggagtgcaatggcgtgatctggctcactgcaacctccgcctcccgggttcaggcagttctcctgcctcagcctcccaagtagctgggattacaggcacgtgtcaccatgcctggctaatttttgtatttttagtagagacggggtttcaccatgttgatcaggctgatcttgaactcctgacctcaggtgatctgcccgcctcggcctcccaaagtgttgggattacaggcatgagccaccgagcccagcctagtttttttttttaaattaagctttatcataggaagttgttaaatttttaataagtacatttctgcttctcagttgatgtcataacttagttatattcttagtaaaaagcaaaggcttaaggctgggtgtggtgactcatgcctataatcccagcactttgggaggctgaggtgtgcacatcacttgagttcaggagttgtagactagcctgacaatacagcaaaatcccgtttctacaaaaaaatacaaaaattagctgggtggcatgcgcctctagtcccaggtatttgggaggctgaggtgagatcatttgagcttgggaggtcaaggttgcagtgagccaagattgtaacactgcactccggcctggccaacagagcgagaccttgtcaaaaaaaaataataataaaattggccaagcacagtggctcactcctgtaatcccagcactttgggaggccgaggtgggtggatcacctgaggtcaggagttcaagaccagcttgggcaatatggtgaaaccccatctctactaaaagtacaaaaaattagctgggcacagtggcacttgcctataatcccagctactcaggaggctgacgcaggagaatcacttgaacctgggaggcagaggttgcactgacccgagattatgccactgcactccagcctgggcaacagagtgagactctgtctcaaaaaaaaaaaaaaaaaaaattatataaaattttaaaaaagcaaaggcttaaaaagtttttaagtatatatagaagattaatgaacaatagttaacttcctaatgctcaaatatttttgaatttattacatattgtttcaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacaggtgagaagaacgtatacatttggcatttacataagaattaaagattgagagaatggctggggaaaaaagtaatatcacgatttatcctatgatgttttgatgaccgacaaattattagctcaaattagaccttttcttaaactttatccatatcattgttaaagagacccaactgattttgagtttctgcctacgaaataaatgaagaatagaattgaaatattcttaagaactgaataagacctgtaactgtgtgctgatgtgtaattaagggcattaaggtgatgacagcagcttctgttggagcacatattgtctgagctttggcattacccagacctctcttctgggattaatttttcctgaggaaaactaatgaatgaggaaggtaagctcccagaagtcaagagcctcacccaagagtgttcaagtagtgagtggtcaggttgcttttcaaagccagatccaactggctccaaagcctaaggtctttttaccttaccattcttccttcagtggttaaagatgcaaaaacagagtttcaatcacagatatgtgccactgaacaggtaaaaactgtgctcctggactggctttaggaagtccttcaatagaggagaaaagcaaattaaaatgatgtactgtttccattcatcagtttggcaaatactttaaaaatattcataccctttgaattaccaattctaacctaaagaattctgacctaccagatattccccaaaaattaatgtataaaaatgtttactgtagcattattgtatgaaagtcgaaacagaataaatatccgaagatgggagtctgattaaacaattataacacattcatgtgatagaataattcacagcccttgacgatgatattttctaaaaatgactggctgggcgtggtggctcatgcctgtaatcccagcactttgggaggctgatgagggaggatcgcttaagtccaggagcttgagtccagcctgggcaacataaagagatctcatctctacagtacataattagccaggcatggtgctacatgcctgttgtcccagctactcaggaggctgagctggtaggatcacttgagcccaggagtttgaggctgcagtaagctccgatcataccactgcgttccagcctgggtgaaaaatgactgacactggaaattgttcatgatagaatacaaaggcaaacagtctatatacagataccagctgaatgtacgagctaaatgaggctggaaggatatacaaaggataatttttttccctctgtaaaaataaatgactactcagatgaggtttctaacatgatccagatctagtaccttcccagagataggtcgtggtttattgacatcccaaaactgttcagtttcttttttattcaaatagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtcagtctcccagtttttcataatgaaaagttgtttcccctgtgtgacctcttcaatattctcctatattcatgacctcctcagattgtcacccaccagcatatgctctgaggcagtttagagcttacatttccatgtataaaaggcgattcattctctcagcaaacttgcagtccttgatgtgccagacatcagtgatgcagagataaagtaagacacagggcctctgcctgctaagcccacccagcttacatccaggagagtcaggtacttatgtacataattctcagagaatgtgcatgaggcgtgggcctgaattggtagcaaggaaaaaacagaggatggaacagggtctggttgggtagaggagaaacagaattcccggagaggagtgcaggggtgtagctggagacagtgtacttgagaggacatgatgaaagcgtggaggtaccagcttggttgtgtggccaggtgaggggaacaggccagcagggtgaggtcagagattcttgtcaccttcttctgagagctgtgagaacccgttgttgaagattaggcagagaagtgatctggtcacattttcttttaagaatggcatgtagggcaggaatcttgagaggtgggtgctgcagccatccaggtgaaattcaaagggaataagcctgagtttgttagcaattggtgtgaagagaggggataaaatttgagccatatacagaaagaggtattaatagacttggtgatgttgcgtatgaccaccaatcttaaactggcactcagcatctcctgactgtaatcctacatccccagactctatttcatgtcttctcattctcttcaaacctccaacattcttagatcatgtcctccttatttcactgagaaaacaacagcactaagaagagaacctcttcctccaccaaatcaatccctgcttctccaaacacacactactcaactcagggatctttagtgattagcttcatgtaaagacttaaataatgctatttcttaatcttgacttgacattgttgacttcctacaatggaagaggagttagcttctcttacactgtctttcccacaacatattatcacccccaccctcgacacccacatttcctctcctattagtctccctaagcagtttgatattggctgaaacctgcattcacagtttagtataactgtatgtttaccatttcctgttgagccctttattggtttatgattacatttcctttaggtacaacttttgatttttcctggagttaattacattgtttttctcatttgcttggttttctatgctcttgtcactactttacccaaaagtcgctgccctaaatgtaaagctcttcccaacaaagtcatgtgcatcaggtaatatgctccactttctcttcgagatgttcctgagaaccccctgtcttcttgccataacttggacatttcctggattctgaatcatattttcctcttgcttggttttctcttcttgatggagcctgtcctttagtagcctcctgagcttgaatatctaaaatgtctttatttctactgtaatattatcaaatatatatctggtctttgtctctgccttctgatatacaactcctaaaatccttgagatctctaaagtgatgtctttttgtatgctagtaagatgactgatggcggacagctcctatgtagcttcaggatagggactggacatctgaaagaccagggcatgattagaggggttgaaactttcagcccaccccccaaactcccagaggttgggggagagggactgaaagtgacgttgatcgccagtggccaatgatttaatcaatcatgcctatgtaatgagggctcctaaaaacccaaaaggacagggttcagagagcttgtggatagccaaatgtgtgggggcttccaggaaggtggacaagaacacgtccacatgctgagagaatggcacttcgcaactccttgcagacagaagctcctgctcttgggactcttctaggcttcatcctgtgtatcttttcatctggctatttgtagcctttaaaatagccttgtaataaacatgtgtttccctgagttctgtgaactgctcttgtaaattaaagccaaggaaggggtcttgggaacccagaaggacaggtaaaacaacctggggcttgtgattgacactggacatggggctcagtcttgcggcacagagtcctcaacttgtgtgatctgctgctatctccaggtagacggtgcaggattgaagcggatacccagctggtgtctgctgtacagctgaatgcttgcttgtcggtggggagaaattctctacatctggtgccaaaaggatgttgtgagagtaaagaaatggtttttttttgttttttggacttatctatccttacgtttgattcatcatttgaatgagaatagaattttagattggaaatcgttcctttgtgtttttgctttttttgttgctggaaatttttgagatcatctctattcctggtgttctcaaatttctcaatgacattacttcatatgttgcctccccattccctccccaacccctgcccaatttattgtgctgggcactttgtagtccttttttctagtttttttgttgctattgaacaaattaccccaaatatagtagcttaaatttgaggaggattcagctgggcagctttctgttgggatctctcatgcagctgcagtcaggtattggctgaggttatagtcatctgaaggcttgactgggtcagtggtccaagatggatcacttgcatggctggaggtaatgttgcactgttttccccaaatgtctggctcatgctgatgatggtgcttgttggaaactgtcaatgggtacagtctgccagctaataggtttgtttttctactaggtcatagttgccagtgtttgcaggactcttgtgggccagctgctccagagggatcctcccactatctcatgctatctggctaagtgggagaagtgagcctggacccacatgtgtagactttaactcaatctgtctgctttcagtggtcctcagctatgcctcatgcctgaggtaacacctactctgattcaactactggagacttcctccacccaagtaggagaggggatctatggtcatactgttcctcacaaaaattttccaccagttattccaatttctgcaccttcctggtatttgctggcaggaatggtctcttgttggcttcacccacaaacgtaagtctcaactttctctagctaactcagttatcacttctccatccattcccagtctctataattttgttgacttctcttgcttactagtgtctcctctcccattctttgtggggtttttttggtcttttattactttatgtgagtagggtttgggcaggaaatggaggttaatgtttatgctcagtctgccatgtttaactgaaaatttctttcaaaattctgccattaggcttttccccccatgtctctttagatagctcttgtcagtcaccaatacattgttttgttgcatccaataataaattctgtcttcattttgcaatcccttcaaagcctcagcaaagatcaccatgtcttcacttatattatgacttcatattcctctggttttcctcctctctctggccattcctctatactggaaaaggtcggtgccccagggctcattctagaacttctcttttttatgtgcatttcctaattcatcttgtccaatctcatgatttcaaatactacctgaaagcaaatgactcccaaattcctatctctagcattatgttctctcctgaatgccagcctactcaatatttcacttgaatgtctaataagcatctctagtataacttgtccccactttaatctgaattttccaatcaaactttccctattttaggccaggtgtggtggctcatgcctataatcccaacactttgggaggctgaagtgggaggattccttgtggccaggagtttgagaccatcctgggcaacatagcgagaccccgtgtctctaccaaactttaaaaaaatcagccaggtgtggtggcacacgcctgtagtcccagctattcaggaggctgagcccggaagatcacttagccctggaatttgaggctgcagtgagctaatgattgtgccactgcattcccacctgggtgacagactgagatcctgtcactaaataaataaaagacacctctattttagtaaatgaccaccaccatatacccagttgttgaggccaaaatcctcagagccttctgtatctggcttaatgaataagctggatgcagtagtatgtaagcagataggaacagtgttttttctcatgactgcccctagaagcttaactgtgtcaattctcagacgtagtttacagctttttcttttctttcagacattaaaaagagcggattattttactcataaaaagtccagtccattaagatatcaaaactcaaactcttatccagttgaaacctcttccctcacctagctttgccaggttcagtgtgagattccatccaggctgaagccccttatccctattcttcatgtttctacatggaggaacttacctggagaaaaacttccagcctctttctgcttccagagaagtagagtgactcatttgattgaatttcagagaacagatagggtggagtgtgctcaggctcctctgggtactctttctggggtctgtgggttgactggaggggtgtcttctggtgggcactcaattgcatagtgcttggtgaggcagtttcatggcctagaggctgggggatatgtttgtctgacttacgggtgatttagtagcttgccctcttgcttgcagatttaagccttgtccttcaagctaggtttttaatttgtggcaaagctgatattttgatacccacccatcttattgctgtgtctttttcatccgtttctgaactgggataggaagaggtgattatccttgattgtctaaaaccccgctattccactgtggggaaggtgcctgtgggtattcttttgtccactctctcttccaactttctcctccggcttgctgtggctcaccgccccttcgaagttaggctgggggtaggaattgaggagtgggtgccgaaatgctcactaggctggggcagttgtaactggatgtcagggcttctgtgggccaggtgaagacatgctggggtcttctgtgggtccttgacctgacttacggaccactggctgcagcctccagacgtcagccatgtttccaacagtcagacgccccctgccctgttgcgcccggctgtcccttccaagttcggtcactcgctctgcctccatcttcctcttccctctgctgctaaggcttttcacctttaatttctcctggggccacccccaactccagcgaccccgtgagcagctgaggctctaccgcgctcggtcctggccagcgacgcagcccttccctggcggggctccagggcttctggcccctgtggtccgccaggtgtgggggcccacggcctcaccgcgcctaccccactccccccggcgaagctacgcggcgctcagcttcccagggacgccggcggcgccctcggctcctccgctccgccccgccctccccctggtctcgcactggagccgacggcccgcgcccacctcacctcagggcggcctcccgcccccacccccggccccggcgtccgggcaaatcctgcagcgcgagagcaattccctgccacccgaccttcgcactcgctgtcgctcgctcgagcctcgctccccacgtccttccttccgacccgcggctggaccctcctcacaaatttctcagagaggctcacctcaaagcgcggcgcacgaggccgggctcccgggacgcaagcctctagagggcgcgcgagaggccccgcccccgcccttcggccccacccaccagccccgcccccacccgcacccaccaggccccgcccccacctccccacccaccagccccgcccccacctccccacccaccagccccgcccctcatgccccgccaataaggccccacccgcctcccccgtcccgtcgccttcacccaccatccccgctccctcaggccccgccccacgccgcatggggcaccaagcgctccaccactgtggtcgcctggcacaccccggggtcacgctcgcggcgctctgattggttgcgtgggcgtcggcccacctaagcctgagcgcctgccgaggcctgcgcctgcgtagtgcgcgcgggaggggcgggaggggcgggaggggcgggaggggcggggctgggcggcaggtcccgggtgcggacatctggcagctggcagtgggcggcgtagagcactgcagcagcaatgacggagggcacgtgagtcccctcgccccgggctcctgacgaatgcggggtggtcctaggtgctgaggagagcgcgactggggcagtgggccggcggccggcgttggggcggggcctgggtcgctgatggccggtggtcctcaggtgtctgcggcgccgagggggcccctacaagaccgagcccgccaccgacctcggccgctggcgactcaactgcgagaggggccggcagacgtggacctacctgcaggacgagcgcgccggccgcgagcagaccggcctggaagcctacgccctggggctggacaccgtaagttgcttccgcggagcgtcagcgagctcgggaccctgaggggtgagccgtgaggagcacgttttctctcagaaaggcgggtgggaggacccggccagcgacgcccatccccaaggcgagcgcccacgggaactgcgttcgcgggcccctccgcttcagccccttcatctctaaaccacgcataggagactcctaatgttttattttttagcaccttattttgagataatttttgacttataggagagttgcaaagatagttgtaactttgtttttattcacaaaaagtgtttggatccactgtcttagttgtgtgcattgtaagagattttggtcgtcagagtctgcagtgtaaacagggtctcctgccgagccccggccaccgagggaaaggctgtgccgccccttgggccctctttgagaggcccgagtcccaggcccaggtcggcacccgtgccccaccctacagtctgggtgcctggtttattccagacatcttggagaagttgtgaagaatacatgactggcaaataaagcaacgaaaatgtgcagctgttcttttactttgctgaggtgtgatgctctcatcaaagagtttcagacttttgatggaaacagctgaaacttttaaagtaatttacattcactgttttgacttgggctgtatgtgaagagggttcctctggccgggcaacagtcccgtcagctatctctttttttttttttcgatctctttgcagaagaattactttaaggacttgcccaaagcccacaccgcctttgagggggctctgaacgggatgacattttacgtggggctgcaggctgaggatgggcactggacgggtgattatggtggcccacttttcctcctgccaggtaggagtatgctgccccagcctgatggtatggccaccctggatcacccttgggatcctggcccagcctggtctagggttttgatgaagcaggtgaaaatccaggggctcacaagaaaagggctggcaaactctgccctatgtcagagtcgtcctgctattggtctaggggatcagctagccttgccagtgtagggtgacaggctctctgataagagaagcaagtggttctctagggctctgtgttgccttgagggaggaggaaggtgggctttgaagtctcagtacaggatgggatggacattccaggtggaaggcccagcctatgccaaggggctgtaggtgggcagagtggtgggtggggagctgatatctgctgtgaacttcctcggggctattgcaggagagcttcaggttcaggctggtgagtaggaggagcatagcagttggactgcctgggtattgaactgatttggctacacaagactattttgcatcctgggagtgtttctctacagaaatcctcagccttgtaaaatgggaaattccctcctatgaatttatgcaataggacttttttccctagtgacttgtaatcacattgtttcaatgacgtgaattcctacataaataggttttgtttctgtgataactcttactgatacatcattttcttttactacgctgactttgtaatagatagaaagtccttatatacctttgttgcctttctttttaaaacatctcttacctgtgtctattcatttactcatccaaattgcctttatcctgattttgtcccagacttgaaatgaagttgcaataggcttatatgttagtttgggaagagttggcctttaacgttaaaaacagttccatggtgtttactgtaggccaagccctgctcaaggcctgttcttcttttagtccttagaataagcctaatgagatacattagaaagctgaggcacatttattccaggtaaccagactagcaggaggagcactgggatccccatctctgctttgacttctagccctgctgccacctggactgtacagcattgagtttttctgtcctgggatttgagggcctgtccttaggggaagtcaaggtgctcttcttcccttggccccatcagggcctgtttagactgttctcagggctcgtggtaaggcaatgacatagagttggtcaggagatgggtcagccccactttgcctctgtagcctgacctgtgacaggattggaatcaggtttggtcatgtgcacagtgtcaggcatgcagtggtgcttggtcagtggggattactgtgttgtttgttcttgctgctttggctctgggcttagctggctgggacccttcctgtgggctggctgtgagttggagtttttttgtatttttttttttttttgagacagcgttcgctcttgttccccaggctggagtgcaatggcacaattttggctcgttgcagcctctgcctcctgggtgcaagtgattctcctgcctcagcctcctgtagggtccagccccacagggtcggtaggtttttctccctgtgtgcggagatgagagattgtagaaataaagacacaagacagagagatgaaagaaaagacagctgggcccgggggaccactaccaccaagacgtggaaaccggtagtggccctgaatgccaggctgcgctgatatttattggatacaagacaaaggggcagggtaaggagtgtgagccatctccaatgataggtaaggtcacatgggtcacgtgtccactggacagtgggctcttccctgcctggcagccgaggcagagagtgggagagagagagagagagacagcttatgccattatttctgcatatcagagacttttagtactttcactaattttgctactgttatctaaaaggcagagccaggtgtacagggtggaacatgaaagtggactaggagcgtgaccactgaagcacagcatcacagggagatggttaggcctccggataactgcgggtgggcctgactgatgtcaggccgtccacaagaggtggaggagtagagtcttctctaaactcccccggggaaagggagattccctttcccggtatgctaagtagcgggtgtttttccttgacactgacgctaccgctagaccacggttgggtccgcttggcaacgggcctcttcccagatgctggcgttaccgctagaccaaggagccctctagtggccttgtccgggcttaacagaaggctctcactcttgtcttctggtcactt

SEQ ID NO: 1425 - DNA, 6114 bp, Homo sapiens
gtaatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaacatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcacacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcttgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttgagcagcctgacctgtggggagggggtctctcccgaagagtttctgtttttactcaaaataatgttattctcagatgcttgatgcactgttggaaatgtgattaatttaatcatgcagataaaccatttaaatgtc

SEQ ID NO: 1426 - DNA, 5943 bp, Homo sapiens
atgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacattagggttcacccaaacctcaagtgttggacccttttctggacttgagcacacttccacctttgtggctacctctgggccttcaagttcatctgtgctgggaaacacaggatttagttttaaatcacccaccagtgttggggctttcccaagcacttctgcttttggacaagaagctggagaaatagtgaactctggttttgggaaaacagaattcagctttaaacctctggaaaatgcagtgttcaaaccaatactgggggctgaatctgagccagagaaaacccagagccaaattgcttctgggttttttacattttcccacccaattagtagtgcacctggaggcctggcccctttctcttttcctcaagtaacaagtagttcagctaccacttcaaattttaccttttcaaaacctgttagtagtaataattcattatctgcctttacccctgctttgtcaaaccaaaatgtagaggaagagaagagaggacctaagtcaatatttggaagttctaataatagcttcagtagcttccctgtatcatctgcggttttgggcgaacctttccaggctagcaaagcaggtgtcaggcaggggtgtgaagaagctgtttcccaggtggaaccacttcccagcctaatgaaaggactgaaaaggaaggaggaccaggatcgctccccaaggagacatggccacgagccagcagaagattcggatcctctgtcccggggcgatcatcctccagacaaacgacctgtccgcctgaatcgaccccggggaggtactttatttggtcggacgatacaggatgttttcaaaagcaataaggaagtaggtcgtctgggcaacaaggaggccaaaaaggaaactggctttgttgagtctgcagaaagtgaccacatggctatcccaggagggaatcagtctgtcctggcaccttcccggattccaggtgtgaataaagaggaagaaactgaaagtagagagaagaaagaagattctctaagaggaactccggcgcgtcagagtaacagaagcgagagcacagacagtcttgggggcttgtctccctctgaagtcacagccatccagtgcaagaacatccctgactacctcaacgacaggaccattctggagaaccattttggcaaaattgctaaagtgcagcgcatctttaccaggcgcagcaaaaagcttgcagtggtacatttctttgatcatgcatctgcagccctggctagaaagaaggggaaaagtttgcataaagacatggctatcttttggcacaggaagaaaataagccccaataagaaacccttttccctgaaggagaagaaaccaggtgacggtgaagtcagcccgagcacagaggatgcaccctttcagcactctcctcttggcaaggccgcagggaggactggtgctagcagcctcctgaataaaagctctccagtgaagaagccaagtcttctaaaggcccaccaattcgagggagactcttttgactcagcctccgagggctccgagggcctcgggccatgtgtgctctccctcagtaccctgataggcactgtggctgagacatccaaggagaagtaccgcctgcttgaccagagagacaggatcatgcggcaagctcgggtgaagagaaccgatctggacaaagcgaggacttttgttggcacctgcctggatatgtgtcctgagaaggagaggtacatgcgggagacccgtagccagctgagcgtgttcgaagtggtcccagggactgaccaggtggaccacgcagcagctgtgaaagagtacagtcggtcctcggcggatcaggaggagcccctgccccacgagctgcggcccttgccagtgctcagcaggaccatggactacctggtgacccagatcatggaccagaaggagggcagcctgcgggattggtatgacttcgtgtggaaccgcacgcgtggcatacggaaggatatcacgcagcagcacctctgtgaccccctgacggtgtccctgattgagaagtgcacccggtttcacatccactgtgcccacttcatgtgtgaggagcccatgtcctcctttgatgccaagatcaataatgagaacatgaccaagtgcctgcagagcctgaaggagatgtaccaggacctgagaaacaagggtgtcttctgtgccagcgaagcggagttccagggctacaatgttctgctcagtctcaacaagggagacatcctaagagaagtacaacagttccatcctgctgttagaaactcatctgaggtgaaatttgctgttcaggcttttgctgcattgaacagtaataattttgtgagatttttcaaactggtccagtcagcttcttacctgaacgcttgtcttttacactgttacttcagtcagatccgcaaggatgctctccgggcgctcaactttgcgtacacggtgagcacacagcgatctaccatctttcccctggatggtgtggtgcgcatgctgctgttcagagactgtgaagaggccaccgacttcctcacctgccacggcctcaccgtttccgacggctgtgtggagctgaaccggtctgcattcctggaaccagagggattatccaagaccaggaagtcggtgtttattactaggaagctgacggtgtcagtcggggaaattgtgaacggagggccattgccccccgtccctcgtcacacccctgtgtgcagcttcaactcccagaacaagtacatcggggagagcctggccgcggagctgcccgtcagcacccagagacccggctccgacacagtgggcggagggagaggagaggagtgtggtgtagagccggatgcacccctgtccagtctcccacagtctctaccagcccctgcgccctcaccagtgcctctgcctcctgtcctggcactgaccccgtctgtggcgcccagcctcttccagctgtctgtgcagcctgaaccaccgcctccagagcccgtgcccatgtactctgacgaggacctggcgcaggtggtggacgagctcatccaggaggccctgcagagggactgtgaggaagttggctctgcgggtgctgcctacgcagctgccgccctgggtgtttctaatgctgctatggaggatttgttaacagctgcaaccacgggcattttgaggcacattgcagctgaagaagtgtctaaggaaagagagcgaagggagcaggagaggcagcgggctgaagaggaaaggttgaaacaagagagagagctggtgttaagtgagctgagccagggcctggccgtggagctgatggaacgcgtgatgatggagtttgtgagggaaacctgctcccaggagttgaagaatgcagtagagacagaccagagggtccgtgtggcccgttgctgtgaggatgtctgtgcccacttagtggacttgtttctcgtggaggaaatcttccagactgcaaaggagaccctccaggagcttcagtgcttctgcaagtatctacagcggtggagggaagctgtcacagcccgcaagaaactgaggcgccaaatgcgggctttccctgctgcgccctgctgcgtggacgtgagcgaccggctgagggcgctggcgcccagcgcagagtgccccattgctgaagagaacctggccaggggcctcctggacctgggccatgcagggagattgggcatctcttgcaccaggttaaggcggctcagaaacaagacagctcaccagatgaaggttcagcacttctaccagcagctgctgagtgatgtggcatgggcgtctctggacctgccatccctcgtggctgagcacctccctgggaggcaggagcatgtgttttggaagctggtgctggtgttgccggatgtagaggagcagtccccagagagttgtggcagaattctagcaaattggttaaaagtcaagttcatgggagatgaaggctcagtggatgacacatccagcgatgctggtgggattcagacgctttcgcttttcaactcacttagcagcaaaggggatcagatgatttctgttaacgtgtgtataaaggtggcccatggcgccctcagtgatggtgccattgatgctgtggagacacagaaggacctcctgggagccagtgggctcatgctgctgcttccccccaaaatgaagagtgaggacatggcagaggaggacgtgtactggctgtcggccttgctgcagctcaagcagctcctgcaggctaagcccttccagcctgcgcttcctctggtggttcttgtgcctagcccaggaggggacgccgttgagaaggaagtagaagatggtctgatgctacaggacttggtttcagctaagctgatttcagattacactgttaccgagatccctgataccattaatgatctacaaggttcaactaaggttttgcaagcagtgcagtggctggtttcccactgcccccattcccttgacctctgctgccagactctcattcagtacgtcgaagacgggattggccatgagtttagtggccgctttttccatgacagaagagagaggcgtctgggcggtcttgcttctcaggagcctggcgccatcattgagctgtttaacagtgtgctgcagttcctggcttctgtggtgtcctctgaacagctgtgtgacctgtcctggcctgtcactgagtttgctgaggcagggggcagccggctgcttcctcacctgcactggaatgccccagagcacctggcctggctgaagcaggctgtgctcgggttccagcttccgcagatggaccttccacccctgggggccccctggctccccgtgtgctccatggttgtccagtacgcctcccagatccccagctcacgccagacacagcctgtcctccagtcccaggtggagaacctgctccacagaacctactgtaggtggaagagcaagagtccctccccagtccatggggcaggcccctcggtcatggagatcccatgggatgatcttatcgccttgtgtatcaaccacaagctgagagactggacgcccccccggcttcctgttacatcagaggcgctgagtgaagatggtcagatatgtgtgtatttttttaaaaacgatttgaaaaaatatgatgttcctttgtcgtgggaacaagccaggttgcagacgcagaaggagctacagctgagagagggacgtttggcaataaagccttttcatccttctgcaaacaattttcccataccattgcttcacatgcaccgtaactggaagaggagcacagagtgtgctcaagaggggaggattcccagcacagaggatctgatgcgaggagcttctgctgaggagctcttggcgcagtgtttgtcgagcagtctgctgctggagaaagaagagaacaagaggtttgaagatcagcttcagcaatggttgtctgaagactcaggagcatttacggatttaacttcccttcccctctatcttcctcagactctagtgtctctttctcacactattgaacctgtgatgaaaacatctgtaactactagcccacagagtgacatgatgagggagcaactgcagctgtcagaggcgacaggaacgtgtctaggcgaacgactaaagcacctggaaaggctgatccggagttcaagggaagaggaagttgcctctgagctccatctctctgcgctgctagacatggtggacatttga

SEQ ID NO: 1427 - DNA, 79786 bp, Mus musculus
  misc_feature (5773)..(5875): "n" at positions 5773 thru 5875 can be any base
  misc_feature (9349)..(9578): "n" at positions 9349 thru 9578 can be any base
  misc_feature (17320)..(17795): "n" at positions 17320 thru 17795 can be any base
  misc_feature (18799)..(18844): "n" at positions 18799 thru 18844 can be any base
  misc_feature (26959)..(26978): "n" at positions 26959 thru 26978 can be any base
  misc_feature (38486)..(38505): "n" at positions 38486 thru 38505 can be any base
  misc_feature (66359)..(66506): "n" at positions 66359 thru 66506 can be any base
cttctcccatttggaagagatcttctgctggaacactaaccgcccaagggaattcaatctggggagtctcaagagggagagagactgtccagactacattccataaaggcaagtatggccaggggaggccttggacaggcaaggaagggaaggtaccctagtgagcacaactctggcagacgtgggtacttgcccaggacccgtgcaggaacaacagtataaactataggaactacaagcccacagacgtggctgacccctcccatgcattttactggcagccttgagtttccaaggatcaagagaagctgagtcatccctatcttgtagtccctcctccctttcttttactaatactttcagcagtattttaaatttattttgctaatattttttggattagcttttagattatctttgtgcatttagtgatgtttacagatttttctcattactgggagatatttttcttttttttttttttcttttttcttttttttttccgagatagggtttgtctgtgtagccctggctgtcctggaactcactttgtagaccaggctggtctcgaattcagaaatccacctgcctctgcctcccaagtgctgggattaaaggcgtgcgccaccaccgcccagctgagatatttttctttttctcactctttataaagttctttctttcctcttcctcctctttttcctcctccccctcccccctcccctgccttctgctcttgtcttcttttcttttcgtttctttttttttctattatacatttagtggttattttgtctttgtcatatcgtttttaaaatccacgcttaatttttttgtcactttcttatgtttaccactttttggttttgagctttgtacggtctgtgattacaatggagctttctgggttttatcttatttttatttttcctgacgccttgctctaccctcttgccctctaaaacactctcctctcctcctccgcttattttctctcatatttatttaatcttatttcggtttttggtttgctctttgcctgcctttccccagcattcactgcttccacctttgctctaaatactttttaggttcacagtacagtacagtagttttgccattttctgttttgttttatggatattagtgatatgttattgagttttttttaaagcacgtgtcttacttctatggtttcatgttcctcgtagtgtagtagtttgttttattttctgtaagtggtattgaggcttcaaagacatgctgttcaacaataagaatccaaaataaaaccagaagaaccattcacaccatcagaaatgcaaatcacagtgaaacacaagacttcaaaggggatggatgacctcagagatggcacagacaagtaaggaattcaagtaggacctgaagaggaaaatccacagacaagaggaaacgatcagcagaaagggtgagaaagtcaacaggattgatggagaaccgaaagttagcaaggaaatggagagattgggataaagccaaacagaagcaatggaaatgacaactgcatgaaaacaaacagactgaaacgtaaagcgtaatcaatggacttaagcaagcagaggaagaacatcatggatgaatggatgccaaggcaaaggtcaggctgcatccaaatacagtaagaaaacaggatcgtggtacagtggccaagactctgggatatcatcaatggtctaaacccacgaatctgtggaatggaaaaaggaaatgagacgtaaaactaaagatataaagaatctacccaattaaattataacataactttccctccctcctaaaatctagagcaacaggcagacatccaaggaaaagccacttctcatctatcataatcaagattttggggatgcaaaggaaaggataataggaaaggtttcaggggaaatgccaaatcatcaacacgagtggttgttgttggacaagcatgtttccataccacggagacaccgcagcaacaatcctaaaacacggcgcagtatatatcatgctctgagagcacaaaacctttccgctaaggtcactccctccaccaaagctctctcttagctctgacagagaagtagacatacaagacaagcacatgacaagtttatgactagcaagtccaaaaatacaaagcaaaacagagcaaacctaaaaacacccaaggcatattacacacagaaaaggtggaaggtctcaatcatgagatcacagagaagaatacgtttactgagaggagcagaaccaaaagggctggccaggaatccggcaggaccaaggcactaaaccagcagacaactgactctaagagcagagaaggaatggagctagcaacaacacaacccaaagttacaaaaattaatacacatctgtcaatactacagattatctcggataaagagatgcaaactgaccggctgggctcaaaaagtagatccaagtatccaatgtccccaagaaacataactagcaaaacacacttacagattcagaatcagacagaggctctgagtcaatcaggcaagtgaacagaaacggaagacacgctggcatggcttttctgctgtctgatggagaagagttcaaacaaaacttactcagaagacataaaggaggccccatggcatattaataaaggaaatatttcatcaagaacaagcagcaaatataaatacacatatactgaaaatagatactctccgttttataaaacaaacactaatggacataaaagtttaggtaaatcctgacacaacaagaggaatgacttcagtgactcaatgacatatccatagaggtcatttgaaagcaaaaataaataaagagatctcatcgtcaaactgcactccaggccgggcatggtggcacacacctagcacttgggaaacagaggcaggcagagctctgagactgagaccagcctcatctataaagggagtttcaggacagccagggctacacagagaaacctgtcttgagaaaccaaaaccaaaccaaatcaaaccaaaccaaaccaaaccaaacaaacaaaacaaaataaaaccccacaaaaccacactgtagattaaatgacttctgacatatagagttcaatccaacagatactcaatatacatcaaaaggccctggaaccttctctaaaacagacctcattctacgtccactggtgttttacctcatgtctgtctgtgtgagggtgtcagaggccccccaaactggacttacagacatgtgtgagctgccatgtgggtgttgaaaattgaacccaggttctctggaagagcagccagtgctcttaaccactaagctgtctctccagcccccaagagaacaggtcttaacaaataaaagaaaatcaaagtaatttcttgtatcttattggatcttactgcagtgaaactagagatcaatagcagaagaaaccacagaaactacagaagtacctgaggctgatgactagatttaggaaggaccagtgggccattcaagaaatcgagaagaaaaattcttaaaattaagcaaaaatgaaagcacaacctattagtctctatgggatacagctaaggcagtccttaaaaggaaagtttatagctggagggcttacattaaaaacatcagtgtgatggtagatatgtgaccaagtggactgtctcaaaggctcaaaaacagaaaagagaagccaaaatccaaagcagtagacagcaagaaataataaagagctgagcagataaagaactgtaaaaacctatctatataaaaaaataataaattcctagacatgtatgatctactaaacttgaatcaggaatatataaccaccttctaaagatctataataatcaacaagattgatgcagaaatcaagtctctaacaaaggaaaactcacgactggaaggcttcactactgaattctttcaagaaaagccaaatctaaaagtcctcaaactgttccataattagaaagaaaaacaacacgaccaaactcactctgtgaaataagcatgacttttgtatctaaaatagaagatggcacaagaacaaaaaagaaaactgtaacttccatgatgaacatacatacaaaaattgtcaataaagttctttaaagcttaaagctagatcaatagctcaggcagctctgcctttagtcctattcccagaggatatagtgcttgcatcttgcctcaggcattggcacacatgtggcatgcacattcacatggatagaaataataaaaaaacacatttgtacactcttgaaaactaatttttacaaatgtacattgtgattatacactatggtcaagtttgtctcattccaggaaggcaaggttggttcaatatacacagatcagtcaagacaacgcagaatataattatcattttattagatgtagataagtcctttaacaaagttcaacatcccttcatgatgaatagcctcagagaaactcacaggagggacgtgtgtcaacatagtaaaggctacatacgaataacacacctatagccaaaagtatattaaatggaaaagactgtaattgtttcctctaaatcaggaaggagacaaatatgctacctccatgagtcctactcaatccaatgatcaaagtcttagctaagcataagacaagataaagaagtaaagtggacatgagtaggaaagaaggcacatggcctttttacagacaacatgagcctatacctaaaagacccaaagtctccaccagaaaacacctagacccgataaatactttcatacaaagttgagtagcttttctacatgccaatactgaattttccaagggtattaaatcaagggggaaagtcctaatcacaatggcttaaaaaacgaaataaatttacaaataaacctaaccacccaaccgaggagattaaagactaaataaagactttaatactttaaagaagttgaagaatacaccagaagatgaaaagatctctcacatgctcatggattggcagaagtcagtcgggagaaaatggttccattactacaagctatatagaaatgcagtgcaattcccatcagaattctgattggcattctttacagaactagaaaaaacaactctaaaattcccacagacgcacaaggtcctgcaataatcaaagcaatgctaagcaagggcaacgctggagctgctgcaatgcttgattttatactatattacagagccattgtaacaaaaccatctcatcctacagagccatcgtaacaaaaccagtacagcaccagtgcaaacccagacacatagaccagtggaatagaagacccagaagaagccacacagctatggctacatgttttgacagagatgtaaaatacatacttgggaaaataagacagccttttcagtaaatggtactgggaaaaactggatattgattgtagaggaatgaaactagatacatagctttctcttggcacatacatatgtgcacacacacacacacacacacatcaatgaaaactgcatcacaattgtagtctcagacctgaaactttgaaattgcttcaggagagtatggtaatatatttcaagatacaggcatgggcaagaacttcccaaaaaggtctccaaaaatacagaaaacaatcccaagaattgacaaaggggattacagaaaattaaagggtttccttcccaataaaagaaacatttgctaaactgaggaggtagcgtttacaatgggaaaaaaaaacttagctaatgtatactagacaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtatactagacaaggagcttacatctagcaatatatgaaggactgcagtaaattaaatatcaaaagtaaattgttcaagctgggcagtggtggtgcaaccctttaatcccagcacccaggaggcaaaagcagggaaatctctatgagtctgaggccagcctggtctacagagtgagtttcagaatgaccagagcagcacagaaaagccctgtttcaaaaaaccagaccaaaccaaactaaaccaaccaaccaaccaaaaacccaaaaaaacaaaacaaaacaaaacaaaaccagcagcaacaaaaatcattcactcaaacagttggctaataacctgagtagacaactttcaagagaacaattgcctagttaatatttgaaaaaaatgttgaacatccttaaccatgagggaaatgcaacttaaaattgcttttggatcccatctctccccagtcagaatgactgtcatcaggacaacaaacaggaacaaatactggtgagggtgcggggtaggatacactcctacacactgctaatgggaccgtaaactcaagaagccactacagaaataagtgtgaaggccgtgtaagtcagctacaccgttacacaacacaactcacacacatacacacacacacacacacacacacacatgcacaccagaaacacttgcacatccatatttactgctgcactgtcattcataatagctagggagtagaaacaactgggtgtccatcaacagggaggtggatattggaaaagtggtgtatacacacacatgaagctgtgacatttgcaggaaaatgggtggaactgaaagtcatcctgcgacagaaagtacactggactctagaagacaaatgcctttgagtcctcttatctaaggagcctcctctctctctctctctctctctctctctctctctctgtgtgtgtgtgtgtgtgtgaagtagaatgtgcacaaggggggaagaactgttcttgattgcgaggaaggggaaagaaagggtaatagaatatactgacatgagaacagaaggaggtgctatttaagagggggaaaaggaccaagtagaggagggtgagggggatgagagaggacagtgggagaagacaatgagtcagaagaaagtgatcacacacacacacacacacacacacacgttataatgaaatcaattactttggatgctatttaaaatgaatgagattacagtaaaaatgccagtccctacatctgtctcctttacaactcagcttttatcaagggtggctaagacagtttcttggggtgcaattgtgacaaatgactcaggattactgacgagatagagcgtgttttatacttcccagcttgatggcatctgcaaattgccccttccatggctgtaacagacatttaatagctgtgcttaagggctttaaaatacttcctatccaatcttcaaaatgtctctttaagtatgatgatgctattatactcaatcctcgtattctgatgagaaggatatatttttcattacatggataaacaggaagcttaggaaattgaagtgactgtcttggtaaaagccttgattgaaacctgggccacctagcttctactgcataacttcttttttaggactgtctactttatgtgtatagtgttttgcctggacatatgtgtaatacatgtatgctcagtatccaaggtcagaaggaggcctgggattcagttccaggagactgagatcctaaattacagatggttgtgagataccacgtgggtgctgggaacacttggccatgaattttccaacctaggcttgctttgtttatttgaaaccaagtcttgctatgtagcccaagctggcctggaactcagaaccttcttgccccagcctcctgagtgtggtatcacttatggctggctttatagcacaacagcctaagaactatacaaagatatagaacacaagggctgatctcacacagcgatacagtcttgttactgtttgcctatggaaggcagctctgctaccacagagaaaggacagaatcttgcctcctgtctctacacccagtgccacagcagacaactagctattgacttttatttttccagtctggccatgctaaacgtcctaaatctaaatgtcttatcttccaccccatacttgtttgtgcagagtttctgaaggtcataaaagattttgtccgattcctcagaactctcccttatctttattagagaatgcaggaactctgtgaaaagattaacaggtggaacaaatctctagcttatgcctctactaggaatcgcatctagtgctggaaagcattctactacagagtgaagagagatcaacattcaagactatcattggctcactcttacctcaccgagaatgattttcactgtaaatgagaatgaacaagttactcagttttcctgtgtgggttgacaaaggacttaaatcctataagcttactgttaatcatctatttttttcttgcccaccttatctttagctttggtgacatttacttaaaagaaaccatgcattgtgtagtggcccacacctttgatctcggcattccccaggcaggtaggaggatttctgtgagttccaggctcacagactcaaaaataaaggaaaaaacaaaaaaaacaatagatgtaagatctgaataacagcatccgtcacgtatataaggggacgtgggtgttgtgaatgcttcatttcggttgacaaacctggggctaagagaaaaaataagaagccctatacagaatgaccccagttatttctttgtcttcttatttagcccctttccttttactgtcttccattgagggttctttcttggtccttaaaacacattcccttttcagaatccttttcattgttagcttctttcttgaaaccagatagttccaggactggatcgttctcatccttcacatttctgctcaaatgccactctaagaggtcttttctggtcatctcaaaataacatctccactcacctttgtgtgtgtgtgtgtacccgttactggcaatcacacacaaagagcagtgcagatttaaagcctcttttctggcttctatgagaatagcacatgcagaatgggtgctgccttcgtctcctctcctgggagcccttgcctagcagggaacaaattcttgaatgaatgaacgtggctctttgggaccctatacgtcgtttcttcttccaagcggtcccttcgcagaagtggtggttaactgaagtcaggtacttgggtctcagcgcccggtccacggtgccacgtcccctgggccgagcgcttagggcagggagccgcctgtggaaacgaaagcaggaaggggaaagtctccgcggaggcagcggccgccaatcctatcagctcggacgcagcggggccttcccggccgggctgactcattcccagccgtctctccgcgagccgaggccgcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctagacctcggcccgcccgacgcgtctcggaggagcggatcctgcgcgcctcggggcgctcctgtgtggcccgacccgtgtcgccggtgggtgcagtccctggctgctggatgggggcggggggcagcggttctccctgcgatcccgcctcctgctttccccttagccccctgctactggcagggaacttcaaagctagaaaacctgcgggtttccgacagcctaggaaggagtggctagctgttgataaatgcatgcatccccttgtgccttagaacccgaccccccctctttcttattcttctgtacatttttctagtcatctaaacagcgcagaaaaaaaaaaagagagcatctattggccctgggtttttgagttagtgacttgctgcttctgtttttaggttcctgaagcaggcgacgggaacaagatgtgaactgttttccctccccagaagaagaggccctttttttccctcccgcgaaggtgggtgttagcgctcggggctgcctgggtgctgcagttaaagacaagggtgtctgagatctgcgagccagtgcctgctaagaaggctggatgcttgtgtacaacggcaggactaattgttgcttactgcgaaaatggcagtgttgaacttttcctgttgctgtgggagagtaattgggtggtatttattgtgtctcttggatccttaaagaagcggtctttgttggttttacagtgtggtcttgcagaggaaaacaataagtcgtctctttctccccctttctccccagtcttaattttcaaggaattgaaataacctgttgagggaacaaattggttgtttttgctgggtttctgctgccacattgaatgcttcctgtattcacctgcttgctttgttggttgattgctttccggtggttactagtctatcaggggaaactccttttccctgaatgaaaggaccgagccgctgagtgtgtcacagagaggaggagaaatgcggagaagggaaacagaagtgggaataaagaagccggaggttgcttttggtttcataataggtttgtatgagtgagttgttggcttactgcaaatattctcatatagttcccagcggatttgaaaatgaatcatcaatttctggtcctctttctctatatcctttacctgtttactgtttacggttccagctattaagatcatttggttgtatgtgagctggcttgagtgtgggacgtctgcagactggatgtgcccaggacttatcctgagagtactgagcggtgctacaggcatgagcatttacctgtacaggagagctgcagtgtgtggaggctagataagcacttatgtttattttggcttttgtggagtattgtggaacttgctctgtagaccaggctagcctccaactcagagatttcccctgcctctgccttccaaatgctgggattaaaaccaccacccaccgggcttcatttgtttcttttagtgtcttttcctttgtaatttgaaggtgtcttgagtaaggtgtcttgagtgtgaaaagtaaacatatttttttttctctactttacccagataggctattcttgaaagatgggatccctttctggcaaaatagagaagaccattggctttggagttagatctgagcgtgcagtcttaagttaggataatggtgttcttcccatttaacagcagtgttaacttaaaatttactttctcagaaccttgtgtgggggtcgattggatgcatgcagagcagtaaatggtttggtcgcttctgaacgtcttagcttctcagagctgggcaggcaaaggaggttcctagctggcccgtgcgtagctggtcagtccctggtgcggcttccatagagcatagagaaactgcatgctagtgtatctacagcctctgtatggaagggtttgatgcctaagccccgtggtgctgccccctggtggttaagatgcgcaaagacttgtcctttgctcctcccccattacactgtttttcctttttaggctccctcgcttagttcttagtttcccaaactgtgtcaggtgttagagcaccagggaaggctggctctcaccacttaacctgaggtagtttcagaggtaggaagttccatccgttcctatgggggtgtgtgtctttgtaaagctgtatcttcagagtttactgtatgaaaagctgctatttagtgtatgacagtgtggaacaagaaatgacaatgtggcagtgcttaggatgataccaaggggctgaggaattgtcagaatcagagcagcaccagaccccccaagagtattaatgctaagttgtttgacccaacaaggagtatttccttggtttaaaaataataaataaattgctaactttcaggattcctcaagtggagatagtctgggaacattttcatttggttgcagctggcttttctgataacagttttcaatgcaaagccttagttcataatggcataatgtcctgcttctaataatgcctgtatgacgtctgctaggttcttctaagaatgcctgcatgctgtctgtgaggttcattcacattgtaattactcctcttgtgtacctgcctctctggacacttcatagtttttattttcttctgcacagggctcttaccactacattttttgataatctttttgtcccaaatgaaaactgatattttatactactgctgtaatttggatcttgaatgtccctgaaaggcttttgtgccagagcttttgttgtctgagatactaagatgccaacttctcttctgcttccctgctgccatggcaaccaggcctttcttattttaataatactttgctggctagaaagacagtgttgagccctctacatttccccaccatttcatagagcaggaatagtttatctgagttgtaaaggcccctagacaagacactgcttcaatgtccgtgctcaatcgctctgtttgtatttcctgggtcgccataggagagacttgacagcattacttaagagcctcctttcccactgttcaatcgcatttttcctcactccaggctaagtcctttctgacagttgccccaaagccttattaggcctttacttgacttcctcaaggaagactttgggtgggttcgcatctctttccagctactacagaacggtccctttatccagtgggtcttagaattacatacaggatttactgaaatatatattgttgcattctgtctccagagtttgtgtttcagtaagtccggagtggaacctgtacatttgcatttcttacttgttttccaaggaccaccacactgtgaaaatcactgatttaaattggttggcaaagatttttttttttctgttaaagaacatagtttttaagcggtgttggcaagattgtctcttttgctagtctatagtggaacctttgtagcacagaagtagtcataggcagtgcataagtaaatggcacgctgtgtttcaatgaaggcttatttatgagaacagccaactggctgagtttggcacatgaactagaatacgaaagttcccagttctcacatgattccaccatctctgtgagttactgatgcaccttttatttcgagcaaaccttattaaaagagccatgtttgtcctttaaaaaaaatctttcttaaaatttattttcttgagcaagccacacatttaatgttttattactcaaaagtatttttgtatatgtgttactttgtgaaacagagaagggcttgttggattagaagcggcatgtgttcctgattgcaacacacacactctgccaagttagtgtagaaacacgaagtgctttttatatctctactacaatgttttcaggtggcctgattctagctaactggggacatgggactactcatagtctgatcatttacaaacttttaattttccgctgggacttgtatgttccaggacatacactcttgttttccatatccctgtccctgccaatagtactgtgctttttgttgtctaaatcctcattccccattctttactctgtgtgtgtgtgtgtgtgtgtgtgtgtgtgtgtatgtgtgtatgtgtgtatgtggaagaattcgggtgcctgggaaggccacgagagggcatcagatcccttgatgcttacaggcagtcatggggtggcaccagacagggccagggcgggtggaatccggaagagtaggaagctcttccactctggaaccatgtctcctcaaactctttttcttgtcaaagtctagtccatgctgtaagtgtgcatgcagtgcctggaagcttcctcggctttaataaccacggccgttcttccctggacatctttcagccccaaccaactgaggagtttagtcttagagtatacaggaactgaatgagtatacagtatatgagtatacagtaactgaatgagtatacagtatataatgagtatacagtaacagaatgagtatacagtatataatgagtatacagtatataatgagtatacagtaacggaatgagtatacagtaactgaatgagtatacagtatataatgagtatacagtatataatgagtatacaggaactgaatgagtatacaggaactgaatgagtatacagtatataatgagtatacagcatataatgagtatacaggaactgaatgagtatacaggaactgaatgagtatacagtaactgaatgagtatatagtatataatgagtatacagtaactgaatgagtatacagtatataatgagtatacagtatataatgagtatacagtaactgaatgagtatacagtatataatgagtatacagtaactgagtgcagggtatgggctttaggcatcaagaggcacatttaatatttattaattaaagaaatgaaagcagtaaagcagacattagtttgcagtgaggctagattggaggtaatttttagtcttctcggcttgcctagttcagtagtttcctctgttacgttattttctcatggacaggtgtttgaaaagtcacgtgttttagaattctaaagtgtaggaatacatttagataatattagaatctcaaacaattgtatgtgatgtttctccatgtatgtgtatatgtacatacatgattaagaaatattatagcagctttttaaccttcacttacttgacatcatttcggtgtcagggaccgtggctgaaataattaacgagtcgtcatacttctcacctgcgggaaactttcagtctagtgatgaaagaataccagaaagcaagtatgtgaccttacctttgagaggtcagaactggtggctcttgggtggggcaggaacaggtggagatatcaagcctgaggactttgtggagatggtgatttctagaggctctgggtgacgtggaagagcgtgggccagactgtgactgcattgtgtgtttcattttacatggggggcggggaaaccctaccaatataggacagaaaaatttagatgcaggttcagaattaagcacttgaaactacctccatttcaagaactagtgatttctcagtatctcccattagaatattttgagtttaactttcttttaattgttttttttttcgcttaatacatatgcatttgccttaattgactaatcagttttgctcaacctatttatattaaactttaatttataccttatatttatattaaacttaatatttatatttaatattatgcttaatatattcgtattatatttaaaattatttatattataataatatttaatattattaatttatatttaaacttcatatttataccttaacgcttacagttttctacaacttgctattctattttcaatatttatctatgtaaaattaaagcgacaggtttaaactgccaaggaacttactttctttttttttttttttttttttttttttttacagtttttacagcaattttaatttattttttttccattttttattaggtatttagctcatttacatttccaatgctataccaaaaagtcccccatatccacccacccccactcccctgcccacccactccccctttttggccctggtgttcccctgtactggggcatataaagtttgcaagtccaatgggcctctctttccagtgatggccgactaggccatcttttgatatatatgcagctagagtcaagagctccggggtactggttagttcataatgttgttccacctggaacttactttctatagtgggaacacaccagagtcttcactcattttcttcataatttggttgtttggaagtctgtttgtttagctctgactttgggagtggaggtgcaacgtgtgttagtgtgagtctctgtagggtttgtaactaggaaaagaacccttcttcatggttgtagtctcagcgtgtgcctgagatccttgaaacccttcaagaagggttaacctaacagtactgagatgttttctgcatggcactgacatgtgtacacatgctatagaggcaccagcagataaaacatacctgttagagcatagatcagtgcattgacaccagctgcagtgtagtcaccatagtgtgcatgtgtgtgtgtgtgcacacccacacgtgtatgtcttccattcacagaaaaaggtcaatttgagttacttatgtttttaatttttatacttttctgtagaaaaccagtacatctctggagtgcttgtagagtctacattatatgtgcatggacgtctcacgtaacacctttttaaaattataaattcataattgtatacaaaaagtaaatataaacccgtatgtaacacacggatgaaaaccagtctgattgccaggcctggcagtagacatttgtgccattagctactggagaagctaatgaagtcccatttgggctaccaaacatcttcaaggctagtatggctaacttgggagatcctggctcagaattttaaaatatttcaagaaggattgggaatataaaattcagcagtagagcccttacctagcatgtgtgagggtctctgtttaatcctcaggattgaaaacaggaaaaaaagaaagaaagagaaaagaagaaagagagagccaagctgaaaatatcgtcagattgcagatacaagtagtgagggcaccttgctgggttcctggtatagagactaggaacttgacctcatggtatagttagtttattgctaactatttcttccctctaacttaacagttctcagcctataggtcttgagccctttgagggttgaacaaccttttgacaggggtcaactaagaccatcagaaagcacaggtatttacattaagatttctaagcaattttgaagtagcaacaaaaataattttatggttggggttcaccacaacatgaggtcccagcattaggaaggttaagaaccattggtctaaatgaacaccttgccaagtgctgcctgatgctattgtattaggtaagttgcaggcttaggaagaaaacgtggtacaggttttcaaatcctaaaatgaagctaaaaatcttctattttgttctgactgggtctgcatatatctcttcatgtagaaattttaacttggtattgtcagaactagttctatatatagataaccaggtaggctatgttgacactaaatatggtcttattgttacaattactattgttagggaaaagtgaaggcaaggtgtgtgtgtgtgtgtgtgtgtgtgtgtgtgttatttgggggtaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattgtgcctacaaaccacatttcaaaaagatagccatcttaaaatttaaaacaattcattttatttcaggtgaaaaaaaaaaaataaaagataacatctttctctgtagtcttagttgacctgaattcaacaggttgcttaagttgacctcagattcctggtggtcttgctgccttttagggttaggatcacaagcatgagacactgcacctgcctttccaaggtttgaaaatacacttttagttgaagtgaatcagagcactaagtgtagagtctcccagatgctcagaaacaagcagcccatgttagtcactgctcctgtcaggtgcatgcacagcgtattgctaacatccctgtggccttttgtgcctcctacccctttcctggtcctgctgcgctaaccattgccctaatggtgtcaccacaagcaagagcagctgaaagttgtggaagtagatttgagaggctctgtagttaacacagagttaaaactcagaagcaatgacaaaatgataccttttgaattctggtttcttagatttgcctggaatagaaagtagagacacaaaacattcaattaaaagcatactggaaattttcttcatgataaataataagctaataaccctgttgccaagaaatggtcaaactttgctgcactaacaatatactttaattgacctgttgaaaaacagactcagctttgttacattttccattgttttaaaattttgtttcagtgatctttgtctattcttaattattcccttcctttcgtctaactttgggcttaaattgttcttttttttttttttctcatcccgaggtgcgatgttggaggtcttccttttatctttatgtaagcactgactattataaactccccttgcttcctctgtgtttgattgacttgtataactaacaaagactttataacaaattacaaaaatatttttaaatcatataaatttgaacaagtcaaaaatttttaaggttttataannnnnnnnnnnnnnnnnnnnnnnnnnnnnnnnnnnnnnnnnnnnnntggacgtagaatgaggtctgttttagagaaggttccagggccttttgatgtatattgagtatctgttggattgaactctatatgtcagaagtcatttaatgtacagtgtggttttgtggggttttattttgttttgtttgtttggtttggtttggtttggtttgatttggtttggttttggtttctcaagacaggtttctctgtgtagccctggctgtcctgaaactccctttatagatgaggctggtctcagtctcagagctatgcgtgcctctgcacacacacatatatatctgtagtacttagagcggtactttgtcagtagcaaatgctttaaggttttgcttgataatatttttatttatttaactaatttgctttttataatgtcctgtcactgtgtggccttctccctgcctctgtctatacaccaccactcctgtattatcagttgttgttattaccagtatttttctcattccaatgattacatatattgggagggttgtcaagcttttaatccccagtcatgaaatattccaaataggcaagctcgtattttaggtgccagctagattctggtagaattgtctaagtatgatgtaaatgaaaatgtgcaaaacggttcttactcatttcatcttccagcatcaaagggtggcatccttatttgtgttgatggttttacagatctcctacgcttgaactctgtgcacttgtctttcagttccttgcttcctccatagtcagttaccgtcacgggggggggggtagcattaagtctgtgtttcagttcatgacctcctaaccacagcaggggctttctagcgtcgttattttactgtcctgaatcgtgtatgctataaggtttaaattctttgctcattgttaaaggttaaattctttaactttgtacgctgtccacccagattgtattcatcttaagtaactagagtgtggaggcaggtggatggatccttagcctcttacgtgtggacagggtcatggctgtcagcaggacttctttgtgtctgagggtagctttcctaatgtcactttattgttttctctaataggccaatgttctgaaaaaagctctagatgggaatggcctgccttacaatgacagaaatggaggcaacctccacatctcctgtacatcagaatggtgatattcctggaagtgctaattctgtgaagcagatagagccagtccttcaagtgtatctgtaccattctcttgggcaagctgaaggagagtatctgaagtttccaagtggagagtatgttgcagaagaaatttgtgtggctgcttctaaagcttgtggtaggtattaaaactcactgctttccttatttatagttattattttactcacttataggttattatgctactctaatgtaatgtacatgtataacttattatggctattagccatgtttttacatgcataacaaatgacaacattaaggtagaatttaaagtgattgacatagagttgacattaaaacagattgaagcctgtaaatgtttgctgagaccgcagtaggtgacgaaagactcttgccatgggacatctcatgagtcagtcttttcttcaggtgatacagggtttgctatgtagcccaagctggtctggaactgactgtgtagcccaggttggccttgagcttgtgttagcctgttgtctcaggctctcagattctgagattcaggtctgagctatcatctctagtttcataaggagatcttagaactgcatctttagcacagtgtggaaggaatgtgtacttgggtaaaattcttatttatttacctttagtttgtgtatatgtgcattttgcctgcatgtatgtgtgtatgtgcgccactagtatccctggtgtctgtcaaggccagaataaggtgtgagatacagatggttgtgagctgccaccaaggtcttcaccaagaacgttcagtactgttaattgctgacctatctttccagctcctgggtaaaattcctgacttaaatattttacagttataagcaacagatctttttttttaactcctgaagttctttatcaacccagtatatacatttctctccattcattcattcatttgtttgtttatttttgtgtgtgtataccttgaaatcttgaaacttctgaggaaacagttgtagactgttcagtatcattgataatttattatttataaggttcacgatatgaatgaaagggcataagcatctaaaatgtaaccatcaccctattctatttcgtctatagcatttacatttagaaactagtgaatgaagatatgtagcagagcccattcatgcttcggtaatgttatagatatagctccattaagtgcaaggagactgggaacagtggaacactgaggaagaaagaagtttgtaggaagtatttaggtataaaactagattgcataggacaccccaaggactaacccttttgtcttggtctttgatgaaccctgtttctaacaacacacagttaaagggaagttaacaggctgttttgtactttctgcatggcttgttttagggggataggttgattccctttttcatgtttatccatccacccacccacaaaagctactaatatggctgatctttaaagataagcacatagagctggagaggtgggtggctcaggttagagagcttactgctcctgtgagggctctgggttcccaggaatccagtgccctcttctgtcccccgagagcaccaggcacatgtggagctgtgtaaacagataggaaggtaaaacactcacacacacgctttatttttatctaaaaagtattatttaataaaagactgcataataaaataattaaaatgtgtacgtattttatgaaaatatattttagctgggtataatggcacacacctttaatcctagcacttgggcagcagaagcagttggatctctgagtttttgttaatataaagtacttatacatatactttatttatataaaccatacacatattttcacttaatatatacatatgtgtatgtatatatgctttaagtccaagaaaaccttactttcttctgttgaaatgcggtgtagttacgtgttcattttccagtgccgttgccatactgcttggctcactgtggcttgctggtaagttactttttattatttgcagtgtgctcctaaggctgaactgcctctctagccctgaagcaagttctgtagacaggaagtagaagttgttaaactctactgttgttttataagattgtttgacaattttagtgcctttggtttcttcccatgaattttgtgattattctgtcacttctacataaagaagagcggagatttctgtagtgcttgcatcacattgatgtttttttatgttacaattctattttagaaaatcaaatgatctagttatctaatttagttttttttaaaaaattatacaatatattttaatcatatccttttccctcctcacaacccagcttcacatttttctctgtgctgggattttgtctagtttgagcctgtgtgggtctgtgtttctgtgtgcatcagccctgttgtgtctggaaaacactattatccttggaaatatctacgacatttggctcttaaagtatttctacctcttcttttcaaagatgcctgagcctgggaagagagatgagagagacataccatttagggtggttgctcgaaagtctctcgggtgttagtcattggtcagttgtagtctttggcatttaacagaaacaagcagggatgctgggtggttgggagcagtccaggctatgccctctacagtgttacggctgtgtgtgggattcttagctgcagtccaggctatgccctctacagtgttacggctgtgtgtgggattcttagctgcatatgtgctgcagtccttgtgtactcatagcaagtcagtctttcttagttctcagcaacaactagagtttgttcccaggcaggcctaggtattgggactcctcagcccttaacagtggtcagtgttacacctttgaggctcggggtatctgagaccctttcctaaaggcctggcaggtctctagaaggctcccataagccagaagtttctcttttctggctctttacagaccttgtatgttcatgagcttcagggtctagtctctctgtaccttggtctcctttaccgtgtttgagcacatgagtgcttctgctgctgcttctggcgtcacacatttggttccttcccgtgttgatttttacagctgaacccatcaactgctaagctgttgccattgctgctgctgctcttaccggatgctttttcctgttaccagctcaaccccagcattcaaagtaggcaataaagggccattgaagaggaatatttcatttgggcctaatgttaaaatataggggaaacagaacaggatgttgtctcttagctggctgggtaagagtgtttgaaccaagcacagcaaacctcacatgtgaaggaaggcttgtcctttcaccggtctcagcctgtcctgttagtgccagtcacagtagtcctttgtcaggcagccaagggaagtgttttgctctggcctgaggtaatgtttgcatgatcgtctccagtttgccgaggcttattatagtaaaagtctagtacagcctttgaaatagtgctgcctgagactcttccagagctggaccaagcagttgtatagttctcctcaggagtccgcagagtgctcagaatggccagtgttggcatgagggtagtccagggggctgtttgtcccgcttttttttttttttaaaggcagctggggcaggaagagaaagtctgaccggctgccagtagggagtccaattgccctattctccagtatctgcttatttacgggaaagtgagcatgagaaggaggaggaggaggaggagggtttatagtaagtacccaaaggccttatcattggcacagctagtgagtttaagattgcatacctgtccttagttcctcagaggtgggtgtgcctctctcacctctcttgatacgttccattctaatgtatttgtgaaattaaaatttttcttttaatgttctcttattatattgtagccagagaagataactttggatggttttaaccttaaagatttttttttttgacattggttttgagatgtatgaacctggagtatattttacattctgccctatgggggcaaagttttttttatatgttagtaatatctagttgatttgtcctgctcaggttttgtctttattgagaatagtatgttgaattctccaataagtattgttgaattgtctatttttcccctttacatctgagtttttggttcatagtgtgttgataattgttctgtctttggttgttaattttttttgttagtttttttgaaacggggtttttctgtgtagccctggctgtcctggaactcactctgtagaccaggctggcctcaaactcagaaatctgtctgcctctgcctcccaagtgctgggattaaaggcgtgcaccaccactgcccggcttggttgttaatttttaaccttgttaattttacatcgttaatttttcactttaaatcttattttcttatattagtataaccatgctggcttttgttttgttatttttgtagaattttttctatctttctcctcctttcaacaacctatttgcatcttcatattttaattgagtctcttaaggacatcatgtagttaagccatgtatttttgtccatataaggaatctctaattttaatggaatagctgtatgaatttgcatttgaaatagtgatagcgaatattaattcctagtatttaattctttactatatactgtatctttctttttaaattaattttttttcttattcactttacatccagctcactgcctgcctcctaatcacccctcccacaatccttcctccatccccccacttctcctctgagcaggtgggacccccccacccccaggtatcttccaccctttggggccagcaatcctttctcctattcttccataagaatccgccagctgcattcactgtttggctgtgggtgtctgcatctgtctgagtcagctactgggcagagcctctcagaggacagccgtgctaggctcctgtctgcaagcattacagagtatcattaatagtttcagggattggtgcttgctcatggggtgagtctctagttggaccagttattggttggccattccctcagtctctgtttccctcccctatccctgcaattctttagccttttttgtgtttaattttttggtggtatatgtcttagttagggtttcattgttgtgaagagacactgtgaccatggcaactctaaaaaaggaaaccatttaactgggctggcttaaagtttcagaggtctagtctattatcatcatggtaggaagcatggcattgtgcaggcagacctggtgctggaagggccaagggttccactgtatcactgggtgtggcttgagcatatatgagacctcaaagtccacctccacaggacacagttcttctaacaaggttacacctactccagtaaggccacacctcctaatagtgccactccctatgagccaagcatctgaacatgtgagtgtatgggactattcctactcacaccatcacagtatataatttgagtctcacttttgacgtatttttagttttattcgaagttctaaaggttagagttaaccctgtacatgtattattttctttagaagtactgacagagtctacctaagccagtggctttattcctgttgtttgctgaactcgataacactcccactgtcgcaggctttcttcttctgaagcttatgtgctgctttgtcactatgttatggctcctcacacaggaggaagtgccaggtggacgtgtttaaatattttatacacacaaggtcctcaaattagatactgctttttccaaagctaccctagtttgtctttctaacgaaattgtaacaactgtagttcacaggacagctcactagtaggaatcttgctgtttttgctgaaatgaatggcttaaagtgctgttgtgttcgattcgtttgcacttccttcaacactcggtattgcatgcctgttgtgtggatttgctttacaagaaataatatttcattctgtagcattagtaactcttaatcttcatttttttaattataaaatacttcagttaatattttatataagtataaagtacaaaccagggtacctaggatttaaattttatcattttgccattttgatttctatagtgttattttgatatattacattaatagaatttactaattttctaatttagctctctctgcaattctttgataaatgaacaatggactttgttgttttttttttttttttaagaaacatttatggattgggtttgttagtacttagtttaagattcttatattttgataaatagaaatttgtgttaaaacaaaatgtcttttgtgttttggttatgctttcatgtaacttctgaacctggttattttcattcgttccggattttccttttattctcttcaacctttattttccatttaaaaaaatgtaggtagattctatgtcttatgtaatgtagttttatttagttttttatttcaaaatattttttaaagttatatttttctgaaaattgtctatctttttaaatatattggtgcaatgctcttctagcactttgtcttttaatttgcttttaattcagcttgcatctatttttattccttgttagatatgacaatgactgttaattttgttaattattaaaaaaaatcaacatcatcgattagttttgtttactctgcactattaactttcacttttaaaactctttgtgtgggctggagagatggctcagtggttaagagcactgactattcttccagacatcttgagttcaattctcagcagccatacggttgctcacaaccatctgtaaagggatctgatgccctcttctggtgtgtctgaagacagctacagtgtgctcatatacatacaataataaaaagtcttaaaactctttgcgtnnnnnnnnnnnnnnnnnnnntacggatatgcacatgtatgcagatgcctgcaaaggccagaagaaggtatcacattctcttagagctggagttacaagctgttgtggacagcttgaaatggggactaacaattgtactctagtcctctgaaagaacaatgagtgtccctactgctgagcgctctccagactcttcctctaactttactgttttcttcttttggctttctgccattgttcttttgttttctgatgtactgatacccaggtgattctgttattgtctgatgtaaatgggttactacatataatttttcctatgagtacatttaaatttcattaataatttttcctttgacatgagatatttataaatacttgcagttgaatttgtcgcagatctttctttgacctatgaggcatattgaagtatttgtaaatacataaggaataaagggtacctttaaaaagctgctactgaataacatttataatttataaattactacaaacctacagagagttgaattgagtttcaaattataatttaaatcctatcagtttatcccatttatgtataaagtggaaataaatgaatatattgttataataaaaatattctcatgaaatataggcttcaatataggatttatttttatgtactcaattctgatttaattgaaatgctagaaaaggtggtgtgtgaagacttgttttgagtcccaggggattatttggtgcgttcatgtacatatatggatgtgtgtggatggtttaaaatatacttgaaaaataatatatactattatattgctatgttctatgtacttttttagaccattgcccttcaacctttacaaatatcttttatatttattttatgtgtgtgactgttttgcctgcatgtatgtatgtgtatcacatgcatgcctggtgctcaaggagatcagaagagggcattggattccttggaactagagtgaaagatagttgtaagctgctgtgtaggtgtgtacatgtgcatgcctgaggaggccagagtcatcagtcagttcctgcctgatagatagagttagaggtggctgtgagctgcacagggtggatgctgtcagctgtcttaggtcctttgcaagcgcactatgaatcttaactgacgagctagctctgcagccctcctttaacattttatgtgtttcttaacatatctgccccctagtgttttttctttctctcgtacttgaaattgaacctgacagctcacaccccccagacatgcactccacactgagctctgtccttacttctgcgaagtgcctgaaaaagatgctgatgcggtgctacactcttgtaatcctagcagttgagacacggaggctgccctgtcagagcttaatgtcagcttcatttgcataaggggtttgaggtcagcttggactacataagaccctattacaaaaaggggaaaggatggaaaaagtatttgggggcagagagatagctcagttgtcatttaacctgtaaggggctagtgagatggctcagtgggcctttacattttttttttaaatggtgcatcaaatataattattagtatagtgtgtaaaatttctcattttaatatgaaaagttttcattcttataaaagtatccagtggcttgttattatctcagtgatttgataattagtatcaattaaaatatacacatgtatacttgtgcatactcatacaagatagtttttccctcagggtttaagagttacttggaaactctctttagaagacagttaaaagctggataaactgtacttttatcttcatgtaagaatgccagtattattttttacaatatatagagaggagtatttgattaaaacttagttttagggagtgttttcccacggtatttcacctgcgactggagtttctgctgactgttagagctgtcaccagggctcccagattgtgttatgtaaatgttctgccctttgcatctgcagtcagttccttatgactcaccggctaggtatcacgtcacgcagattgtgcatgttatgtaaatgctctgctagctagctataatcagtcccttttatgcttcctttctaggtattacgcctgtgtatcataatatgtttgcgttaatgagtgaaaccgaaaggatctggtacccacccaatcatgtcttccacatagacgagtcaaccaggcatgacatactctacaggataaggtacttcctgacgccaagtgactcgcgtattagcaaaagataaagccagagaaactgttggctctgtaaggtgatagctacgatgttttgttctgttggaatgccacttcatgacttttgattataattaagaattttaaaaaaagaacaggtgaaaatagcctgcaatcagtccttagtgtctggaatattgccagtttcccaggagatgtgatgtgtgtgcaataaaaagcaatcttaacaattttttttttacaaataaaattttaaagttgaaagtttttgtttataagttaatgtatttagctatatatggcaatgtgaaaaatattaatattcagaaaataaaaatccagattttttttctgtataaaggaatagcaaataattttggttttacagatagctgtaaatttccaagcacttacatgttatttaattttcttatgacttaatgaaacattcagaattccctgtaatatataaagaatctgatgtgacgtattactcatagttgttcatgctcttaccgcttggaaaagtttgaactcagacctagctttcttcataaactgccttctcaccagcttgcttttacctcattgtagagataatatgtgtagtatttactgtcattatttgatggtctgtcttattgatttttatttgttgagacaggtacaacagacttcctctgacctcactgactagcggggactgaccttgaacctgcctcttaacccccagtcattctgagatcacaggcgtggccaccacacccagttggttttgctgaaatcaaacccagggtgttaaatgtgctaggcagagtggtgacattattagtacttaatgcgttcttagtaaattttcatatttcattacttattttcttctccttggtctgtataaaatatgtagatgcatgtgtttgggttttctgcttttaaggtaaaacaatgttagtaaaagagttcagggtctaagtggtgaacataggaaaggcaggggaatgagctggaggaatggcttggaggtttaaaagccctggctaccctttctagaggacccaggttccattcctagtacctacatggcagctcacaaatgttccagggggggtctaatgccctcttctggcctaaacacaaaatacatatgcatatttattttagaagaaaacaaaagtaatggcctttttacataaagtagccagttgtaacaaaataatgaagctttcataaaataattttatagctttaactatttggggataatctaaataagtaaaaaataagaaacaatgtgggtgtgggtgtcagagtttgccttttttttttttttttttttttttttttttttttttttttttgagacagggtttttctgtatagccctggctgtcctggaactcactttgtagaccaggctggcctcgaactcagaaattcgcctgcctctgcctcccgagtgctaggattaaaggcgtgtgccaccaccgcccagctcagagtttcctttttagcattataataaacatgaccaaaagcaacctggggtaggaaagggtttatttcatcctacagtttacaatccatcctgaagggaagatggagcagaaactcaaaggaggaactcctagagtcaggaactgatgtagagaccatgaagaaaccagcttacctctcctgtcttgctcagataactttttattttattttttattattttttctttctttactatatgtaagtacactgtagctgtcttcagtcactccagaagagggcatcagattttgttagggatggttgtgagccaccatgtggttgctgggatttgaactcaggaccttcggaagagcagttggcgctcttaaccactgagccatctcaccagccccagataaaattttaatacaacctagactcacctatccaaaggtggtagcatacacagtgggctagacccttccatattgatcactaatcagaaattacttgactacagaccagtcttacggaggcaatttataattgacatttccattcacaacataatggtagcttgtgtcaattggaaaaaaaaaacaaaatcttaaccagaacaatgaataaattagagacctacttggaaaatgaaaatataactaagtatccatggtacattgagcctttttggatatcagatttcatgtatgttcaaggcgaaggacttgagtaaaaacttctccaaagaaatgtttggcatgcaaatagctaataggcatttgaaaagatacccaacatcattagtcctgtgagaggcataaatcagatgtgctagaggttaacaaccaatccactaggatggcaaaagtagacaggcaacaatgttgaaaattatttgtactaattagaatgctcacacactgtcagtgagaataggaaatggtaatggcacttttggaaaagattggccatttctcccaaagataaatacagtgttgccaacatgaatctacaaaaacattcttcacagagtgttattcacgttagcataagaacagaaacaactcatcatttaaagtaatgaatgaatgaataagatatgcacatcatacagtcctgtgctaattcattaggaataaagtacatgccacagtgttgataaaacttgcagtgtactaactaaatgtgatcacataaaaagacaacataccacagccattcttttgagtataaagtgagtagaatagaacttgtgaaggttgtagcttgtagctagaggttaacagggtgacttgagtttgattgctaatacctatggagacagaataaaaatgtgaaatcaaattgtggtgatattggtaccacattgaatactacagaccacacagcactttaacgtgcagactgtatgtagataaattacatctcaaagcttttagtttcaaaagtgagtgtacttaatttttctttgaacggtacattttagtgttcattttcttaaaaggaggaattatttgtgtgcacagtagatttcacttttcgatgccttactagtgttgctggacttaagatttttgctgacttttatatctacctcacttcagtttcccttgattgcttctcttctccatcctattacttattactccaaggtgggctgtgtgctttgagtttagagttacttacgttccacctgctgctgctcttgcttgatgctgtgtttgtttgttgtttatggaaacaaagtattattctaggtagcccaggatagtctcaaactcagcttctcttgctccagctccctgggttttggggttacagatgtgctccaggatgctacactctgtttcttgtgttttctgctgacattataatcatgttatcatgcacaaagccttttgtttcacaacctgcattcagcactgctctctgtgttttatagcacagccctggtaacttttagtgtgctgagggtggctgaacttagtgctctgtgcttgaactctggaggctgatagactgtctcgttgtcttacaggttctacttccctcattggtactgtagtggcagcagcagaacctacagatacggagtgtcccgtggggctgaagctcctctgcttgatgactttgtcatgtcttacctttttgctcaggtataattataatatagttaacattaatcctctttatgtgtgtattaaaccagaaatttcttcctatttagtatgcatcttaagtagagtaactttcacgtgggaaaatgcagctctccctgaggcaccaggtatgaagagataagggggtagtctgtgtgataatcggtttccatctcatgatttacagatgtattttataacgattccatgaattgacccttccaaagtcactttttttttcttttaaaatctaagtcattttaaggattttttttttaaggtagcataaatttaacagcagaattcatgtggccattgggtggtaaaattctatagagtttttaataaataaattttggatactttcgtgtttacatggtaggcagtaaaatgtaacaagattcctctacaacaaacagagtgagctgtgatagttggtaggcccctcaagggaggctggccacgtttgatgcttagagtgggagctgtgttcagctatttgtccactagtactataatgatacacttctgtagtgttatttgaacacctcgtaatgcattcttttctattatctttaacttaacagtaattgaaatattttctttttaaactattttgttttcatgggctactacttttaactgtcctatcagggaaaaaaacatggtgagacaaatttattgaaaaatgaaacaaaaaaacccaaaaatgaaacaaagtgaaaaacaaaacaaaaacttctattgcatcattatgagtgtctagccatacaagaatactttctgcctggtcccaggcaagctacccctgccagtctttctgaggtgcctgtgctctctctttgcctcattccttctatgtctttgctctgctttgcacctgtcccaatgccttcatcattaaagaaaattaggtttcaaattttgcgtgaaaccttttaattatgccaattgtatacgatttcaacactctctaggttcctaaagtgtctgctgcgtggtacttcacgttctattagctgacatagtagtgatctgcttctgtgtttagcttccaagaaaacaagtctggtctttctgatggattaagaccaccttctatgtttctttatagaccacacaaactctagtacaatgccttcaatatgaagtccgtgtacatttgattaattaacatttattttggtttaggcatttttaaaatgattttaagataaagctttacggctgggcagtggtggtgcattcctttaatcccagcagttcggaggcagaggcaagtggatctctgtgagttctagcctgtgtagctagcctggtctacagagcaagtttgaggacagtcaggactacacagagaaaccctgtctggaaaaacaaacaaaacaaaaaaaagaaaaaagaaagaaaagagaaagaaagataggctatgaacccaatttaaatcagtttctatttgtatatgaaccttggttaattctttgtggtataattctttgtggtataatgataaaagcagaacttggtttattacttttaaatgcgtattttaggagctaacttatagcatataacataaatgtgatagtaaaacctgagccatggccttatcgtttctgtttttcagtggcggcatgattttgttcacggatggataaaagtacctgtgactcatgaaactcaggaagagtgtcttgggatggcggtgttagacatgatgagaatagctaaggagaaagaccagactccactggctgtctataactctgtcaggtaatttcctctcacaaagcattacatactttgtatcgtttgcttgtatttcctgtgtttgctcacacatttgattttataataaaaatggaggggttatggagatggcccagtgggtgaagtacttactgcactgtggttcatatccctgaaccacataaataccgggatgacactgtacacctgtaactgtaggtgggtaggtcaaggcagacagctctcagggtgtggctgaccaccgttcgacacagtcaacacagtgagacgggtccaggctccgtaagagactgcctcataaaataaggtcgagggggctagagaggtgcttgctacaccggcttgctggcctgagtttgatccgtgaagcccacaggaaggtagaaggagagcactgacctaagagatttatctctgacctccaggcaagtgctgtggcagtgtgcccccaaacatgtcatgggcatacccacaataatataaagtaaaactttaaaatagggtctgtactgggggagcactggctgacttcccaggcttggggattctccgcacccacatagtagctcggtcaattggaaccccagtccaattaggtgggaagtgataaagacaccaccttgactctgacccccttgaggttgcatagcacatacaccagcatgtacatgcgtgctccccacatagaccgctcagaaactaaaacagttaggggcaaactttcctactacagcgcatactctggaagagattgagttttcaggctctataacatcacaggtgttcattatttgctttatgtgttctgaaaagactcagtaagttcagaataatggaaaaatactttaaggcatagtatttcatgcctagttcttatattgtgcacatgatctgaagcgatagttttcaagtcatggttcataacttaggcatattagacttctatctggcaaatgacccagaagatttgaatatataattattttcttgattcttttaaccctctcatggaatgaggctataaacctgtatacaagctttttttaaaaaatcacctttctgccttttattagtgtttcttaactgtacaaagtaatggtttccttttattttcgtacatgaatatccacctcaccactgtccaaataatccccattctattagtggaaattttggaattttggtgtctttaaaaaacagaatatgataagaatatttttattttaatccccatcaaaggatatggggatgcttcagattgtccacagcagttaactaagattcgcctcatgctctggaagaggtgtgattttgccacctgcagatagtttctgcaattgcgtgatgtttggaattctggggactttttagaaggtgtataagaatgtgtattagagggccctaagaagcggggtgagttgttggttggtagttggtttattgttggctgtgattcgttaagtactcatgtgcagagaagaaaaagaaattagataaagatatctaattgatggtggagatcaaacttgaaccaaggaactggacatccttagtcagcaggaagtagggtaacgataacatcgccaccttcccaacccctgacttcattcaggttctttcctctctcccctctctctttcctttctctcttatctagtggtagggcactgaaagggtggaaaaaagaacgcccaagtagcacagaacaggtacaattctactttgtggtttttttcagaaactctggactccacctatgagaggaaatatttagtagttttttgtttcttttactttaaaaattgataattattaactagtcataagggtttttgtatacatgcaactgacatatcacaatgtatacataattaaaaccattaaactttttaagtacattcacaacattgtataaagagggttacacacaatcttcaaaacatttctttcttcctaaaagaaaccccatgtacatttgtgtttcagccctagtcttcctttccccagactctggcaaccattcatctatctctgtctttctggatttgcttattttggtctttttatataaatcgaaccatacatggagtggcattttcctgagtctgacttcttctgatgttttctctaagtttttaaagttttttcattatcaatgcaagtgtatgacagtgtgggtttgtgcatgtcatgtggaggtcagaggacagctctcagggatcatttctcttccttcattgtgagcgctggtgatgtaactcaggtgtggcttgcttttactgagacctcttgccaaccttagcacagtgttcttcaggttcaaaggtacaatagcctatatcagctatttcattctttttattgacaaccagttccattttatgttatgtttttgaggcaaggttttctgcatagctgtgactaacatagaatgctgtgtaagccagggtggtcgagtgcacagcggtgggcctgcctttgacacacttgaggtaggattaaaggcatgtgccactgtgccctgcatgttatttctctctttgagtcctcgtaggggtagcggtgtctaagtgtgggttgggtttcattttcccagtgactgctgctgattagtagcttttaaaaagcttattgaccaaatgcatatcttctttgaagattgttcatttaaattcttggtcatttttaaagtgagtaatttatattcactttaaatttatttaaataaataaatgcatttatattgtgtttaattttttttatattctagatacaagataagtaaatctctagatataagttaccacatttaaagaacttaaaatgctttttcataatttgtgaattattatcttttaaatttcttgattgaattatttgtggaactcaagtgaggagatgtaaaattagaggtgaaatgaataaagtgttagctgatcacaaactaggccatggtagtgcctcctccaggacatgtggtggttgggttactatgagaaaaatgagcgagcgagcgagagagagagagagagagagagagagagagattgattgattgatttagagagaaagtcaaaggctgtaaggaaagataaaacaaaaggtcaacgaggtttccagggcttgcagaaatgggtgaattgtgctatgtctcatttattcctacttagcatgggtaaactgacttgcctgtgacgggtgtgggtttagagcatagtgatcggggatggagaaaagcaagcgagagagagagaacctagagaaaaagacagtggataagatggtccacatcgagtcttgaggaattacacagtatttactcacaaagcacaaatcccactaatccaaaatggagatggaaaaggaatgcacaaggagatgcagagactttcaaggagagagagatactggtgttgaatgctgctgaaagtgtctaaggaaaacagaaggcacgtttagtaaggagagaggctttcctgacagtagcaggaacccttcccttccctctgtactctgtagctgctgggaacatgaatcaaggcaagcttaaatttaatatgggaaggacgttagtatttaaacatgtgggtagaagagagataatacatagaataaggttgagaggctctctctctaggcgctctctctctctctctctctctctctctctgtgttataggaagggagaggtatgagtgggtgatacatgtgaaagaattagcttttatctgtcaggtttatacctcatttattgcattgttgggaaggagaagacaatgagcatggatgtgtatagatttgttagcagaaatcttaaagaattcccagttagaggacctctcaccccagcaggcatacacagtctgcatgaagccatnnnnnnnnnnnnnnnnnnnngcatacacagtctgcatgaagccataaaagcatttgttgagaaagaacacgaggaagactatggctgaggtttgaaacagaagaccatttggtttagaatagctgtggaacagagaagtggagtaaaacagtatgcttgatggagctattggaaactggtaattatcaacctagaacataacccagctgtcctctaatgtagctttcgttagcaattgtggctacttgacctcacagctttgagagccacaagaggccttgtgggaagtaggaaaggtataagctatgaagctttggtaataataccagacaattccaaaaaatagggaaaaattctgatttttaaaatctttgcttatatttatggtatatctataatattgttatgtcctgatgtcactgaatgtagattgaggagctctggccgtgcctcaccactcacatttgaaggcatagacattggtaaacccacatggaagtttaaaaataattaaattatgacttttgactgtctattgactacatatttaatgacatttgattataaaatacataactggaattttagtgactttttagcagtcagctaagagtcttttaaaatgatgagtacttcatctaggacaggccttgaatttcattggtggaaaataaataggcccagaatggtgtaggtgatgctgtgaagtggcgcccacaatattctcagaacagaggctggaacccctatttcacctctggaataaatactggaccactttcctctcataagagctagccagttgccgggcggtggtggcgcacgcctttaatcccagcacttgggaggcagagacaggcggatttctgagttcgaggccagcatggtctacagagtgagttccaggacagccagggctatacagagaaactctgtctcaaaaaaacaaaaaaacaaaaacaaacacacaaaacaaaacaaaaaaagaactagcccgttgagagatggatgttcggagtaaaagttagcatgcagatttaatgtagatgtgctttagaaacacagctaggttctagaggccattgtacatagaaataaatatacagaagaattgcaaaatttttaaaaggaattgttttgatcagaatgaaattattaggacttattgaagctaagctcacaaaataatacaaacaataaagtgtgtttatatagcaagcagtagtgtccagccatggatgtttgcagaattcagaaaaaatttggagtatagcattataggaaatatttgtagcacagagaaataaatgcccaaacttataaatcatttcaggcatataagataattagagaaaacaagattttagagactttattattatctagacagtactcatttcactttgggaagaaaattaataggtcataaactgtgttgtcaccaagagaatgcctatcaaatgagaatgcccatcaaatgagaattttttcttgcatatatatcagatggtagttatgttgaacccgcttattgtgggaaaaggcaggaactaatctcctgaatttgtttgctgtgtacttgttgtttctagctacaagacattcttaccaaagtgcgttcgagcgaagatccaagactatcacattttaacccggaagcgaatcaggtacagatttcgcagattcattcagcaattcagtcaatgtaaagccactgccaggaacctaaaacttaagtatcttataaacctggaaaccctgcagtctgccttctacacagaacagtttgaagtaaaagaatctgcaagaggtccttcaggtgaggagatttttgcaaccattataataactggaaacggtggaattcagtggtcaagagggaaacataaggaaagtgagacactgacagaacaggtaatcctaatgatacattcttgctctttcttctttatgtagaatgcccataaaagcaaagtaaatgtggttatttgagtaaagtcttgccattctctgctggtagaagttttatttatgtaaaaatgtaactatagtttgtatcacaatgttcttaaatgttttgttaatttttgtggcaaaataattagtaatgactttcttccagtttcagagaaagattgaattctttaagtaatttaaagttaacattgtttcctttactctttaacttctgaaatttaagtacaatcataagactaattgattttgataatataattaattctattatatttgcattggaacactgaaactgttcacatgtatcattcgtatatgatttcagcaatttagtattatattaatttttaaaatagttaataattctctacttttctgacaatcattctttttaatattaactgggttaagttctgtatcacactgtcatactttaatgctctcactttttttagtatgtttttttttaagatttatttattttatatatgtaagtacactgtcactctattcagacacaccagaagagggcatctgatcccattacagatggttgtgagccaccatgtggttgctgggaattgaactcaggacctctggaagaacaagcagccagtgctcttaatcgctgagccctctctccagcccctagtgctctcattttgaagtcaatacaagaaacataaacttcgtcttcaggttcaatatttaggagaagtaatctcatccgatgcctatacattgttgtcagtgtccctttagagaactttaagtggctatcagcaccttctcaagcttcgtttgatgtcactgtgccttcctaaatgttcttgattacaggacgtacagttatattgtgatttccctgatattattgatgtcagtattaagcaagcaaaccaggaatgctcaaatgaaagtagaattgtaactgtccataaacaagatggtaaagttttggtaagtttgtattatacattagtaatgtttccattttagaaattttcagaagtacaatagagtcttagtatcaaagttacttaagtattttgattatagccgtaagtatgctctaaagagtgccagcccagcaaaccctttattgtatgcaatctgggaactagaggaaaggcaggaggatgcatccttctctgatgcgtgagtcatcacttctctgatgtccactccgctggtgttcagagtcccatgtttgtctggttttcccatgtgtatcaactggagtatctgttggccttctcttggagactgtgcaatttagaaattaatttggaatttctgtgcttgttttgtttttgtttttcacgagacagggtctcactatgtggctttggttgtcctgtaaaccagactggccttgaattcacagagatctccctcccaagtgctgggcttaaaggcatatgccattgtgcccactttaggagatatttttatatttttataatcttgaatttccttatccaagaacataattcattttctgtgtatgcagataatgtgttacattgtacaagagtattttgaaacttttaacaatcattttcaattttttggttaagtttaattcaacatagggcatttttcttgctgctataaatagggcttttttaaaaagcattcaattacattgattattttgataaatggaaaataagtactttttaagtatgtgtgcttttctattagataaagtgacacatttttgattatatgttcatatgtatatattttaataaaaaaaaatctcagcatacttccatatcctaacacatgtagtttagtctgagcagtatataaaaataaatgtttgtatttataattaatctcaacttttatgtatgtattagattctgactaactctctcagggtcattgaagtgtatagttatgaatggttagtgactaactgggaaggtgagctaagcctgtgtttgggagggtcttacatatcagatagaaggatttgttaaatcatgctagggaactaactggaagttatacaaaatatttgaacaatttagaggaaattaaccagaatagagtatagagaatttccaacattagaatttaattggttttttaattccatggttttctttttcttttctgattaggagatagaacttagctcattaaaagaagccttgtcattcgtgtcattaattgacgggtattacagactaactgcggatgcgcaccattacctctgcaaagaggtggctcccccagctgtgctcgagaacatacacagcaactgccacggcccaatatcgtgagtaatgccacatttcacaggacagttctaggagctggctggtaggttagcataaggactgtggaagtccgaattccaggcactccagtacaagactgaacatagccgatctaacagatgagacagtcaggcacatcccgagagcttcaggccagacagacagctgagtgctgctggctcagtgagagacctttcctcaaagcaacaagacagttgtaaggaagacattgacacgctgtcctggtcaccagagtacatttttcagagggaaatgttctacaaagtgtgcttaatacccatgtttctaggtcagtactgtgcaggggaactttacacagtgccgaaaaggttcactgtttggacattctaattaaatatagtctggatttatacttaattgtattttcatttctttacctttcaatacccaaggctacgaattactgttctagtttgctttctgttgctgagcagaagcaacatgaagagaaacggccttttaattggctcacagtccaggtcacagtccatcatagagggtgccagagcaggagctcaaacaagaaccgaggcagaaaccacgcaaaccctgcttcctttctcactctccttgtttatgggcagcctgcctaaggaaagcatcgtaggcagcaccctcccacatcccttaacagtcaagataatcccccagacgcggccacaggccagtctaatctgagcagtctttcagttgagactccctgtttccaggtggctcttggctgttctcagcagggcagggaccttatgaccacccagcacctttgcaggcctcctattgttgtgtaaattacatcctgctctccagtgctgcgtctttgaaatttatgcacatactaattcttttggcacataggacatttttggactggtattttccagtcactgcagatcttcggttagatttgatactgttgtaaatatagaaagatgattttgtattagtatttctgggatagaagagacatgagagattttatgggagtatattttttaaattattcaatttgtaaaaagcagaacatcaaaatgaatgaattttcctcgtggctttattgtttcgtagtgtcttaaaataatataattattccttgaattggtttgaactcactacaaaataactcgatacacttatttctcttgaaaacaaattttgtagctatatatagtagggagtgttctgaggcgtgatttttatttggttgctgtggctgtcagtcacatgtgcaagctgccattcatatgatttctccttgacttgtagaatggattttgccattagcaaactaaagaaggcgggtaaccagactggactatatgtgctacgatgcagccctaaggacttcaacaaatactttctgacctttgctgttgaggttagtaggtcacatttattaatagcaacatgttgtgtaatctgtctttctccgtcaagaagtattttatttttaatattaagaattatagttcttgagatggtaattggcatagtcatacttggcatatcttaaaatgtcataaaataaataattcataaagttaatgtaaatacataaataactataatgcctttgtttttgacgtttattttattttttgatgtttgagtattagccatgtgtcaagtggttatttcgttaagtatactcaagtctacttacaacaaccaaaaatatttaccaaatcgtttagaggaaaataagtgacaagaacatttcctgattctagaataggttactaactgcgacattcagagcaccagggacatgattgcatataagagtgcactggacactcactgttaaatgcacgtgaatttggatctcatcgaagattgtttatccatatttatctttaaaatatatgcagctacatgctctaaatcttgagaggatttgtagcaacatctagatttattttataaaaatatagaaggtaaagatgttattcaattatttcctaaaagcacctacgtagcactcagcacatgtagtgaaggaactgagtataagggcagcaggtgtatgtacctcgtcccttcaccattacataacttactcaccatgctcaaatgtttgtcaatcactgggcctaataggtgtgatgagaaattagagaatgtatgatagaaacctatgtttcaaaaatctgttggaaaacaaaaattttaaagtatacttaacatactcagttaagctttgtgattagtataggcagaaatagacaatattggaaaatatagtatttattcagaaagatgttttaaaatatagaagccatgcaattgccttgaggcattaaaagtaattttataaattgctccaggctggaggaatacagtaataaagcaggtcaaattattaagataaatgaagtagttcattgtttattacattaagacaaatgtttttaagatagaactaaacaacgtcatagtagagataattacaaagatagaatagtatagaatgcaatgcatagtctttgcttgtggagcagagtcagtcctgttagggagggcctcaccagtaaagtatgttatcactgcagtgagctaagggatggatacagtcacatcaggggtgtgtgctgatgggcagaatagaggtgggggaagcggtgaactcgcgaaggtccatatgctgcaccagcgctagacaagggacgctgttacacttgaaatcagttactgagctcttttgtaggatgtggcactgatcgaacgccttccagaggcactgcctaaggatttatagcttcatcatcgaaatattctgttggctgttttttgatagcccctttggctgaagaatctgcataattatcattgtgatttctcttcttcttataattaaacttatgtagcgagaaaatgtcattgaatataaacactgtttgattacgaagaatgagaatggagaatacaacctcagcgggactaagaggaacttcagtaaccttaaggaccttttgaattgctaccagatggaaactgtgcgctcagacagtatcatcttccagtttaccaaatgctgccccccaaagccaaaaggtagcaacaactctccagttactctagtcctagtctgcacgtagtgggcagtgatttgaaaagaagtaggcaaaaggcagggctgtgtgagagcaagttgatctttctcttgtgctttttggtacatgtagcctgagcgtgcgtgactggaagcgcctttctaaggtgttctaaagataattgcttcgaacttgtcagccatttgcttatgaaacttcctaactctactgccaaattcctgcatgttatatctttcatatatgtttttaggatttttaatgtttcttgtttttaaaatgaaattgcaagattgtaaatctctttttaaaataatttctttaaaattcccagaaaataaattctgctaagaagtgattgtaagtttgaatgtgtgtgttagctagtaagaatatttccaccagagttgaatagtaaagttcctagtataactaagcagccattgagagattctaagacacagagcacactcatgtcacttatctggagaggtcatagttttgctgtgctttgcttatatgcagacctacccacatatgaaacagatacgttgtgttttttcccccagataaatcaaaccttctcgtcttcagaacaaatggtatttctgatgttcagatctcaccaacattacagaggcataataatgtgaatcaaatggtgtttcacaaaatcaggaatgaagatttaatatttgtaagccaatcttgataattgggtggtttctttttttttttgtccctttaaagcagtgtcttttaaaatttcttagttgataattagattcatgttatagttgaaattttattataatttgcatttcaaaatttatcatttataaaattcataaatgttaggaaatatgccagtcttacagcataaattagcagaattaataatagagttatggtctcttttcagaagtttaaaaatattcctttgggaaatttaaaagctaaaataacctgtcttagttcccatgtatgcaagcgagtaaggggaattctgtggattgtctttaaggacttgaaaacaaaatagtctgtaggtgacggcttgactagtgtgtggtgtgagagggcatgtctttgtatcatagaggttagagtgagaagcattacaaagaaagggctgatcctaggtttgtccgagggcgcgacttagaagtgagatttatctcggaatagagctggaacctacaagagtgtgcatctagtgtatagagagtgaagtgtctgcctactcgcaagaggaaaaacattaatcttgtctgtttcaattgatttagtgaaaagaagaagaggagtttataagctgttgcgtgtaggctttgttagatcccttacacgatctgagaaacactaagccagtacgttgaagacggtgccatagacgcttggagaagcacatgcagagcttttggaaagcccactcgggtctaggaacatagttccagcccttgggggagaagcagacatatgaacagctttaggacatccttggctccatatggagttgagggcgattctggactatatgaggcctttcctcaaaaacaaaacaaaataaaaaacaaacaacaaccaaaaaggaaagagagaaagagagatgtttccttaactcacattttccaggattcccatagataaaccactccaaaaataagcttttaattaaaaaaattaaaacatacagggaagccacccaaaattaagtagaggtcatcaaaccaaacattaaacttaaacttctagtaattttatataattttcaagtatagaccataaaatgtaggtatctttaaagagggcttgaaaaacagcaaaatgaaaacatttaaggtgtgtaacttaaagacagaattccaggaaagaaggaatagttgtgtaaaaacctactgttgtacttgccgcttagtagacagtgtagaaagcaggttcctttcccgcccctgacctgagactgagggaattggaaagcaaccgtggtgtagctcagcgatagataggggttgtctagtgtgtacaaagttccaactttagccacagcatctcaaatgtaacagcaaaccccagaatttttaaatgaagcatattggcttatgcctgccacgcgtgtgctcaggagactgaggtagggagatagtacactggaggctggcttggggttcaatagtgaattccccagcctcagcctgagaaacagtccacacaagggagatggagaaggacagagggagagggacagagacagagagagtgggtggaactagagaggggaggaactgcagaatgcgagggcattgcttttcaggtgtgacagaagcagagagcagccggggaagttgacagttgaagtgctgtgtggtggagcagcttcaggatgcaggccttcagcagttattctgggcagattcatgataaatgctagtactcagagtggtggtggtagatggtcatctagtttatttcaggctttggtacgtccatgtatttactcacttattaatcaaagcagttctacaggacattcacattattcctcattatgtgaagagttcaaggccagcctgggccacacaggaaaaagaaagagagatgtgggagagggaggaacggggcagtgaggacagcccaagtagcagaagcacacagggattcattctgtagccttctgaagggcagctggtgagtggtcagagacaaatcgggctcctgcctccacactgtcctgcctttgtaccatatgaggaggacagcctaggaaggaccatgtgtcatcaaatttaggtaaaggctgactcgttaaggagtgcaatagttgtagccattgaaggagtcatgaaagtacagtagtcaaaacatattttattaatccttggttttaattattacttaaggaagaagagtagagaatttcgaacctcaaatttaggttcagttttaaaatatttatccttttaaaaaacatttttgtcattgaatatgtttcctattctctaattccttacttcatccatctttgttcacttcccactttcctttttttttttcttttaaagaatgaaagtcttggccaaggtacttttacaaaaatttttaaaggtgtaagaagagaagttggagattatggtcaactgcacaaaacggaagttcttttgaaagtcctagataaagcacataggaactattcagaggtgtgtacgttggttggatccttcacgtggctttttacactctgcaagtgtatgtattcataagcacattagatgcatgtgagacttcaaaattatacaattgtatgctttcattgcatatatcaattatgcataagataggtttcattatgatccatttacacacacacacacaatatatttcgagcgtttagtctgttaccttctcatgtctccctcccagtgatcctctttctcattccagctaacgtctgttctgctgtttcatctttgagtgacctggtgagctttattcgggttgcttacgtgagtgtgggtgacggttgatttacagggatatgctcgccttaccattaaagcagtgtgtctccatcccctgacaaccagtacactccttagggcgtggtagtcacgtgagctcctcctccctccacggaaggaagagtgttgagaggcctcgtcttgtgtatacatggccaggtaaacacagctgctttaagttcacgagtgcaccacccatgtgaagcccagagtgcttgttcataccacccttcctccggcgggcacacgatttctcctacagtggtccttgtagggcatatatattacttactttcccattgccgtggtaaacactgcaaccaaaagcaaattataaaggtgtttattttcacctgcaattccaaaaggataagagttcatcataacagagcaggcgtgacctggtgacaggaggaacagcagtgagaactggaagtgtgaagcaatggtagccttccaagaccatcctccatgagctccctcctctagcatcatctccccaaagcaccagcaacaaaacctaagtgtttggatacgtaaccatataggggacattgcttactcagtcacagtgggtgatctacatgtcttatttatggctggaatttgagtcacttaatctcagtacttggacaagctatcagtctctgaggtcactgctgaccactgcagaaagaagctagttaggaccaaggctgacggcaacgctggtttgtgcgcagagaccgttgtgttcggggcagtgggatggagagcccgtgctcatgtgaccgacagcagcagtagctgcactgctcaggcctacgacctccccagtcacaaactgggccagctttacggttccagacctgaattactccagcaaagcaggtctcaaatctaactaaaacgcaacctgtcaaaagacctgtcaccatcgagctgttaggggcatcctgtctggctgattgctgtgtacaggagccatagctgcgtacaggaagactgtttgtgacagttttgacctagcaactagccccgcgagggctgcagaccagggaggaagcttccagcccagttctgcatgatttatttatgtcctgtgactcagatgtgtggcatcttcagcaacaggctcttacagtctagcctggtgcacaatcagtagccatggtaattgtgtgtatcgtcttgagggcctcaggcctcactggtcaaccatgtgtaaggaggtatcccacccctggtgctaggattaccacttcccaacccatggcttctgggaacagctttatctatagtacaagatccctctgtccagactcctgtggtttttagtttagttttggttagcttacagatacctgatttacttacggattttcacacattagtttttcttgactgtcccctccccttccggcccctcctcccctccatctttcagtcttttcatttctagccttcccttctacttttaaatctatacattctgttaccccctcttgcctctcatgagctctttgcttatatttagactctatacatacatgtacattcacatgcataacaattagaaggtagggttcatacaaaagagaacatgtggtatttatttctttgagccaaactgagttacctcacttaatactggtttttttttccagttctgtctgttttctttcaaatgaaatgattttcttttctttatgactaaatgatatgtcattgtgtatatgtattttcattatccagttgtcagttaatgggccttgaggctgattccatttccttgctgttgtgaatatagcaacaatatgtatggatgtgtagggatctctatagtagggtacacagtccttcgggtttaagctcagaagcagtatagccggtcacgtggaagttctgtctttaggcgttatgtgtggagtttatgtaggtgtgtgtgctagagatcaatactgggtgtctttattcctctccaccttacttgttttagaatgtatttattctatacataatttcatgcatatataatgcacttggttagagtgctgttgagggcacccgactcgattctataaaatatctataaaatagaatattgccctcagcagcagtcgctatccagaaatgaccctcagtgagaagagagcagtcctcagactgtaaaccgtctccccacaagcactaatcactttaagaagtaaaggagcactgacagtctgtatgtgtggagcattagttgtcatgggtatgtggaaggaaaaaggaaaacccaccctggactcctgggtggcgctgggggaggaggaacttaaaatgggaatggagagtgaagaggagcggagagcacttctggcaaagggcagactgcaggagagtgctaaagtgatgacgaaagggtctgtgtcccaggaggctgagtgtgcatctgcacagcaaagcagaccagcttctttgagagaaaaagagtaaaagaaaggagtgaggaaaaatattcctgcagagcagggacaagctggcctgctgatgatattgggtattaaacaaagatggttagcagagaaaggcctggatgggaatacacagagtggaaactgactggccaggcacttcatccccttttcagctcctgtcaaaattgtgccttcttttttttagaggagcatcgatgactacatgatgaggagactacagaacatttgagaattttattttttctataaattttatccttagggtttatttagttatttctttttaatttctttattttttactttatgtcatggttgttttgcatgtatgtatgtctgtgtaccatatacgtgcatagtgtctgtggaagtcagaagagggtataggatcctttgaaactagagttacaaagcagtggttaatggccctgtgggtgccaggagccatctttccagcctaaaattagtagaatttttaaaataacattaatgcattacttgctttcagtgttgtgttataggtatagttaaatctttacttatactgaggctactccctttaaatgtagctacttgagccttacagactctccacggtctcatctacggaagaataagcttggagagcaccaaactaaaaattccccattgtccagccgagagtaggacacacgctggttctcttaagtcaggggtatctttctgagttctgtacttacagactctttggacagacattccttcacgtttcttgtctccctttgccccctctagtctttcttcgaagcagcaagcatgatgagtcagctttctcacaagcatttggttttgaattatggtgtctgtgtctgtggagaggagagtaagtaaagccagctgcttgtctttgtcaatgtcatagcctgtctcagaatccttctcatttagggctacaataggtgtcagcaaaaccttggaattacagatgttgttgaacttgaaagcactgtgggactgttcagttatatcttgtaaaacaaaggaactggtgtttaaagctaaaatgtagaatagagttaatatgtcttactaaagcccaggtgatggatgaggattacagtaaacaaatacaagcttttgtgtgcacatagcaatacagattatgggtgactcgtgtaaccctggagcaactggtcctttcagtactaactgatttggagttatgaaaacaaagcatatatgaattattaatgaaactaaagtgactgaatattggcactaggtaggttccccagttatgctggagtatgtatatttacactatataataagtagcatgttatatataaaattatatgttaggtatacattgtttagcatcttacctcttactgttgtgaataagccaaaaacaaaagtacaataaagtgtttattgtttccctgatgttagtacagtttgtttaatttgatttatttgcctgttgtatccacaagtaacctaagtactttgacattttgagttatgcatttttaactggatgtatacgtgagctttatcattacttgtattttaatgcagacattctggttcaagaatttgtaaaatttggatcactggatacatacctgaagaagaacaaaaattccataaatatattatggaaacttggagtggctaagcagttggcatgggccatgcattttctagtaagtgattcctgaattctttaacaaactaaaactccccgttctgttttgtaaaagtactgtacatatcttaacctggcaaccagaaggaagtcttggaatgagtgtcaagtcattcagtgtgttaggcattgaaagggatgggtatacacatggaggtcttgcatcagctttgaaagggttggttatgcacatggaggtactacatcagctctgaaagggatggtatgcacatggaggtattgcatgagctctgaaagtcagcgctgcctccactaacctcctgcaactaccgtagacacccatagtttatatcacttgagtttatagatgcatattgtgctactgcaatagcagaaagcaggctgcggtatttgtaggcattgaacagtgtacagtgagaaagcagtattggcaggtacacactgccagagtgccttccagttattagtgtatgtttactgaactggaagttgtttttcctaatgtcagctaccacctagaagtgcttatcatttagagtctcctttgaaaagtaatgctcatttctttgtgggtatagattactgcatcagttaaagaaactgaagacttccttttactgtctaaagtacactccacatcagtattaactgtgctgtgttttgtcctctttaaatctgtactgtagttttgggcatattatatgcacacatatttgtatattgatatttgaatgcatgtgcatttaactttaataggaagaaaaatcccttattcatgggaatgtgtgtgctaaaaatatcctgcttatcagagaagaagacaggagaacggggaacccacctttcatcaaacttagtgatcctggcattagcattacagttctaccgaaggacagtaagttctgtaccggctgccctcagcattcttaaatgttgtttgggtggtaccacgaaaatcatgttaattttcctttcattctagtttattgctgttcttgcttactaatgacatttaactactacttttagtaatttaaactgttgtggttaaattgtgactatgttcatttctccttttgtaaaaaagtacattactgggctggagagatggctccgaggttaaaagcactgactgctcttccagaggtcctgagttcagttcccagaaaccacatggtggctcacaaccatctgtaatgggatcagataccctcttctggtgtgtctgaagatagctacagtgtactcttataaataaaataaataaatatttttttagaagtgttctaccatacactgaagttatgcttctgtgcatctatctgtatggaggaggcctgcgtgtggcacagcacatgtgtgcagtcagagggtaactagtgggaggtagccctctccttccaccatgaggccttagggttgcacttctattcttgagcttggctgcaaacacctttatccacttaagccatattgctggctgtatcttaactaattttttggctgaactttctaaattaagaatccatattaatcagactttgtgcattggtgtataatattctggtttagccaatgctacttaactttgatagctggctgaaaaggacacgcatcatcggacagtagtgcagaaaggaaagcctcacagggatttttagatctgcatttgaggaaattgacctttcagaatgagaagttaaattgaaaaaaaattatatagtaaaggagagaggaactaatgaactatttaacctcctccatatgtaggaaaataatctatattgctttaccagcaggtagaatagtatcctcattttcttatctttttctctttatcagagtcctaacagagagggttatactgcttcttccttcctttgcagtggtgttcaggactactgaaactttatttgggaaattccatgatttgaacattacccagtctgccaattccatactgagactgtttgatataatttaatcatttgtctattgtaatgatacctgttgggccttgcttatctgccagtcacagtgacctctgctgctaagttgttaaaacacccatcaacgatgtaacattacttatatgagatatgtgcacacacacacacacacacacacacacacacacacacacactctgaatattgagagtaaatcttgcatgtttgtttctgtggtagagagaggcaggactaatgggaaggtggtggaagtggtgcccagtgagacactttggtttaatggaaagaagtttagttgatctaaatcattacacgggatactgattctgacaacattcttaaaactatgtctctgtgggaaattccctcatttttgacgatctgaattgtcaaagctgagttactgaagtaggattttaaggttcagccagcccttagacttagtaaacttaagccagtcctgtacagctccgaaagacttgattattcaagtaagtttggaactcttcacatatagaataatggttgtggagcttaattaacgatagtttgttcctgttgtttccaagttcttcaggagagaataccatgggtacctcctgaatgcattgagaatcctaaaaatctcaatctggcaacagacaagtggagcttcgggaccactctgtgggagatctgcagtggaggagataagcccctgagtgctctggattctcaaagagtaagttcatgtgggctgacgggagaggcaccccgattccttggggctcttccatggtgtgttcctggcccttctaattgtgaaaagaactcgaagtaacagcactgtggagtgtgtcttaccatttggccctttcattatagaagctgcagttctatgaagataagcatcagcttcctgcacccaagtggacagagttagcaaaccttataaataattgcatggactatgagccagatttcaggcctgctttcagagctgtcatccgtgatcttaacagcctgtttactccaggtgaggactggtggggccgtctccccgaccactgactttctatctctcttgctttaactggatagtttctcattttttagctccatctgagacagtctttgatgtcttgccgtatatatgtcctacatgactgggcagtctttattttttaaaaagatattcttgccgattataacctaattttatttacttgtttattttgtgaacaagaaaacttaaccacagaatttattatctgtgtctaaaacaagagttttttttaattcattgcatttttagttaatgagaagcaagtttacctgaccacacatgttactcgggctacatggagtttataacaagcccccctttgttttttctagttcccatctattttgtaattgacttgttagtgtaaacgctagataggcttatttttgtatgtccctacatctggagtgctgaaatcaaggcacagctgccccacagctagccgttaggacttacctctcactgcagcaattgagtaggacctcactttgtgaatagcctgtttaggaaaacagtattttaccttttgaaaaaaaatctatgttgaaagtctgggtaataattaaaggcccctatgaatataatctaaataattttgcatttcccgtgttatttagtattctaaaatcgttttgtttcttaccttgaatatcagttttgcctagagaatgtatctgaccatttaatatgtgtcattccttattcctacagattatgaactactaacagaaaatgacatgctaccaaacatgagaataggtgccctagggttttctggtgcttttgaagacagggaccctacacagtttgaagagagacacttgaagtttctacagcagcttggcaaagtaagctgtcataagttttcaaatagaatataatcagacattgtgttttggaaacaaaaaggctttggactagagttactaaatatacttttcacaaaaaaaatgtaaggggttatttgtagagaaaaaaaagcttatttgttgaatattagagaattttccggttaaataacgctgtactgaagaatacttcaggtcctttaacatgcagtgcacattcaacatcttttaagaggatagatataaactaaggagtacatcccaaactgaaggtactctgcgtctctcgcttggaaggagaagttagtagttcagagtaagttagggtaagagagaagggagcatacagcattctgtttgctttccaacttcatcttgggagaaatagtctgagtgcttagagcataggaccttgaatgaccatgttcactaacagaggttccataaaaaggttgcacactcgtacatagcctgtattatacagtctatactgtgtaacaagatgagaaaagccacagtgcttagcccgcccgttgtggtgatatgctctcttccttgtctgtttaccgcgatctataccatatctcagtatgaattggattttggcatagatagaacatgaaggcttcactgagacctttacctaagtgagaagtttcagttgaatgttcctaaaactaagcactgagggttacggtaaagttagcctaactgtgctaatcattgactcttcctttttctgtggaatactcttgggaatatttgaggcatatagccattcagagagggaaagttctggagttattcttgttcttataatggtgccacccttgtgaccagttaacctttaccactctgtataagacactaccgtataagacattagggttaggcctccgttgtataactctgtgggccgcacaatactcaggccgtaacaacccttgttcactggcagtagagttaaagtgcagtgagatagacaaaaggttaccggaagtcagttatagagacttaccacagctcctagtgtaccctgatttgtccttaggaactagtgttcaccacttgtttatcttttccaagagtactccttcatctcaaggaggttgtttataggcatactacccagtttttaaaataatacttccatttattgctccaaaagttgtctaacagaagctgggaattctttctactgattctagcagccagcattttctgcatatttagaaattaatatcaagttgtcttggaaacgtttggcttccaccctaatggctgtgttgttagggtaacttcgggagtgtggagatgtgccgctatgacccgctgcaggacaacactggcgaggtggtcgctgtgaagaaactccagcacagcactgaagagcacctccgagactttgagagggagatcgagatcctgaaatccttgcagcatgacaacatcgtcaagtacaagggagtgtgctacagtgcgggtatgttgccaggcacacttgtctgaacttgacagcgtgtctttgtcatccagctagtatattagtcagtgcccgagagcgagcgagccttggagattgtgcagggagatctggggctgtaactacaacagtatttccgctggttggttaatcatccttctcaccactcccttaaggaagaagtgttaacttttttaacaaaattaatttccttttataatctattaaaatgtttttatattagatacttcttataattgaaaaaaattccttaaccgcttatttagatttgtaaaaataattaaaggaggtttaagaatatttataaagcttctttaaaaatttggattgaaaacctgtattcctaactattatatcacctttaatttaacttttatcatcatggacccagattttgtatatacttaaatcagttacatatagcttttttcctagtatttaatcagtaaaatacagcacaagaaaacattgtgttccttttgtatttaaaaggtcggcgcaacctaagattaattatggaatatttaccatatggaagtttacgagactatctccaaaaacataaagaacggatagatcacaaaaaacttcttcaatacacatctcagatatgcaaggtacccaccatcccacatgtctcttatagatgaaataaacatggtgaactaactcaaatcatacaaacttattcttaactaataaagagaacttgtaggaattcagccatataaattatatttatatgactactaaaagaaaaatgtgtcttttggttatagggcatggaatatcttggtacaaaaaggtatatccacagggacctggcaacaaggaacatattggtggaaaatgagaacagggttaaaataggagacttcggattaaccaaagtcttgccgcaggacaaagaatactacaaagtaaaggagccaggggaaagccccatattctggtgagtacggcggcttttggtgtaatggaatgagacgttagagggcttgcttcaaacttcaatcttactgttcctaaatgtataatatttaatcatgttcagtttagcacttttcccaataatagcaatatttatcctatgctttgtattgagctaatttgtattgagctaaatgcatctcatgtattatctcaaaatgagtagttgtgagccacctggcatgggctctgggaatggaaccgggtcctctggggattgaactgggtcctctgggaatggaaccaggtcctctggggattgaactgggtcctctgggaatggaactgggtcctctggaagagccgtatgtggtctcagctgctgagccagctctccagcctctcagggttccttattgcaacccacagagaatgtatatttctatgagtattagagatgcaacagtcctaacctgaaaacccagaaccaaaaggcactaagcatgaggcatctcaggtgctgacgtggttctcagcctggatttgcagtagggaagcttcactcacagacattttatgtaagacaatgtcccagaagctgaaaagctctgagaccagaagcacttctcatctcaagcatttctgacaaggcctgtggctccatttactcaggagggaacttactgtacatataagctaagcagcttgcccgaggtgtatgactaataaattgtagcactgggattcaaactcagtctgatcttagcgtttacactttcagtctttctagatcatgataatgtaataacctggcattaattaaatactgaatttatagtagttaggcattagaagtaatttttgacctttaactaaaatggccaggaacattcataacttattttacttatttaaatattttatgagcattaattatacataagagtaggtgtcatggcagttttcgtacattcatgggatgtattcggtcacatttaccctctgcctcaccctcacccccagctgcctctgttatggactgggctgcttgtttccatgacaacccaggggattggttaggctttgattataggaggataggtgagggtttggactttctcagcagttcctctgcttaagatattgatgtgagcccataagctcctctctgaatttaatgatggagtgccaggcccagctttatgtgagtaatcagagctgctatgagttcaaaagaggggctgctgctgaccaccgggaacaaacttcttacactcaggctgacagcagcacttgtgtcccggcataaacagagttctgtagaaggtgatgtaatggacccaggcccattcaccagaggaatggcagtagcacacacgcacacacgcacacacacacacacacacacacacaaagtttcagtgtgttcatgtaggatgcattttgtcttctaggaatgccacaatgaacttctttttgttttatataccattccaatagaatttctggtttatttctctgctgaagtaatgctattaagcagtattgtatgaatcaaaggatggtgtttaaaatttaggaagagtaatacaaagaatacaactgtcaatttataagtattgtctaaatttttccagttatttaaaaaatatcagtttgctagcgctaacttcacgggtcatccatatttctgggttatgtttatttaatgctctaaatttacagctcatctttaaactgttctgaaagaattttggttaaaatatttagaataagtgtttccacataagtttatcggcattataactgtgtgttaaaggaagaggttccttcccctctactttagagatgtgatgattcacatcactgtaaggtacaggtgtgtataggtgagggctttctcaggaggactctgcttactcaggaaacaaggccaataattgacaagtgggacttcatgaagttaaaattattttccttgtcttctgtgtggacaaggaaacaatcaagttaaaagcaccctccagagtaggagagaatcgtggctagctgtacatctgacagagaattagtatctagaatatacagacgactaacacactaaccgccaagaaagcaacccctcactaagcccttgcaagggagattgagtgaatggcagcaggctaggtgtggtgagtagtagacctagaaagagactgagccctgccctgacttgaatgtcccgtaccatcagaaaacacagatatctcattactattcattagtattcattactattcactagtaacgattgctactgttatagtagcaaaattacagttatgaagcagcagtgaacataatgttttggttggggtcaccacatcgtgaggaactgttcttaaggatcagattaggaaagatgagaagcactggtttaggtgaatacatcagtagtcatggcaacagacatacggtgttcattttacatctttataaatggaaacacagagaaaactgtatttcagtagatggaagattggctacaacaaaatacatttttataattcctggataagtaactaaaacgtatacaatgagccagtactaaaattatctattcttaggtgaaaatgtattttttttctcactagtattgaaaataaagaataaaaccaacttgactttcagaaatggatttagtagctaatctgtagttactcttttctcttcatttctgggaagaaaaaaacaaaacagttttgaattaattaaaatgtttctattgcactattgtagtgatactttatttgaactgatctattcagaacttggagaaacagattgtcactcatttcaaattaagtacaatgttttaataataccttttattatatataattaaatcaagttcaaaagattaagggttctttgcctttaaaaaaaaattgttgttgtttagaatagccatcctgtaacccatctgcaacaccatacctatttaccccctgacccccaaaagactcactttctaacagagaaagtcttggctcagttttcttcctggccaagaactgtcttttgttcaagtgtgtgtgtgtgtgtgtgtgtgtgtgtgtgtgtgtgtgtgtgtgtgtgtgtgtgttatgtgaaaactcaaagttagcatcaggttttcttttctttttttgttttttgtttttgttttttccgagacagggtttctctgtgtagccctggctgtcctggaactcactttgtagaccagactggccttgaactcagaaatccgcctgcctctgctgggataaaaggcgtgtgccaccaagcccggctaggttttattttctattcatctttccactttagtttttgagataagactaaacacagaacttgccatttttgccagcaagtacccagatctgcctattttcttgtccctcagtgcttgggttataggttgctctccctggctttttacatgagctggggatccgaactcagtcctcatgccttttacagtgatcaccttacccacagagtcatacctgcaagtgaaatattatttttgaaaaactagcagtagtaggtcagtgaagtggctcacctataaaggtgcttgctgtattgacttgagttaatccccagatccaggtagaaagtggaaggagagacccgaatcttcacggttgtcttctgacctccataggcacacatgctctgtacacgcatccccttcatgtgcaacgacacaacagcaaatgcagacatactggtaggagcacacagaaggtccagtgcgtggttcctagcatcagcaatccagaatcgcagagaatatgtgcttctgtaggcgtcatgaagccagtgagacgtgctgcagagcccgtcctgtgtgacgctctttcctgatgtttaaatgcatgccttagttttcttttggtcatggtaaaaaccaccagacaatataagctttggcacctggcttcctgagtatgtggagacataagtcccgagggcgggcagttaatatgaacatgagtaagacacattgttcatcgagtctttccacatcgtcgtgttcttccatggaggaaggtggaagggcagcgccatgcagcctgttctggagttcctgactctgattctccactttctctaaggagccccttcctatactacattgaccattgagtttcaacacctgagttttggagagaacacagtcaaattctagcaaacaaaattaagatatgaaagaaatcacacgcagtttttaaccatagaagttagtcatggtttgttttttttaaagcttgattttatttaaaaataaatctttgtcctccttaatactttaattattcaagatgctgttttgctttcatctcttggcatgttccagcatgttttaggggttggtactaagagcttgaggaaaagtgcttctacttcagtattgaaaaaaaatgttggggctggagagaggatggctcagtggttaagagcacttagtgctcttccagaggttctgagttcaattcccagcaaccatgtggtggctcacaaccatctgtaatgggatctgatgccctcttctggtgtgtctaaagacagagacattgtactcatgtacataaaataagtctttaaaaagaaaaagaaatgttgaagcagaatttcaccctacagggaaggcgtgtgctgttcttactacagatgtcatttgggcagtctgtgcatattggttactctgcagtagtcataggctgtggcctacgactgtaatgatagagagagtaagctaggagaccactctgaaaagacatggtggcttatttcacacagcagtgagagagttaaaaataattcctgggccaaccagaggctcagcagcaggcctgagttaggttccccaggatctacatggtggaagaaaacataaactcgtgggttgtctctgacctccacacatgtgcaaataaacaaacacatgtacacataaatacaaaaaatgtaaaatatctctaaaaattcctaagaatcctttcttgggtatagattgtgattccatttattgtataatcaaagccaaacactcagcaggatttgggaagatggagttctgtttacctgcaggtatttaatgtggaaacgagatatattagagccaagagaatggactgtgtttaggagactttggaagaagcatgggcaatatcatctataggaaacacggtagcatgagagggagggattaaatgatagaactgcaggaaactacatttagcagagagaaaagaaatgttggcagaaatacaattaaggccaacccattctctcaactcaaaacccgtctatgaaagcaggagacagaaaggacctattgttgaataaggattaagtatgtgtgtgctgttgcatttaaacaatccccgtgtaataagagatctccgagatggaaagaaatcttacatttttctgtactcaggcagaaacagcccactgcatacacgtttactgcatggcattattcctccagtgaaaggactgaaccgcactgcttgtcacacatagttcatcctaaatcccctgggtgaccgtgtgactccctgcgccgggtactggtctcaccatactgtgacatgggctagcacttggaacgaggctctggccgacttgggttcctcccctccccaagaaaccagaagaaaggggcattgccacctttgatgatgatttccaaaagacagttcctaggtggttgctaattatgtttctggatcataaaactgacagtggcttttaagcaagagcatttcaaagagacataaaatgtacaagttccctaaatactacacaaaaaaaggagggaaaaagtcttcctcttaagacccacagagaaaagtgagccttttcctgacttgatttatctttgtctaagtaaaagagcattaggtaatgaatgtacctgggggttggcaatatgtaaccaagaaattaattacaaagagcgctttgctaaaaacaaaacaaaataaaagccctaaaactagaaaacaaaaacataagaacaggatggctgtcatctcagtacttgagaggctaaggctggaatttgagccaagctgggtacatagaaaaacctgtccagctttttgaaaggagggagaaaagcactttaggatataggataatagcattgtcttaaggagattacattttgctaatagaataaaaagctattaaaggcgtggtggcacacacctttagtcccagcccttgggaggcagaggcaggtagatttctgagttcgaggccagcctgatctacagagtgagttccaggacaaccagggctacacagataaaccctgtctcaaaaaaaaacaaacaaacaaaaaaaaacaaaaaagctaagtacacagattccgtactggttgcatgtttgtgtagtacaactgtaagtctagatgtgcaataagcagcccgattagtgagcttgactacttagggaaggacttgtgcaagtaaaacttaaattaggttttgaaggaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttctgtgtagtcctggctatcctagaacttgactggtcttgaactcacagagagtgacctgcctctaaggcttgttcatgttttctgtctagccagtcaaacaggtctctgtagctatttctatactaaagacatgcttgtccatggaactacaaaactcatggtccactgcccacctctgactgggataccactttcctgtggctttgtattttctgtgttctcttccataatcactccctttctgatttttttttagatttatttatttataaaccttatgtatataggtgcttgtatgtacatttacacaccagaagagggcagcagactccataggactatggttatagatggttgtgaaccaccatgtaggtgccaggaattgaactcaggacttctggaagagcagccagtgctcttaagccctgagccatctcttcagcccctcccctcctgattctcaaggcttcaagttacatttctggctagaaactatatttcctccacctatttttaatctggatttctttaaaagaacaacttaagagcatctcgcatttcaggtcttagaaaaacttatcatttaacacctggtgtgccaacaaaagaaaaacaatgtgtttaggtttttgtgtgtcagacgtctcgggaccaggctttctgaattgttaggaggacccactgtcagcatgtgtcagattcatagctgtcgttcatcactggggagaacagcagagcaaaggccagatgggaaaggtctgtggagcagataacaggccttctgtcccctttgttcccctgggtgtttgtcatttgtttgtttccccctccaatataacgtgtcattccatgaagtaactcttctaaatgattgcaatattgcaggtacgcacctgaatccttgacggagagcaagttttctgtggcctcagatgtgtggagctttggagtggttctatacgaacttttcacatacatcgagaagagtaaaagtccacccgtggtcagtgcgcttcttagtggcgtagctccccgagccctctcctgctgcttaacttttgttttaagcacaagaaaggcattatccaaagatgagtaacatgtttacaacctagtttaggaccctgttgttatttatttggggacaatattcaataatacccaacaaaataactacaaacaactaaattcagtgtatcctcttgtccattgtctctgtgactgtaacaaaatacatggtactgagtaaattcataaagaaaagcttgcagttgtggagattgaaactccattatcaagccaaggaccctttgggatctttacaacatggcagagaagcagaaagagaactaactgcaaaaacccatcacaaggcaaggcttcggctgagagccaggagggccagcattctgcttcctgtagagcagctcgctctcccaggaagtggaacccgcagggagcctggtgttatcccttacagagcccatcattccagcgctgccagggcccaggcctccagaacacctcagtggcatcgaagttacattgagtgtgcccgtacactttaggaagcattgcacaacctaaagtaaacttttggaagtacatatatatttctttcaatatagggaagtatgaaaaaaatagaaattattttaatgaaattactcatagataaccattttaatatagtaacattttctttcagacttatatataaaaatgaaactttagaaagaaatacctattgttttatatgactgagctttgtagcttcctgtgaagtcctgttaattattacatcgtttcataatatctcactttatctgtacttatctgtacttactcactgcaagtatgattttagttatccagtaccattctgacacaaagtcgcatatttctggataatcatttaccatttttatacataaataaatacttttgtttgtggctatcatgttagaagaagagtgtacttgttagtgagaagttatgagttagtaaatcgctgttgattgtttcaaaagaagagctgcatcaggctatgtattcacggcactgagagggccgaataattctctattcacattatatatttaatgaaatattaccaacctaatataaaaattcttatatctattttatcctaatttgcatttgttttattagtgtagtaattatttagcaagtcatttaaaactggtttctgtttcaggaatttatgcgaatgattggcaatgataaacaagggcaaatgattgtgttccatttgatagagctactgaagagcaacggaagattgccaaggccagaaggatgcccagatgaggtaacaagctttaaagtcattcattcattcttttgtgtgtctatataatgtgtgtgagtgtgtgtgtctctgtatgcatgtgtaagaaaaaggtgtgcgtgtatgtgtgggtccatctatgtatatatgtatggtttgtgtgagtattttgagtgtgtgtgtcttggtgtgtgtgtccctggaggtgggtgtacttggtatgggggtggggggttgggaggggaggtgtgactacaggcatacataccacagtgcacattgggatcagaggaaaaccttccagggttggttcttgccttctgccttgctgaaacaaactttctgttgtttctactgctgcactaagcccaccaggctggttggtcctcatgactgcctctcatgtcttagtgctggaattagagactagtgctgttttgctggctccttgcatggtcccagggactgactctcattaccaggctctgtgtacagtcctgtttgtctactgagccatctccctgatccaacaatttttttaatccacagtaattatccattttctttgttttattgagaacatacacagatttccttttcaaggtataaccgtagcattattattggcctacgtaaattaagatttccaaattcatgtcatcctgtaacaaccatggtactttgggtcactctcactttggtttcactttttcactgtacagatttatgtgatcatgacagagtgctggaacaacaatgtgagccagcgtccctccttcagggacctttcccttcgggtggatcaaatccgggacagtatagctgcgtgaaagagatggccttcactcagagaccaagcagacttccagaaccagaacaaagctctgtagccttgtgtctacacatccttatcatgatgctagctaggcagaagaaactgtgacgccgtctgctcaaagctttggaaacgccgtgcgtttgtttctacaccatctgtaaaaaccactgctcaagtctggcagcatgcttgtgggctgatgcatggagctcaccacagagtctctgcatctcctctggcagaagaagaaaatagacagttttcaactcagcttttttgagaaatggaaaaaattataatgtaaattttgcagtgtaggaaatacacagaacatacatgtacagtttttaccacgtggagtgtataatactttggcctcttgtgtgatttacatgagggctgatgtttgttaatgttttctaatttttccataggtgatctataataacttcatgatacaaattaaaatgctcagaaaattaaataccttttctttcttgctcatctttgctgctctgttagggcctgtagttccatgccactgtaaatatttttcaaagcaaaaggaacaaaggtctagttttacttgtataggaaatcttcctgaccctaaagaattttgaaatgggacaatcttacaaagacacagcacaatctattttcttatttgttttccttgtgtttatggtaaatgtgtttttaaatagaactgtctccaactttttctatgactataatgaatataatgaatccttttataattttgagattaagaatgccagaaatacttccctcccttgaactgttaactgccaatgagatgtttcaatccctaagacttgtcattatacattaaattgaagcataagccatacataatttgtaaaatgtacaagctctttaagatgctttctgggttggaacatggccaaagactgtgtgagaggcctccaggtttgccattacagctgtgagagaaacgtcctttcctcagcgtctcccagacagatgggaagggaagggtgtggggcacatgctgttcatcccattcaagaataccagcaggcgtgtgacgcacatctcgagatgagaagagagagcgtacatcttttcaaagtataaataattgttatcatccttcgtgctgctccctcttagacaatgtcatgtcaaaaataaaacaagatttttgtgtgttatttatacaagattttaaatatttggtaatttgtttaaaaattctgttttcagtggtgtgttctgtttttgaacgtggacttaaagagttttggttgcgctgaagagacgagcctctcacatcctttgagaattttagtaggtaacatatacagaaaccatctatggtggtgagactagtggattttgttttgttttgttttgttttttaatctaatatgtattttaatggaagtcagatttatttttatgtaatttctcagatctcaaggaagtaagtgtgtgtgtgtgtgtgtgtgtgagagagagagagagagagagagagagtttttagttctatagcatctaggatagaagtagtgtatcatataatacaattgatctgagatttttgtactaaaatttaacattttcataaaagactaacatttacttatttttaaaaatcgtaatataaactacattgttaggctttttaaaatatttgaattttacttttaaagaatcttgcatgcatattcttaagattgtagaatgagatgacagtctaactgtaaaattcaaagttgtgaaaagacttctcattgagagttcataatctttttagttttggtttgaatggtacacataaagaaattattcccatagttagaacttagtgccacatgagaagcaggtatcagatgtttcttcaagctaatatttcttagaaattaagcttttttcagaattttataattatgtaaatgtcagatgatggtattctataatcattagataatcccatactattgtgggtacttggttttagaacagcagttctcagccttcctaatgctgtggccctttcatgcagttcatgttttggtgacctccagccataaagtgattttcatggctacttcataactaatttttctgctgctatgaataacactgtaaatatctgtactttccgatggtcgtaggagacccctgtgaggtggccattcctctcccagaggggctgcgacccacaggttgagaaccactcctttagaaataaaaatttgtgatatttttatatatatatatatatatatatacacacacacactgctggtagcactgcaaaatttactctagcaaagtgccgtcttacagtcctaattttcctcctgaaagtgaatttttttacagttgtaacttctggtaaatatttaagttctaactaaacaattttattacataatagagatgaggaaatacctacatttctacatctgaggagccccccccccccgaacctggggtggactgtgtgctccatgtattgtcatagtaactacattattggacctttagcatgctctcacaagattggaaggttgctgtaatcgtattataggttattttcctttgtgtaatcacctagaccatcacacttgtatatatagatgaaactgtctcataaactcaagtgaatggtggtgtttatagctttttgctggatagtggtgtatctcagtgttggggtacctatagttttggattgcattaccgttatgacttaaggtgttgaatctttttttccagtgtatatttgaccatttacattttatgttttgagaactttctgttgggttcttgcctggatcatagaatttgtacataggtctgaattgtttatcagaaataaggttctcctgatgcaatctttggatccttagggtattgggtcatggaatctgtacaccggtctttctatttctattccttttgctatcattttattctatctcttgcttgcttactctggttaagcatttaatcttggataagggtaggaattgatgcccttgtcatatttatgattttagaggacatgctatcagttttccactattcagtataaatagggatatattgcctttcatattaaggcatgatcactctgtttcaggtgtcttcagggcttttatcaaaagaagttggattttgtcactttttatccacttattgtgcttaaagtattatatgtatatttacctatataggtataggtgtgtgtgtgcgctcgtgcatacaatgcaccatatgtccctggtgatcccagggtctagaagaaagtgtcatatcctctagaactggagttatagagagtttcatggcaacatgtgggaactaggtattgaacctagattctctgtatgagcagcaagtagtcttaaccactgatcctatattgtgattttaaatgttttattaattatttgataattatatacagtatattttgatcaaattcatccttaagtctctcttaccatccttgcccccttattcttctcccaagtccaggttgtattgcccaactacacctggagtgtggtaaacctaccaggggctacatcattaaacttcttcctctttcaacagctatcgagtgctaatagctcctcagcttgtagtggaaataccatgcccacctctatgctaggattttatctggcttgaacttgtgcaagtcttgtgtatgtgttgataatcaccatgagttcgtatgtgcatttgccctgttgtgttgggagaatactttttttttattcagtatgtattgaccagttgaggatttctgtgttaactgtcatctatagaaagaggaaacttctacttatgaggtcagagagatgtactgattcgtgcacatagcaataagttattagaagttattttaatactatgctcatttagcaaagaaacagtggtaggttctcctttagggcctaaagcctatttagctgagtcttcttggccctgttaacagtactattgatgggtcctatctcatggagtggactaatctaatcagaaggtggttggttgctcctgtaacatttgtgccattattgcactagtggatttatcttgtcaggacagttgtttttgtaatttgtaggagtcacagcagggtgagtctaatggttttcccccctctggtagcatggatatcaccttccagaaccatcaaacttcgcagagatgaagcctccgtttgagtacatgcttgatgtctcagtgttcacagttcaacatgtagagttcaacatgtaagagcaacaggatcttattgtcaggctgtggaggcgcacagtgattcatgggtggctgctttgaaacagaggagggaatcccctgtgggtttgatatataaaatgcagagtccgtcgttgcatcctaaggcaaggactggtacgtgtgaaccttaagaagtaccacccacagagggagaactacagactcacagaaggagctgggctacagtgggcacccagatgtgtctgtcttactgaccaacatcagttgtagccatcagcggagtgttcacacgtgccaaaagagctagatcaatggtctgtgctggagaaatgctcagagactagactccagcaagatgagtactgaagtaagtaagggttgaccgtggctttgagatcctgaaacttaaacttggcatgagaaaatcagtctcagaacagtaataagacaagcgaagaaaataaaaaggatacaaataggaaagaataaaaaatagtctctatttgcttatggcattatactatacttagaagaacgtctggtttctacaagaaaagtctagaatctgataagtgctttcaggcaaagtttcattatttaataccataatacacaggtcagtagcttttctatgtaccaacaataagctggctgataaagaaatgaaaaatatctattcataatagcttcacaaaaataacgatatccatgaataaatctaatgaacgggattaaagatctctgtaataaaataagacacaaaaatgggaattgaagaagacactagatgatggaaatgtcttctctgctgctgtattgacagaatattgtgaaggtgggtacagtatcaaaattagtcacatattcaatgcaattaccttcaagatctcaaaaacattactcaaagagcttggaagaaaactcacattcatatggaaacacaaagctaagagaacactgttggatagcatggtgcctaatctcaagttatactacagagcaatagtgacaaagatagcagggtcccaacacggagccagacgtgtgcaccacgggacagagaaaagaacccagaaataaacccccacagctgtaagcactgcttataacaaaggagaaaaaaaatcagagcaagggaacacacctctttcaacaatgggtgctggggaaactggcattggtacatagaagaatgagcctagatccatatctctcactttgcacaaataccaagtcaaaatggaacaaggacctaactgtaaagccttagtcactgcaactgccagagaaaacacaacaaaatgcaggcttaggcaagtgagttatggtagcacagtgaataccccaagagtctggaattgggaaattaaaacaaacaaaacctacatagcaaacaagactagcagcatagtgaaaagacagcatacacaattgaagggaatctttgctaggtatatatccgatagtaaaatattcaagacacacaaactgccatgattaagcaacacaaaaatatgtattgaatcaatgaatatgctaataccctgaatagacaggtctcaagagaagaaacaaagtggacaataaatagtttttaaaggtggtcaacatcgttagtcattagggaaatgctgagtaaaactacaccaagatactttctcgtccctgtcaagaatggctaatgtcacaaaagcactgccagtgtgtgaacactgccaaggacgtggggaaggaggaatccttagtcattgtaagtggtgatataaatgagcacggccaatgtggccatcaacatggtttctcaaaaaaacctaaaaaagatcaaccagtgagtgtagtggtgcatgcctttaatcccaacactggagagtcagagacgggtggatctcaatgagtttgaggccaacctggtctacatggtaagatccaggccagccagggctacatagtgagaccctgtgtggattgttggaggaagtgtatcactatcagggtgggcaatgagacccttctcctaaccacgtgggagccatttcttctagctgccttcagatgaagatgtagaactctcagctcctcctgtaccatgccagcatggatgctgccatgctcccaccttgatgataatgagcctgtaagccagctccaattaaatgttgtccttataagagttgccttggtcatgatgtctcttcacagcagtaaaatcctaactaagtcagaagttggtatcaggaaccagtggtatggctgtgataggcctgaccatgttcttgtttgagtgatgtggatttggggactttgtaaagtggtgcgacttaatgggccctattaccagaagcatggaagacagtgttcctgagtgtgttttgaaaggcagggacctaactcaagaggtttcagaggagtagacttttagtatgcagtctagagatatttttggtaatattttggtgaagaacgtggctgctttttcccattgtccgaagagtctgcctgaggcgaaggtaaaggaatttagattaattgctttgacaaaggaagtctaaacccagcctgctataaattctgttgtgtgattactaaagttcactcttttttaaaaaatctatttttatttttaattggatattttatttgcttatatttcaaatattatcccctttcctggcttcccctctgcaagctccctatcccatcccccccttaccctgcttctatgagggtgatcccctaaccatctacccaatcccacctcactgccctagcattcctctacactggggcatcaagccttcataggaccaagggcctcccctcccattgatgccagataaggccccttcagctccttcagtccttcccctaactcctccattggcgtccctgtgctccgtccaatagtcggctagtcagctatgagcatccacatctgtattggtcaggctctggcagagcctctcaggagacagctgtatcaggttcttattagcaagcatttcttggcatcagcaatagtgcctgggtttggtgtctgcatgtgagatggatccccaggtggggcagtctctggatggcctttccttctgtctctgtccactctttgtcccttcagataggagcaactctgggttaaaattttgcagatgggtgggtggctcaaccagggggccatgtctaatatctggatatggtctcaacacgttctccttcctctttgtggagtatttcagctaatgtcatccctgcggggtcctgggagcctcttggcatctgggaccttctctctgaccagttcttctaccttgtttgtgcattcatctacgctgctgctgctgctgctgctgctgctaaattcctttcctgatatcagaacccaacttcttcaagcttccagtatagacgagtttggaatgaagaccagtgcctctctaggaatcctctaagccttcagtgccagactgggctgctgaggcatctggcattgtggtctcagctctccaatgtaaagaccgccattgttggaccaccctgatggaactctgtaagccaatccaataaataccttttcaacagatagtcattctattggttcggttcctctatagaaccacaaccatataattgaatgctaattttaaaaataaaaattactttttttgattactgcagggacttctgcttcctccggctaaagacttgacgaaaagatctctttaaaaatgattcttcactcagcaccactgaataggataggaagagcaggggccattcttcaggatctgcttgctgtgttgaccaaagacattccttccctaacttttagccagcgccagcggcagattgtgtccttctgcagtttggtgagatttttttttttactcttttgcttaaagctttgttgggattagggactgttctttgaccctccttactgtaatgcctagatctgatgttagagttgcatttctttaactgatctgaaacttctgtccgtattaaaggtacattttcatttaaagctttgtggacctattcaaccatgacacaacataaatttgtttcaaaaatggttctcttctctctctttacaaaggtaaatgtgcagggtatattttgaaagcagttgaaaagcaaagcattttacaaatgcaccagaaacgtagatttgagtggaaaagaagttctgtcttaagacatagtgcagctgaagagaaacagaaacaagtctcactgaacagggtgttatagggcgtacctgcgaagaagacgagagaaatctttccatcgatgcttacccatcatttagtgagtgagaattatactttggaacctccaagtttttgctcaacttttagcattaaaatgatttcacatagagctggtgagatgactcggcagggaaatggtacctgagtaaaactcaaggccctgaaacaatgtgtctgtctactattacagtgcaatacaatgtgtctgtctactattacagcgcaatacaatgtgtctgtctactattacagcgcaatacaatgtgtctgtctactattacagcgcaatacaatgtgtctgtctactattacagcgcaatacaatgtgtctgtctactattacagcgcaatacaatgtgtctgtctactattacagcgcaatacaatgtgtctgtctgctattacagcgcaatacaatgtgtctgtctactattacagtgcaatacaatgtgtctgtctactattacagcgcaatacaatgtgtctgtctactattacagtgcaatacaatgtgtctgtctactattacagcgcaatacaatgtgtctgtttactattgcagtgcaatagcttgtgccaggggcatagttacttgcttaagttgctgagacaaatgagctggatgactgagaggaacccagtcgttatgggcatgagtcttctttttaatcatctagatagaatgataacatgccatattccatctaaacccagcttaagggctttcaatcatgacgaaacccaaatagatcgtttttcaaatacctacacggattatggcacctatacatagtctttaaaaaaatattcgacaaaataggagtcactaaatactaagattcttgttaccagcacacaacactacaaactacttgcaaatatcctctagtgtggttcagtcctgcacctacaagcagaaccgcaagaacatataagcagtaaattagatttagtaagcttttattaagcgagcatagttcctacgacagtttgtacatctctatcaccagtgatgtttgattaatcgttaaggtttaaaaatcaacaaaggggaggcacgcgacggccatctcttctttggtgcatcctatcacacagcacttatctgcaaagcctctgcgtttcctttgggaatgattcccccaaaataaacttctgaaggtattcattttgttcgtgcttttcttctgaagttgtacgctcttaacatagggcttgccactgtggtatgaaaacactcttgccttaggaagcaactccgtcttttcaaactgatagtcgggcagtgactgaggctcccaagtgtgtgttcctttcttctgagagacgcctgcagggactgttgagagacaatgggggaagaaagtcctatttatccaaatctcctactagatatgaatttagtattgcaaaactaaaatcagatacttatttaaaaaacattttaaataaaagttgaaaagtacagctattcaggggcaatttttttttttttttttttttttttttggtttttcgagacagggtttctctgtgtagccctggctgtcctggcactcacttcgtagaccaggctggcc

SEQ ID NO: 1428 - DNA, 3629 bp, Mus musculus
cgggggaacaagatgtgaactgttttccctccccagaagaagaggccctttttttccctcccgcgaaggccaatgttctgaaaaaagctctagatgggaatggcctgccttacaatgacagaaatggaggcaacctccacatctcctgtacatcagaatggtgatattcctggaagtgctaattctgtgaagcagatagagccagtccttcaagtgtatctgtaccattctcttgggcaagctgaaggagagtatctgaagtttccaagtggagagtatgttgcagaagaaatttgtgtggctgcttctaaagcttgtggtattacgcctgtgtatcataatatgtttgcgttaatgagtgaaaccgaaaggatctggtacccacccaatcatgtcttccacatagacgagtcaaccaggcatgacatactctacaggataaggttctacttccctcattggtactgtagtggcagcagcagaacctacagatacggagtgtcccgtggggctgaagctcctctgcttgatgactttgtcatgtcttacctttttgttcagtggcggcatgattttgtccacggatggataaaagtacctgtgactcatgaaactcaggaagagtgtcttgggatggcggtgttagacatgatgagaatagctaaggagaaagaccagactccactggctgtctataactctgtcagctacaagacattcttaccaaagtgcgttcgagcgaagatccaagactatcacattttaacccggaagcgaatcaggtacagatttcgcagattcattcagcaattcagtcaatgtaaagccactgccaggaacctaaaacttaagtatcttataaacctggaaaccctgcagtctgccttctacacagaacagtttgaagtaaaagaatctgcaagaggtccttcaggtgaggagatttttgcaaccattataataactggaaacggtggaattcagtggtcaagagggaaacataaggaaagtgagacactgacagaacaggacgtacagttatattgtgatttccctgatattattgatgtcagtattaagcaagcaaaccaggaatgctcaaatgaaagtagaattgtaactgtccataaacaagatggtaaagttttggagatagaacttagctcattaaaagaagccttgtcattcgtgtcattaattgacgggtattacagactaactgcggatgcgcaccattacctctgcaaagaggtggctcccccagctgtgctcgagaacatacacagcaactgccacggcccaatatcaatggattttgccattagcaaactaaagaaggcgggtaaccagactggactatatgtgctacgatgcagccctaaggacttcaacaaatactttctgacctttgctgttgagcgagaaaatgtcattgaatataaacactgtttgattacgaagaatgagaatggagaatacaacctcagcgggactaataggaacttcagtaaccttaaggaccttttgaattgctaccagatggaaactgtgcgctcagacagtatcatcttccagtttaccaaatgctgccccccaaagccaaaagataaatcaaaccttctcgtcttcagaacaaatggtatttctgatgttcagatctcaccaacattacagaggcataataatgtgaatcaaatggtgtttcacaaaatcaggaatgaagatttaatatttaatgaaagtcttggccaaggtacttttacaaaaatttttaaaggtgtaagaagagaagttggagattatggtcaactgcacaaaacggaagttcttttgaaagtcctagataaagcacataggaactattcagagtctttcttcgaagcagcaagcatgatgagtcagctttctcacaagcatttggttttgaattatggtgtctgtgtctgtggagaggagaacattctggttcaagaatttgtaaaatttggatcactggatacatacctgaagaagaacaaaaattccataaatatattatggaaacttggagtggctaagcagttggcatgggccatgcattttctagaagaaaaatcccttattcatgggaatgtgtgtgctaaaaatatcctgcttatcagagaagaagacaggagaacggggaacccacctttcatcaaacttagtgatcctggcattagcattacagttctaccgaaggacattcttcaggagagaataccatgggtacctcctgaatgcattgagaatcctaaaaatctcaatctggcaacagacaagtggagcttcgggaccactctgtgggagatctgcagtggaggagataagcccctgagtgctctggattctcaaagaaagctgcagttctatgaagataagcatcagcttcctgcacccaagtggacagagttagcaaaccttataaataattgcatggactatgagccagatttcaggcctgctttcagagctgtcatccgtgatcttaacagcctgtttactccagattatgaactactaacagaaaatgacatgctaccaaacatgagaataggtgccctagggttttctggtgcttttgaagacagggaccctacacagtttgaagagagacacttgaagtttctacagcagcttggcaaaggtaacttcgggagtgtggagatgtgccgctatgacccgctgcaggacaacactggcgaggtggtcgctgtgaagaaactccagcacagcactgaagagcacctccgagactttgagagggagatcgagatcctgaaatccttgcagcatgacaacatcgtcaagtacaagggagtgtgctacagtgcgggtcggcgcaacctaagattaattatggaatatttaccatatggaagtttacgagactatctccaaaaacataaagaacggatagatcacaaaaaacttcttcaatacacatctcagatatgcaagggcatggaatatcttggtacaaaaaggtatatccacagggacctggcaacaaggaacatattggtggaaaatgagaacagggttaaaataggagacttcggattaaccaaagtcttgccgcaggacaaagaatactacaaagtaaaggagccaggggaaagccccatattctggtacgcacctcaatccttgacggagagcaagttttctgtggcctcagatgtgtggagctttggagtggttctatacgaacttttcacatacatcgagaagagtaaaagtccacccgtggaatttatgcgaatgattggcaatgataaacaagggcaaatgattgtgttccatttgatagagctactgaagagcaacggaagattgccaaggccagaaggatgcccagatgagatttatgtgatcatgacagagtgctggaacaacaatgtgagccagcgtccctccttcagggacctttcgttcgggtggatcaaatgcgggacagtatagctgcgtgaaagagatggccttcactcagagaccaagcagacttccagaaccagaacaaagctctgtagccttgtgtctacacatccttatcatgatgctagctaggcagaagaaactgtgacgccgtctgctcaaagctttgcttc

SEQ ID NO: 1429 - DNA, 3390 bp, Mus musculus
atgggaatggcctgccttacaatgacagaaatggaggcaacctccacatctcctgtacatcagaatggtgatattcctggaagtgctaattctgtgaagcagatagagccagtccttcaagtgtatctgtaccattctcttgggcaagctgaaggagagtatctgaagtttccaagtggagagtatgttgcagaagaaatttgtgtggctgcttctaaagcttgtggtattacgcctgtgtatcataatatgtttgcgttaatgagtgaaaccgaaaggatctggtacccacccaatcatgtcttccacatagacgagtcaaccaggcatgacatactctacaggataaggttctacttccctcattggtactgtagtggcagcagcagaacctacagatacggagtgtcccgtggggctgaagctcctctgcttgatgactttgtcatgtcttacctttttgttcagtggcggcatgattttgtccacggatggataaaagtacctgtgactcatgaaactcaggaagagtgtcttgggatggcggtgttagacatgatgagaatagctaaggagaaagaccagactccactggctgtctataactctgtcagctacaagacattcttaccaaagtgcgttcgagcgaagatccaagactatcacattttaacccggaagcgaatcaggtacagatttcgcagattcattcagcaattcagtcaatgtaaagccactgccaggaacctaaaacttaagtatcttataaacctggaaaccctgcagtctgccttctacacagaacagtttgaagtaaaagaatctgcaagaggtccttcaggtgaggagatttttgcaaccattataataactggaaacggtggaattcagtggtcaagagggaaacataaggaaagtgagacactgacagaacaggacgtacagttatattgtgatttccctgatattattgatgtcagtattaagcaagcaaaccaggaatgctcaaatgaaagtagaattgtaactgtccataaacaagatggtaaagttttggagatagaacttagctcattaaaagaagccttgtcattcgtgtcattaattgacgggtattacagactaactgcggatgcgcaccattacctctgcaaagaggtggctcccccagctgtgctcgagaacatacacagcaactgccacggcccaatatcaatggattttgccattagcaaactaaagaaggcgggtaaccagactggactatatgtgctacgatgcagccctaaggacttcaacaaatactttctgacctttgctgttgagcgagaaaatgtcattgaatataaacactgtttgattacgaagaatgagaatggagaatacaacctcagcgggactaataggaacttcagtaaccttaaggaccttttgaattgctaccagatggaaactgtgcgctcagacagtatcatcttccagtttaccaaatgctgccccccaaagccaaaagataaatcaaaccttctcgtcttcagaacaaatggtatttctgatgttcagatctcaccaacattacagaggcataataatgtgaatcaaatggtgtttcacaaaatcaggaatgaagatttaatatttaatgaaagtcttggccaaggtacttttacaaaaatttttaaaggtgtaagaagagaagttggagattatggtcaactgcacaaaacggaagttcttttgaaagtcctagataaagcacataggaactattcagagtctttcttcgaagcagcaagcatgatgagtcagctttctcacaagcatttggttttgaattatggtgtctgtgtctgtggagaggagaacattctggttcaagaatttgtaaaatttggatcactggatacatacctgaagaagaacaaaaattccataaatatattatggaaacttggagtggctaagcagttggcatgggccatgcattttctagaagaaaaatcccttattcatgggaatgtgtgtgctaaaaatatcctgcttatcagagaagaagacaggagaacggggaacccacctttcatcaaacttagtgatcctggcattagcattacagttctaccgaaggacattcttcaggagagaataccatgggtacctcctgaatgcattgagaatcctaaaaatctcaatctggcaacagacaagtggagcttcgggaccactctgtgggagatctgcagtggaggagataagcccctgagtgctctggattctcaaagaaagctgcagttctatgaagataagcatcagcttcctgcacccaagtggacagagttagcaaaccttataaataattgcatggactatgagccagatttcaggcctgctttcagagctgtcatccgtgatcttaacagcctgtttactccagattatgaactactaacagaaaatgacatgctaccaaacatgagaataggtgccctagggttttctggtgcttttgaagacagggaccctacacagtttgaagagagacacttgaagtttctacagcagcttggcaaaggtaacttcgggagtgtggagatgtgccgctatgacccgctgcaggacaacactggcgaggtggtcgctgtgaagaaactccagcacagcactgaagagcacctccgagactttgagagggagatcgagatcctgaaatccttgcagcatgacaacatcgtcaagtacaagggagtgtgctacagtgcgggtcggcgcaacctaagattaattatggaatatttaccatatggaagtttacgagactatctccaaaaacataaagaacggatagatcacaaaaaacttcttcaatacacatctcagatatgcaagggcatggaatatcttggtacaaaaaggtatatccacagggacctggcaacaaggaacatattggtggaaaatgagaacagggttaaaataggagacttcggattaaccaaagtcttgccgcaggacaaagaatactacaaagtaaaggagccaggggaaagccccatattctggtacgcacctcaatccttgacggagagcaagttttctgtggcctcagatgtgtggagctttggagtggttctatacgaacttttcacatacatcgagaagagtaaaagtccacccgtggaatttatgcgaatgattggcaatgataaacaagggcaaatgattgtgttccatttgatagagctactgaagagcaacggaagattgccaaggccagaaggatgcccagatgagatttatgtgatcatgacagagtgctggaacaacaatgtgagccagcgtccctccttcagggacctttcgttcgggtggatcaaatgcgggacagtatag

SEQ ID NO: 1430 - DNA, 96589 bp, Homo sapiens
  misc_feature (29878)..(29897): "n" at positions 29878 thru 29897 can be any base
actaattttttgtattttagtagagacagggtttcaccatgttggccaggctggtctctaactcctggcctcaagtgatccgcccaccttggcctcccaaagtgctaggattacaggtgtgagccaccatgcctggcactattcatttttcaaactcaaatgacatctactttaagagaacatactttgtggggagacagatctagattcaaatagcaactttaatactagaagttatgtcagtttgggtttgaaatgaaattcaggcaatttctgtactttattttctgtaaaatagagataataatacttacctaatagggtataaaaccaaataataaaaatttcagtcatttcaatatttattgtaccaggcactgtcctacgtattaggtatatatggtaatgaataaaatagacctggaactcacctctccttgaaagaaacagacaaataaataaatgaaatatattgtatgtgaagtggtaataagtgcaatggaaataaactaattaagtgtttggtgtaggttgaggatggagaggcattgaaatttcaattgtaattgcatctcacctaaggaggtgatgaagtgagccacggggatgtgagaacgtgggagaggggccagggagagtcactgttctgattcctggctgcagctgtgattactgccatatctcttgtaattatgcatgtcggcttccctgaaacaccaactctggccttctacaacttcagaccaaggtctcccagtcgagtgccttcctgtttgcattctataactgagccacaaacagccctgtcttgagctcttattttcttataaagtttctggatatatctgtattttatttggtatgctcttaattatagccctctctccccattcctcttctcgctgctggaaggtggtggatggctaggctggaaggctatcctgagcaataccgtcttatgttggtatttattatttggttttataccctattaggtaagtattattatctctattttacagaaaataaagtacagaaatagcctgaatttcatttcaaacccaaactgacataacctctggtattaaataccaattatcagtcatcacacctcctaatacccagtcattttatccaggctaagcttctgcacctcaagttcttcccttaaggtgaattttttctatagcgagacctctgcccagggagttaagtgctaacctgtttcctgatagcttaggggtattattaatacggaggatttggccactgatcctcattttgtcctgctattgttcttattcattaattcatttatacaatggcacttatttaacatatactatgtgtcaaacttgcattgatactggatatacaatagggaataaaacaaatatagttctgccctcatggtctacaagggtttctttggattcttatagaatacactcttcctctgcctaccctaccaggtaacaaataggtatatttcttgggctgcctcatctctgcacactccataacttgttgtacatgtatttatatctgatgattgtatctaatcaattatctctatgatttgtaaggtctttcagcagcaacatttgtgattttagaatttgattgatttgtaataagtgtactcagtgctatttgacttaaatttgttgcactgcaacttagtgtagccctgataaaactggggctcccatgtggtctggcatatacagtaaatgccttaaaaacacaagcgttataatcaagaatacttgaagaaaaaatttaaggttttatataaagggaatgaaagtaggtccactttataagttaaagcaaaatgttttaaaattctctattgccatccacttcttattcccatctacatactgaagcaacttgaaagaaagatctcttctttttgttcattcttcaagtcaaggtactgcatctgtgcctcacttatattttattccctaacccctccccaccatatcacctgttatgaaaggcaacctaagttctttggcttatttattttcttttactttacccattacaaggattctctacaacagtggttcttgaactttagtgtgcctcagaattgtctggaaggcctgttaaaacacaaatggctggaccctacttccagagtttctgatacagaaagtctgggttggggctcaaaaatgtacatttctaacgtgttcccaggtaatgctgatgctgcctgtccatggaccacattttgagagccactcctctacagtatagcatctgggagccattccagcaaataagaaatctatccatggatagaagcctttgctatatattatacataaatattgttacctgattgcctatatattaatatgaagcttatgaatttaatgaatcatcttccatcaccacgtttaaaattctgtgggttggggtgtatacttgggataggctcagctataagcaagaagagtaaaggaaataatatttattacttgcttgtctattcaggagatagtagagtgtgattgttagaggagttagctgtgcagccaggccctttggggttcagtcttagcccagcaggatttctgagagacacttgaaagacatttaaccttttgttcctcactttcttttgagatgaggataatgcaagtaaccacctcatagccttgtggtgaggctcaaatgatttgatacatataaaactcttgaagatgcctgatatgttgtatgaactgtgatgttacctattattgttatcaggaatttgttgagtgttttctacatgttatctcattataacctcaaatcaatcctaaatgcaagtgcccctattattctcattgtagagactagaaaacagaagtttagaaaaattgagtaacagattaaaatctcccagctagtaacaatctctggtctttgtatttttccagcattttcccaaaggaatcatttcctcctgtaagaaaaatggttcaggaaatctgtacgattcaaaagcatatttgaagataattggataattacttgatcagtatggttgatgaattttatagtcaatattattgtgtctactttaaaatgtaatcaaggcaaaaatggaggcaacgatgggtaaaagagtggttgtgtaacacactagtgagtttctaacatttacagagtaccgttacataacaggcgtttaataaatactggtcaaacgactgggatgagtgtgttttggaactaaaattacctaaaattaaagattcataatattgagttagtgagattatagagaaatgagcattgatatactactgtggaacttctggaagttgatttgacagtagtcaacaaattttaaatttgtatttcctttggtacagagagtctaagtgtctatcccaggaaatacatttttgcccatgaaatgcatgttcaatgccttcaaatttaacactgtgtaactggagaaattagaaacctaaatgttcataaataaattatttaataaattattagcacctgttttactgacacagtataagagttaaaatgaatgagaaaagcaatacatattgacatgaagtatctccaaggtattctaagtgaaaaaaatgttaacagaaaaacatgtgtagaataacccattttatttatttaccaagctcaaaactatatctataggagatatgtaagaaaatgcattggaaaaagtttgaaagagtaaatctcagatagttattaatggtggcctctggaaattgaagagggctgggagaagagggtcaagagaaatttccactttgtacattttttcttctatgttgtttggattttccacaattgctatgtatttatgtttacttgtgaaattaaaaatgaaaaaaagtagtttgctcaacaaatatacttaaaagccctttaataaatataatagacattaatatgtacaacagtaagttttcatgagccttaaaacatatctattctggtaatacgcatttgttttcaaaaacctccaaagtcatcactgttactaaaattttattacttgtaatgctattgagtcccagaatatttcctgtgagtagtaaaagagctgaattagcatctgagtggaaagcacatgatactaaaattcttgtaggattagactgctcagccaaaagagcttgccttagcactgtgacatcattttatgcttgatctataacaggtggagatgacagtaaacataacaaagcaccattacacaaaaggagaaagcaaagaactgtttttcccctccaaatggacagctatatcatgttcagtgggggacactgttagatgtggatgggaaacctaagtatgtggataaagtaagaccaccctaataagggcgctcccttaataccagctgccttttctagaaggaaaacacctgctttccctctgatcaactctcatgacatagagataaagaggtacagcctcaaacctcagaaggataaggcattcagggaaaaaaagggggaaggagaagagaaaagtctagttaaggacaaattatggacatttggaggtatatggccaagcaggagtagaagttaaaatggagaactgtttcatgcagcattttctggtccagttgtgtattttgtagttgaaatggaaatacacagtattccaccacatcagtatgatactttaatatcaaatcagattttcctttggtcaatagcatagctagagtggaatgaccacagcaattcctatagctacagcccagaaaattcacaaaattattaagttacagagaaattagagtgaagcaagtgagaaaagaaaacagaacaggggtgaagggtgtggtggttgggagaaggaggcgtgggtgagaaaaatttcactgtagtaaacgtccatcataatcaaagagggcttatcttctgctaacctatgggttatatgtaatatctcagattatgactaatacttgcatagttctgcttggctttatgattgaagatagacttccacactttgtgggtgaatcatacattttttttaaatatacattttccctgttgtaatttgacagagtatttttctctctcatcagcttactatgatgtctcccttactcctggttatttcagttgtgagtacgctgacactactagatctaacttaagtcaaaaggagaaatttgtcataaggaagtattttcaagatagaaaatgcatgaagttttggtggaccttataagaaagagggaactgaaaagctatggggacacatactgcgcacattctctctctcttctcttctgtggcattcttctctcctatagcaaatcagctttctgtgcaagaatgaagatggtaacctcatagtggcagccttaactttagagcatgggtaacctcatttcaagtgaacagaaaagtctgatttgctgtttttgaatcccaactccaaattccccaggagtgagactctgatggctcagcttggtccaatcaaggggttgtgggaagcagggtgtcacaaactagaacgtaggtgccagaggctggctactctgggtgaagaggacagttctcagcaaagaggacagaatccttagtctaaattaggactcaggaattaagtctctgagtctctgtaaactaacaattatgctagggatttatttttattttttattttattttattttattttttgagatgggagtcttgctctgttgcccaggctggagtgcagtagcatgatctcggctcactgcaacctccacctcccaggttcaagtgaatctcctgccgcagcctcctgagtagctgggactataggcacatgccaccatgcctggctaattttttgtatttttagtagagacagggtttcaccatgttagccaggagatcttgatctcctgaccttgtgatccacccacgctggactcccaaagtgctgggattacaggtgtgagccactgcgcctggccgaaattttgtttttaagagtgaatgctggcatgaatcctttcacacacacaaaaaatgtttttcgtgaataggcaactatatgtctaacagttttaagttaaattttttaaaagtagcacatagttataatggtcattttacatattttgccaaataattatcctcacttgaaagaggttattaattcttggcttacaaagggaaaactgttttggttttcaagcaccaaagtttaatacatccagttatctcaagggaatgagggatctgttcactggcaatatcttttttgttttccttttctttttgtgattgaaagtaaggataagggaactgatgtagagacaaggacatgctgaagtaccgaggaggtattggaaaatttctttgccatagccaaccaaattttggaataaatggtactaaaatatctggatgatttgtagtaaaaaaaacattgcttgcttgtctgtctacttgattaataccccttgcctttgtcttttggcttataatcctacatttggaataaataagcctctttccatattttattcctttctgccttcaggaaagtacatcttccctgttttggaaagaaacaaactaactcctggacttctccccagcccttcgtttgagcctgtttccctttccaaggactttcctgcatctttttttgtgctcacatttatgtccctccttaagaatgatgttttcagtctcatcatttaatgatatagttctgttttttaaaattcaaatggagatcttcacatttatctctattacaactcagcccttatcctaccagcccacacagtcctgtgtagtgcaataaactgtgacaaatacttcaatcttcctaataaaattcaacaaatttcttatacctcccagcttggttatatctgtaaattggtcctgccacagatataatagacatttgataactgtgctaagggttttaaaatactttttcacctaatcttcaaaatctctctacaggggagattattatcctcattatactgatgaggaaacagaggcttagaaaatctaaataaactttcctggcaaaagctgtgattgaaagaaacctgggtggtctggactcttaaagcgtaagttcttaaacccttggccatggattttcaaccgtggctttatgtcaaaccacctaaaaatgttaaaaagttatagaagccaatgcgccatctcacacttactgaggcagtcttgttggggtggggggaaggtttgggcatagcagtcaagaatcactgctgccatgctggccaacactggaaggacaaaacctcaagacactacacacagccccacagtcaacaactagctgttaagttttcccattagatcttgccacaaagttttgaatctaaatgtgttaccttacagctcatatttcttgtttcttcatattgtatgaatgttttgaaagacttggtcaaattccttggaattcttttcatcattatcaaagaataagggaaatttcctgaaatgtttgccttgagtagcaaatttctagtgatgccactaccaggaatcacataaagagctcaaaagttctgttaatacagagtgaaaaaagctcaacattccaggttagcattgacttaaaatcatgtcttagtgatgagggaggctttcactttctgaatgacaggaggcaagttgcttcatctttctatgtggggagacagaagatttctcaattctataggcttatgaataatataccccttgtccaccttgtcttccatacccacatctctaatattaagaaaataacctgctcccccacaaaaatatcctcaatattcaccacttccaaatggcttctccctgcaattcaccaatttcaaatggcttctccctgcaaacaggctgtggacagtaagagataccatgcctagttacataagtatatcactgcaaaatatagaaacatcacttataatgaaagtaatactgtttcagagttctaaaacaagcattttcttcccctcacaaaatatcacatttccatttccacagttgtgatgcttttcatttacccatgacgttaagctcatctttagctcttcttcattatgtgggtctgtgttctagcttttacctcagtagcagtttttgtttgcaggaaaaaaggaactcttttggtagtcactgtttgtaattgcggccttgatattctaagccattgagtcacaattaataattagaaattcttactaactttgcccatatattacctatgaagcagtagccgtaggaatgcaattttcctgtaaatccctccctcttatacagctctagttcattatttaaaagattcagggtgaattcaagtaatttcctatgctgctatcatttgcttaaagaccttttgcaatgggtcttatgtaagaagaaatgcaggagttgctttggtgaggtttatttaaagaaaccattaagtgcaagacagacctgaagagcagcatcagttgtgtatggggaaacaggagctatgaatgcgtcacttcatttaggttgacagaaagagggctaatacttgaaaaaaatccctacacgatctggtgccaggctacttctttggcctcacctcttaccactgccccctccttccgtgtcctccagccacagtgacctctttcctgatccttgaacttgccaaacactttcccttctcaaggtctttgccttcaggagtccctctgcctgaaattcttttcccagatagtcatgggactggttcattctcatccttcagatctctgctcaaatgtcacttattctaggaaatcgttcctggccaccgtaaaatagcacaccccctcctcactttctactccttttctttgttattatgtatatggcagcagaaaactatgcattttcttagtggcaattacacaccccgcacattatgcatttaaagcgttgtttgttgttttgtcgcttccatcagaatacaatccagtagggcaaggagtgtgtggggtcgtgttcacctggtatctctggggacctacagcccggcacctagtagacactcagtaaatatttgaatgaatgaatgaggccctttggcagccgggaagcccgtcacagccgttgtctccaccctctcccgggctacaccaggccacgccggtaaagttgtttctcctctaggagaaacattcgctaggccttgttgccaacccgcaggcggctgggcgcttcatcccaccctcacccctttccagccaaggtggctgatgggagtcaggctctcgagggcgcattgccacgaaacagcgtgtgtgagcgcgttgtccccggcccccggcgccacttcccctcggcctagcagcctggactggggaaggacgggtctgctgtacccgggaggtggaaggaaaagccgaaagcggagaagtgtgcgggaggggagtctccgcgcggaggcagcccggcctcctccagtgcaggctgcgcgctggggagccagccagggtgagtcactcccggccgcttccctggagggcggcggccacacacacacccgcccatctagtgagggccgggcccagcgctggcgcctagctccagccgggcaccagcgtttcgcgaggcgccgccgccttaacttccttgcgcgctcacgcccaggggccgtcccaggaatctccacgcgcgctcgccggcttcccgagaggcagctgccctgcgtggcccgcgcctgccggtcccgcgaccagcaccgagcggcgcacgcgcactgcaggacgcgcgtccggctctcccccagcctctatccggcccggtctcctgccattcggggagactgcaggccaaccgggaggctgagttcgaagctagcagggcggcgaagccagtgtcgcccgcggcgttgagaagacggtgtggccccggagagggtggagacaactgtgacgggcttcccggctgcccgaagtgggagtggtgtggggctgcaggaaggagagaggaagaggagcagaagggggcagcagcggacgccgctaacggcctccctcggcgctgacaggctgggccggcgcccggctcgcttgggtgttcgcgtcgccacttcggcttctcggccggtcgggcccctcggcccgggcttgcggcgcgcgtcggggctgagggctgctgcggcgcagggagaggcctggtcctcgctgccgagggatgtgagtgggagctgagcccacactggagggcccccgagggcccagcctggaggtcgttcagagccgtgcccgtcccggggcttcgcagaccttgacccgccgggtaggagccgcccctgcgggctcgagggcgcgctctggtcgcccgatctgtgtagccggtgggtgttatctctgcctggcttctgggtggggggcagcagctgtctctccacccccttcctaccttttggtcccgcctgccccctgctagtggcagcaaacttctgagccagaaaaatcttcctctttaagacgacacctagaacgagtcttgctggtgatatttgcttccatttgtgtcttataattccctcgctcccgcctccttattcctttttaaaattttctagacacttaaacagcctagaaaaagcatttgtttcccctggatttatgtggtagtagttaactgctgcttctgtttttaggtttcagaagcaggcaacaggaacaagatgtgaactgtttctcttctgcagaaaaagaggctcttcctcctcctcccgcgacggtgggtgtgctgtcctttatcgctgcagtaaaggcgaaggtgtctggagctgggagtgcgtgcgtagggaaggttggaagcgtgtgaagagaggcagggctcattgttgcttactcttctgaaaatgtcagtgctaaacttttaatgttgatctgggagagtaattttggggtgttttgttgttcgtcttggatcctttaagaaacatttttttgttggctttacacataacgtgactttgcagagaaacgaaaaacgttgtccattaccctttcttcttaagcagccagagattcttaatcctttaaagaggagtatttccaagcaataagagatagcttttgggagaacacgttagctattcttgctggggtttctgctaccacattgaatgtttcctcatggttttatctgcctaagcttgctgtgtcggttgaatttacccagtttgttttccagtaattactaatctgttaggagaaactccatttctctgaatgaaagggtaggagcggctgagtatggagaaggaaactggaagtgggaataagggaaatgattgcttttggtttcataataagtttgtacagtgagttgttgggctactgcaaataaagattttgtatcccttctccagaatgcttgggaccaaaagtgttttggattttttttaaaaattttggaatgtttgcatatacaaaatcagacatcttgaggatgggacccaagtgtaaatacgaaattcgtttgtttcatatagaccttattcacacagccactaagtcatttgcaatatttttaatacgtctgtgcatgaaacaaagtttgtattaagtacctatgcggggaattttccccttgtagcatcatgttggtgctcaaaatgtttcagattttgcagcttttcagataagggatgatcagcttgtattttgatataacacccagaacatttgaagatgaataatcaatttttggcctcccttcccccatccgcctcaccttataccactttaagtgtgagaattatttgcttgtacatgcatttgtctgttggtgtgtaacgtatgtacagactggatgtatccagcacttgccttaatagtacatgtatttacctgaataggaaagctgcagtacttgctggccagaagagcacaccatgcttgtttttgctctaactgaatatcctgtatttgcaatttatagcagttttagggactcattagggaattttgtgtgtgtgtgcctttggtgatttgagacaggtgtctcagatatgggaagggaatatgacattgtttctctttcacctggctattactgaaaggtgggatgcttttgaggcagaataggaaagtgcattggctttggagtgagatctggatttgaatcctggtgttcttgccacttaagagttgcattatttacggctggtcatggtggctcacgcctgtaatcccagcactttgggaggctgaggaaggaggatcacttgaggtgaggagcttgagaccagcctggccaacatggtgaaaccccatctctactaaaaatacaaaaattagccgggcgtggtggtgcacacctgtaatcccagctactcgggagggtgaggcaggagaattgcttgaacctgggaagtggtggttgcagtgagccgagatctccactccaggctgggcactgcactccaggctgggcaacacagcaagactctgtctaaaaaaaaaaaaaaaagaaagaaaaaaagagttatattatttacgactcttttagcttcactttcttataagattgttgtgagaagtgagtaagacacatgcaaagtggtaaactgcctggctgtcataaaagtcttggctactatcacggctgggaggcaaaggagattcagagaagggcagaatgactgcataaggtgatctgcctgtaactcgtgtttcttcctttctagtataaagagataaaggacttcaaggtcttaaactggtgagggagtattacagcctttgtatggaaaggtttgactttgtgtctctgcttaaacccccattgtgttgcccctaccaattattgtgctgcccccttgtggttaactgtgctaagacctttcttttgctcttctcccattacatttcccacccttccccactcccttttagacccctcctcttagctcccagtttcccaaactgtgtgccaaggtgcccagagcacctcaggcttgaacttgtgttttgagttggttcatggtttcaatattagatacctacacccgtttctacaatgtcatgtctttgtaaagatgtattttcagaggttgctccgataaaaagcaactactacatgaaaatgaatgtagaacaggaaatgacagtgtggtattgtccaatttgattctaaggtttgataagttctacagtgctctacactaagttgtaaggacataactactaagtaagttgttcaaacctatttcttttggcctgggggtgtcgtgaaaaatttgctaagactcagagctccctgaatgggtttggaaacctctgccttagcttttagtttgcttttctgataaaattattgatataaagctagtaccagctgatcatggcttaatatatttcctctcctatgtaatatgtttataacttctgcccagttctttcattttaaaactaatcctattgctaacttgttgtactagtcacttcctggtttttcctgtactggtcttctgcttctacttctgttcatctccttaaactccgaatgccccaagtgaaagttaccattttctaccccttaattttcttctaatcatgtaggctttaaattaggcatcatctttaaactacttctttcatttacctcttattcccattcaaaatgtccatatttcctttctttctcatatctctgctttccctcctttactgtgtgaatcccaggacacatttcctgagcctagaatattgaaagtcatttgaacttctgagaattcagtgtcccttccttctgtttatcctcaatagagattccactctaatactccttattatagcattcccttgccccaaaaccttcagtggcttaccattttctacttattaaattttcctgacttttaagatagtctattatcaatccctgccctatttatttagtcttttgtctaaggatctctagtccttaagcttgtaagctgatttccacactttctaataataagctatgcttcttctatcctttaatttttgcccatgttctccatccctcttttttttcctctatttctgtagctctttagtcttagaacattttcacatggtttaattatatgccatgctttagttgtttgatagttatttccctagtgttagccatatcttttcaagttgattgtgtattctttgaggagcagtaccttagattaaaaaaaaaccacaacacacagtggagagcacatgggcagcattcaagaaatacatgttgattgtgtgataaggaactgtagtcaccaaacaaatatttgttaatacttgcaatgtaaaaggtacttggctgtattcaaaagagaaataaagaaatataaaataggctcctttccctaaggacttacagtataattgggcagataagctaaataataaaagttacagatatttaagaccacttgagttgagcagagattttgcataataggaaggaactggtagagggggtaagcaaaggcaaaatatgtatatatgtatgatatgttcagagagcagtacataaataacttgactgaaatgaagatttgtgtgaaagagtagtaagaaattgtgttaaaaatgtagttggaatttgattatggatgtctttaaatgctaggatgagaagaatgtactttgacctgtagatatggagaagctttaaaagttttgaattgagaaagagtttgctgaaataagtattttaggaaaatcaaagcagcaccagtgctaggtctcatatgaattggaaagagaatggtagaaagaggtaggaaaataattgagccctgaagtaatgaggacttagaaataagtcagattgcagagatgtcacaagacattattatggattggataagaagggagaatggaggggagaagagtgattaaagattaccttaccttgaaggtttgcttttcagtgacggaggaaatcaaagagtgttgactctccaagacatcttagaacatctaagtctatatgttttgtatattaggactcagaccagagagatttaaaaatgtgtccaaagttactcagctagttaatgacaaagaaactgccgtttgattaatggcagttactaacaaaaatagttatggcagtgttagtagctggtagaggggatgtagacagttgagcgtatattgtggatatgttgagtttgcggtggccgtgggatgggcaagtgaaaattgatagcatacagtgggacatatgactagaatttgttagcgaagttaaggctggtgctgtggtacttaagagaaaagagtgggattgcccataattagcgggtgggtgaaaggagaggaatgggtaaaggagacaaagaaaaaaacagtatgagaggcaaattagtggataggttaggaggcggaatgatcaacatgttgatcattggcaagaaatgagaagaatcagatccaaaaaaaggtcttaaaaagatgtattcgtgtttttcctaataagaaatctataaaaacagaagaaaattgcttatactttccctacgtggaaataaccactgttaatattttgttctctccggtttaacaaaagacctttggatttgacagttgggtgatcagtggagacttttccaaagctctccatcactaggactaaggatgagaattttaggcataataaaacctaggagatatttttcaacagattgtcattcgtctgtatcgtcttatatatcacactgtccaggtactattcttcctgtgtgcattggttctgtgtttttttctgaatgatagaaggttagacaagccatctctgggtgcttttgtgctggtaaaatttgaataaagtgataaaatatttgtttctaaaaggaaggagaaattcttggtcgataacttataaatctgagggttgaatgattgatgaaattaggggtactggaaagaacaaagagaagcattatttattttgaagcttttctgtatagttacaaagggttaactaggttagaatggtccatgggctgtttactttgcttgcatgtttattttgatcttcccaagaacattcttctgttcatctttttagtatgttattggaaacagagtactcattagttcttactaagtggttttagtttaataaattatgattatgaaataaaatgctattaggtaatatttttataatataaagggccatgtgatgtgagtaagtgcactgttttggaaatcaggggataagggactgaccctgctctcagcatggtatatgatttcaggcaactcacgtaatcagtgagtcttgtctattgagggaatggactaaatcttttctagaaaatttaaaaaggtgggatcacatggtaaaatgtgtataaagtttaaaaaggaaatggtttaccaatgtttatgacaaaaaccagcaaactctttcccacccccccaccccacatctccttttctagtctctaattcctgtacaccaggcaaccacctgtcctctgtactttgccgttttcacctttataatgaatgaattgtttagcatcccctctaaagcctctccattcagttgtgtagaagagctcatcccctttgccttcaagggctttaccattatatttctctcctctttttcttgccttctcaattcttccctctactggattatttccatcagcattactctgattgctattgctgtgtaacagaaactacccaaaacttagtgatttaaaacaactactttattaggctcacagataccatgggtcagtaattgagacagggcacaccagggatgactttgtttttgctccacaatggctactaggacatgagttgggaagaattgccagccaggggtgacttgaaggcaaaggactggaatcatctggaggtgtcttcactcacatgatgggtagttgatgctggctcttgactgggatgttagctgggctgttaactggagcatgtacatgtggcctggatttcctcacaatatggtggcttcagggtggtcacctttcatagtggtgagtagagaattaaaagtgagtgtgtctcagcataaatcttttatgatttagccttggtagctgcacagtataacttctgccatgtcctactggttgtaagggtcagaagcctgtccagatttgatgggggagtggcaagttcacactgcagaagaaaaacatgtgagatgggaaatagtgttatggccatctttggacaattattaatactattgccatagtttgccattttgccaaacttcacatccctcctgtatctgaaatacacgcaaaatacactgagcttctcctcaaaggtccctaattcacatcccatcatgacagtaactcagagtccagtatctcatcatataaatcaggtccaggtacagaatagttttcttgggtatggttaattggatatggttcttcttgaactgaggacccatgaagagacagtttatatgtcccctgcatactttacaaaatggaaaaggcacaggttatctgcagtagacattcctcctcaagaagcatgcaaggtaggcacagtctgtagcaattctgcaacctcactgggcacatgttgccagttccttgattaggtctcagtcctgcttcctggaagtcattcttaataggacataggcttcttctgtttttgggtttaccttctgaattatttatctcccccacccctgcacccaacccatataaattgctttgtatttgtaagagtagctttctgagcttgcttcctgcctgtagtgctccagagtccaaaggcccccttttatatagcaactgtccctttcattccaagctaatacaactcctttaaaaactttgtggacttcctgtgtgtaagtttataatctgtactgccatacccacaaatctcttttgagaggaactctttcctcccctaagctctgtgtgagtctgctgtgggacaacacccttaagatccttagataatatttcgtctgaaaggatctatgaggtactgatttagatcttaagaaaggatcttataatcacactctagattggatctttgctctgaggccctttttatttgacactttgctggctgaaaagattgttctgagtccattacatctccttgaaattctactcaaaaaatgaatagcttattctttagttcatctctctgttctctcaattataagggcagctagaagaagccaaattgctttaacttcctgctgagaatctccttaattcattaggtcaggtatgtattttattttccatgttaatgtaggtgacagttttgctaaactttgccctagtatgtaacaagggtgtcctcttattcagctttcactatcatttctctcactttgcttgaagtcctcactgacagtctccttgagggctcttaggctcccatgaagtttcctcaagaccctttacatgtgtgaacacaaagggtccttatctgttcctggctatatagcaggtccttgaataactgtcatttcttcataacgttgataagaaaaaaatggattcctggctggggccactgtttgtgtggagtttggacattctccccacgtctgtgtgggtttttccgggtgctccaatttcctcccacattccaaagatgcatatgttagtggatcggtgtgtctaaatggtctcagactgagtgatcatgtatggatgagtgtgccttgcagtgggtgatgtcctgtctagggttggttcccaccttgtgccttgagttgctaggataggctctagccactcgtgactgaactgaattgggttaataattatcctacttgtttttattagtctttcttaaatgtgtgtatagctcacatttatttcagtgtttaataatcagagtgtttggaatctttacttagaagtttgatgatgtttttgtggccataaatatgccataggaacttccttatctcaattagcctatggaaaaatggattttgttacacattgtttcacttaaagtcacagtttccaagaacctattgaagacagtgaggattaactgtactagaactgtttcctaacccactggttcttatcagaattacctaaaggacttattgaaacacaaattgccgctgggccccacccccagagtttgtttcattagctctggagtgggacttgaggatttgcatctgtgagttcccaggtgatctgataatgttgatctggggcctagattgtgagaattactgatttaaaccagggattggcaagatttttctattaaggatcataaataaaatattttagactttgtgggcaagattgtttctcttgcacctactcaattccgcctttgtggtgcaaaagcagttatagacaatacgtaaatgaacagacgtggctcatggctgtgttctcataaagctttatttacataacaggcagctggctaaatttggtatgtgtgaactgtgctctgccaattcccaatttaaatcattacttgactccacatctcttcaagctatggccccatttttcactcccctttggaacaaaactctctgagagttgtctgtatttgtctctttttattctttcataaaaaaattatctattttttgaacacatttaaatgtcttagaattcaaaaagtagtaaatatctttgtacatttgtcagggcgtgtgtgtgtgtgtgactataactaaagattaagtagaagaggagttgctgattcaaaagtggtatatgttactaagttcaacaaatattgccaaattgacatagaaataccaagttatgcttttctacacctttactaacattgtgttttcagatgacttgattgttgccaacttgagacgtgaaaaatagaatctcattataattttaatttgctttttattctccttttttagggaactcttcactcatatcttggcccactttctattggatttgtggtccttttactttgctttgtgggagctcttatactaaggaagatagctttgagtttgcgaaatgagttgttttccctaggttgtctctttatctttttgattctgtagatagtgtgattttgttgttgtgcatctaggtaggttccttctaaccctgaaattatattttgagattctcccttgttttcttgttccatctggaatttatactgatgcaagatataagatgggacgcaacttttttcccctagatggttgtccagtttcaatactatttgtcagataatccttcttttctctgctgctgtgaaatgctggtgttttaaattgtgtatgtagttggatctatttctggactttgtttcattctaaaaatggctcctctgaaaccatattgtgagttcttgggtagtgaacatttctatttatttgtttccaagtcctgtataatatttattagcatatgggaggcattcaagtacttgaaaataaaatgaataaatcaagcatttaggaatagaagcagatctttttgccaattattcattttagttattctatttaattctctatttctgattttaaacttgaatttaaccttggttttccattttagttttaccttttttttaaactttattgtgaagtattaagttattttttgtacttactgaatgggcatttgctaacttatgtgtctgctcttattagtctatttttggcctcaaattgttaaaaattcacagtatagttttatttgtatcaaatttgctactgagggaagcttgtcatttcataatggcaatccataggataggtcaagtcatttgagattggaaccattaaggataagttcatttaacattgaattattagatctgtggttaattggccaggttagagaagacagaattacagggaagtctggattttacaacttattattttagagggtcaaatttagaataatatttttaagctttttaagtagaagtatatggatcacctgaggtcaggagttcaccaccagcctgactaacatggtgaaaccctgtctctactaaatacaaaaaaatagccaggtgtggtggtgcatgcctgtaatctgagctacttgggaggctgagacaggagaatcgcttgtacctgggaggcagaggttgcagtgagctgagatcgtgccattgcactctagcctgggcaacaagagtgaaactctgtctcaaaaaataaataaataaataaataaaaataaatacataaatagaagtatactattctgattctcttatttatatgtataatttatttttttaaatacatgaggtattgtagattttttggtttttttgaggaggggcgggggtgatgtgaaatatagttttcattgcatcagatcttcagttgtaatgatattgctggaatccaccatttaggaccctgtcttgttaaaaaaaaattatccttgccttcacccctacccctccctgccacagacttttaaaggtaagtattctgcgataattggattatatttactattatgaaaatttaaaattattagaagtaaaatgaaatatacctccattgtagtaagtttgattcacagtgcctctggttatggtggtcagtaaaagtaacactgtattaggaacagtcttcatggtgggagttctctccttttactcttctgttagtttgttctttttttttttttttttttttgagatggtttcactgtcactcaggctggaggacagtggctcgatcacggctcactgcagccttgccttccctggggtccagtgatcctcctacctcagcctcctgagtagctggcactgcaggcgagtgccactaggcctggctaatttttatatttttttttgtagagatggggtttcaccgtgtcactcagtctggtcttgaactcctgggctccagcaatctttctgcatcagcctcccaaagtgctgggattatggttctggagccaccgcgcatggcctgttagtctgttcttgcattgctataaagaaatacctgaggctgagtaatttataaagaaaagagatttaattggctcatggttctgcaggcttacaagcatggggctgacatttgctcagcttctggggagtcctccgggagcttttactcatggtcaaaagctaagagggagcaggaatatcacatttcaagagctggagcaaaagagaatgtggggaaggtgcacacacttttaaacagccaaatcttgcaagaactcagtatcttcaggacagcaccaagggggatgttgctaaaccattcatgagaaatccacccccatgatcaagtcacctcccaccaggcctcacctccaacattggggattacagtgcaacacatgaaatttaaaggggacaacatccaaactgtatcaaccttgctgtacccctcagcctcattttataggcaacaattgaatatattggttttataaaggtttgatatggaaagattcattaggagtggattttaggacttggggaatgactcagagaagaaaatagtgcatgatagtataagtctatctgattgatgagtaactggaaatccttccaaaacataatgcttcagtgtctgcagaattgtttcatttccatgtttatgtatttcttattgtttccttgtttatccataggtgcttaatttttttttaatctgaatgcattatgataatctttaaataattatttcagaggaatatctgaaatattcagtgttcttctagcatggcagtattttaaaaatcattatgagcttaaattcatactgatttaaacaacttctagatttttttgaatatcaatagcagagggtagttttaaatatttcacgagcagaattaattaaatttcctgtgcaattttattttttatagacaaactcgtcacttcttaaaatcttttaaaaatgtcttggtaatacaggcttggaatatgatggtattgaaatgagatcttaagggaaaaaaaactccaacgggtttttttgttgttgttgttgagatggagtcttgctctgtcacccaggctggagtgcagtggcattatctcagctcactgcaacttctgcctcccagattcaagcaattctcctacctcagcctcccgagtaactgggattataggcgcgcaccaccacgcccagctaatttttgtatttttagtagagacggggtttcaccatgttggtcaggctggtctcgaactcctgacctcgtgatccgcccgccttggcctcccaaagtgctgggattacaggcatgagccaccatgcccggccaaaaactccaacttttagaggcctatttacagcacttgtcccatatttgttcacactttttctgtatgtgtgttgtgaattataaatctggcttttcctacaaatgtggcttttcctgtgtagtcatcattaagcatgattctaagaagtagctcaaaatctcctaagaccaaaaaccacaaaaaacaaaaaaaaaaacaacaaaaaaccaaaaccagaaaagggatacattttgcagaataatttatattttcttctcttcatggcatcagttttctcaggagttctttttttgagatggagtctccctctgtcacccaggctgtagtgcagtggtgcgatctgcaagctccgcctcccgggttcacgccattctcctgcctcagcctccggagtagctgggactacaggtgcccgccaccacgcccggctatttttttttttgtattttcagtagagacggggtttcaccgtgttagccaggatggtctcgatctcctgaccttgtgatccacctgcctcggcctcccaaagtgctgggattacaggcgtgagccaccgcacccgggctcaggaggtcttttaagcttttgcctgtcatgtgtgtacttctgacgctggcccaaggtaaaatgattacatttgacttcggtagcccttaaatgtatggctgttcttaatcttttctaaagcctaaaagttgaattagtattcatcttagatttcttgtttcttaagtgaaagaatcatgacattgtattaaaatatcttatttgcatgtattttatatactgttttaataggcagtagtagtatacaagctttgaccaaatgtctcttcatataaaaaattcaagtgaataaaaacagtcatttaaaaatgacattagtcaaaggggcaaaaaagattacaaatgcttattgtgattgacagaacttgcttaacatattagggttctctagaaggacagaactaataggatatatatatgagtttattaaatattaacttaaatgatcacaaggtcccacaataggctgtctgcaagcttgaggagcaaggagagccagttcaagtctcaaaactgaagaacttggagtctgatgttcaagggcaggaagcgtcttggctaatccacccatcttggcctcccaaagtgctaggattacaggcgtgagcccccgtgcctggtgtacatcatttttaatatctttatagtattctgttggctaagttgccacaatttatcagacccctttaatgtcattaattttttcccaatatttagacttgtttcatagaattattagatatgcatgctactactcctgtcctttttcaaaggacaattattagatattcttgttttcctcatatctttgccaacactgggtattggcattcttcttgtttaccagtcagctaaggaagctaaggaagaaacaatatctcatttttatgtacttttctctgattcttaattatgttgaccatgttttcatttcttttgtgaaatgcctatttatgttcattttcatattaaattgtaagagttacttgtataaatatattaaacctttgtagtatatattttttctgtttttttttaaagttttgattatagtgtttataatatgcagtcaaatttacccatcttttatttcctctatcatttttcacttagatgtggggtttagaaaggaggtacataatgtgacagagtttttggtatagaaataactgacatagttagatataaaacataccaaggaaatagtcggaaatgtccaatttcgaatgtgtaaggagaccagtaagaaaatcatgaagaacagctaacagcagtaatttttaaaagggtatttacaaacacttgaaaatgtttatgtagtttaaaggaatgattcaaatataaagagaagcgtaacataaaaatgaaataaaggcatatatatagtcattgtgtagatggttttctagtaacagttataccaagtttgaaatgatttttaggctttgttatgccaacttttaggagttttctttttaaactttttgagcttatgtttcatcatggccaatttttataaattttccctatatgctcaaaacatttttttagtggaaggttttaatacgtctgtaatttctccggtgtcttaaaaataattagtttgtggagctctttgtgtattggagataccatcttcttgtttgatatatttgtatatgtattaagtaagaactggataaagaaggtggttgggatatgtataaatatcaggtaagaacttgataacgtattggttggtttgcatatgaaaagttgccctcactgtcaggttctttcctgtttctaggaattggctagccctggaaggactgccccttccagggtcagcaaattcccaagatagcaaagcatcaaaaatacagaataaaaagacatgcttagtagagtatatagaaatacaattggttttgtttattttgtgatgtatcctgtgatactggtaaattcatttataagttctagtaattttttggtagaatcctcagcatttttgataaatacaatcatgtctgcaaataaaaagttttatttctttcatttcaatctctatgtcttttatttcattttcttaccagattgcattaggtagaacctccagtgttgaatagaaatggtggtggtgagcatcctttccttgttcctgattttatggagaaagcattcaatatgtaatcattaagtaatagaaggttgtttgtagatgatctttattttattgaggaaattcccttctttttctaatttatttccagaaattttatcatgaattggtgttgacttttgtcaaatgcttttcctgcaacaattgggacgatcttatggttttgctccattattctgttaatgaggtaaattgcattgattcattttcaaatgtcaaagcaaccagtatgactggaataaaacccacttggtgatggtgttctgacctttttatatgctcctggttctatgttctattattttgttatgttcatgagaaacatttgcctgtaatttttttttttttttatgatgtgtttttgccaggttttggtattaggataattctggccacataaaatgatttggaaattatttctgcccctctgttttctgtaagagtttatacagaattggtactattttttccttaaatagttgacagactttcccagggaagtcactttggccaagagttttctttgtgggtatgtttttaatgaagaattcaatttattgaagagatatgatactattcaaggtttctgtttcttcctatgtcagttttggtaatttttgtctttcaaggaatttgttcatcaaatctaacttgttaaagtcattggcatgaagttgctcctatctttttatatccacttactgtttataaaatctgtagcgatatcctgctttttttacatcatatggggcacatattggtaatatgtgttcttttctgtttgtaaattgatcatcttagaggtttatcaactttttaaatcttttctaaaaacaaagttttggtttgattgattttctttattgttttatatattattaatttttgttctttattctttcttcactctctggttttgttttctagctacctaggaagcttacataattaatttcatatctttcttcttttccatcataagcatttatagctatacattctctctaaccactattttagctgtattcccccaaattttattgtttattatcattcaggtgaaaataatttctgatttcccttttaatttcttcttcgaacctgggattatttagaactatgttaattttgcaatactgggagattttctagatagttttttgatatttatttctaattcaattttgctatggccaagaatataattcatattaattcagtcttttcaaatgtttgagaattggtttatggaccaacctatggtataacttagtgaatgttctgtgagcacttgaaaaggatgtatgttctgcagttgttgggcattgtgttctgtaaatgtcagttatatttagttggttgatgtttaggtcttcattatttttactgattaaaaaaattttttttgttaattcctgagaaatgagtattgaaatttttagtgtaatagttgttttatttccctctttacatttttgcttcatgtaattggaaactattattgtgtgcatatatatttaagaagagtaatttataaatcttctatgattagtgtttttatgttctgcttacaagaggtcacattggtctgttttccatcttaaattaatatttgtgtaccgtatgaagtagatagaagttaaggttattttttgccccatatgaataaccagttgactaagccacatgttttgaaatgaccaatatttcttcactgaaatgcaatggcacatctgttccaaattaggtaactgtatgtgagtatgtttttttggactctattctgttccatttgtctatttgttcatttttgtgctaataccaatctgcttgttctatctttatgataaatcttgatgtctgataatataaatctttagtttgctcttcaagattgttttggctattgtaaatcctttgtttttcacagactttaggatcaacttgtaaatttccacaaaaactgctaggattttaattggaagtgggttgaatctatagattaatttggaaaagaaccgacatctgaaccatactgagtttttctgtattcttatatcagcatggtctatccctctcttatttagctagcatttattttttgtagaaatgttttacagtttttattgcacagtttttacagatatttccatagatgtattcctaggtatttgattttttgttactattgtaaatgatactatttttaaatgttcatttaaaaaattgtttgcttctgacatacagaaatgcagttgatttttatatattggtcttgcatcttgtgactttgctaaattcactcagtgattggtagattcttttaaatttcctacatatacagacatgtcctctatgaatactgacaattttacttatcctttctaatcatcataacttttatttagttttcttgccttattgcactagccacaatgtccactatggtattgaatagaaatcatgattttagacatgattgttacgtttttgaactctagaagaacaagatcaatattttaccattaggtatattgtttttttactgttaccctttatcagagtgaggaagtttgcttttattcctagtttgagattttaaaatcatgaacattggttaaattttattaggagtagtttctgcatctattgaaatgatcatatggtgtgttttctcattgtgctaataatgtaaaatatattgactatttaaaaaatttttttctaaattacataaaaattgtatatatggtgtacaacatgacattttgttatatgtatacattgcagaatggcaaaatcagtctaattaacatatgtatcacctcacatacttatcttttgtggtgagaacacttaaaatctactcttagcaattttcaagtatacgatatattgttattggtaatcaccatgatgtacaatagatctcttcagtttactcctcctatctaacagaaatttcgtatcctttgaccaacgtctcccattcctcctaatgggaccctcagcctctggtaactgctgttctacttactctctgcttctatgatttctacttttttagattctatggatcagtgagatcatacagttttgtctttctgtgcctagctttatttcacttaatataatgtcttccaggttcatccatgttgttgtaaatgacaagattttcttctttttttaaggctgaattatattctattgtgtacatatgctgtattttctttatcagttcatctgttgatggacacttaggttgattctttatcttggctattaagaataatgctgcaatgagcatgggagtgtagatattgctttgacatattatttttagttccaatacccagaagtgggattgctaaatcatatggtagttccattttaattttttgaggaacctccattcattttccatagtgactgtaaaaatttacattttccccccaagagtatacaagagtttctttttctccacacactcaccaatgcttgttatccttatatctttttgataaggctcattgtaacaggcatgaggtgagatctcactatggttttaatttgcatttagtgatgttgaacgttttttcatgaacatgttggccatttacatattgtcttttttttttttttttgagacagagtcttgctctgttgcctaggctgaagtgcagtggtgtgatcatagctcactgcagccttgacctcccaagcgcaagtgatcctcctccttcagcctcctgagtagttgggactgcaggcatgtgccagcatgcctggctaatttttttttttttttttttttttttttnnnnnnnnnnnnnnnnnnnntcactgtgttgcccaggctggtcttgaactcctggtctcaagtaatcctcccaccttggcctcccaaagttttgggattacagggttgagccactgcacccagtctgtattgtcctttgaggaatatctgttccggtcctttgcccatttttaaatcaggttatttgttttcttgcttttgagttgtttgcatttcttatctattttggatattaactccttatcatatggatggcttgaaaatattttctcctgttttataggttgtcccttcactctgttaattgtttcccttgctgtgtacaagtttttaaatctggtataatgattgatttctaaatgttaactttgcactcctgggggtaaattcatttggtcaagatgtattcttttaaagtgttattggatttaatttgctagtattttgtttagcatttttttccaaatatgtttatgagagagattccagtgtaatttttttccttttcatgtccttacatattttggtatcatgtttatactctcattttaagaatgtgggtaagtgttttttattttctatttcctgagagagtttgtataagctcaatgtttcttcctcagacatttggaaaaatttaccagcaaagtcactgggcattacattttctatgtggaaaagttttaaatggtatattctgagggctctgttctgttccattgatctatatctctgttttgctaccagtaccatgctgttttggttactgtagccttgtagtatagtttgaagtcaggtagcgtgatgcctccagctttgttcttttggcttaggattgacctggcgatgcaggctcttttttggttccatatgaactttaaagtagttttttccaattctgtgaagaaagtcattggtagcttgatggggatggcattgaatctataaatgaccttgggcagtatggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaacgggagttcactcatgatttggctctctgtgtgttattggtgtataagaatgcttgtgatttttgtacattgattttgtatgctgagactttgctgaagttgcttatcagcttaaggagattttgggctgagacaatggggttttctagatatacaatcatggtatattcaatttttaaattactgtatttgtttgttctcatattgctataaagagctatctgagactgggtagtttttaaagaaaagttgtttaattgactcatggttccataggctgtacacaaggcatggctgggaaggcctcaggaaatttacaatcatggtagaaggtgaaggggaaaaaagtacatcttcatacagcaacaggaaagagacagcaaaggacgacatgctgcaaaaatttaaataaccagatctcatgcaaactcactcactatcatgagactagcaaagcgtaaatccatcccatgacccagtcacctctcaccaggccactcctctaacactgaagatcataattcaacatgagatttgggtggggacacagaaccaaaccatatcaattatatatagaattattcaaattttatatttcttcttgtgctagtttaggtaaattgttttaaaaggaacttcatttgtttttaaattggagaatattcctgttgtcttttacatgtttcaatattgtaagctctggtaataatgtctactttttaattcccgatattgataatttatgttttatcttctttttttcttgatcagtctttctagtgttttatcaattttaatgcttttaaaaagccaacgttttactttgcttttctttattttatttttatttttctctgatttctgctcttaagtactttcatttttatggtttttggcttaatttgttgcaacttcttgaaatgaaaatttatttaataacattgttcagcctttcttctcgtcttgtgtatgaatttaagattatgaatatcttagtatacacttttactgcgttttactcattttcattattgattcaaagtatttttaaagttattctttgtaccatgggttctatgaaaatatattgattaatttacaaatatatgcgggtttctagttatttttctgtatatgctgtggtacttttgtcagtggttatattttccataagagatttttaatttaggtgccattggcaaatttccattaattcaaatgcagaacttcacatttttcaatgcatacgtgagttttttttgttgaggtattaagaatagcataaatttataaaatattaagtaatcattgaatgcaaaatatgtcctattttgcaacttaatatacttttattaggttgacgctaaagtaattgcgttttttactcatactttaatggcaaaaaccacaattacttttgcaccagtctaataatgagaattattattattattatattgtcttttttttttttggagtggagtctcactctgtcacccaggctgaactgcagtggtgtgatatctgagccttggctcactgcaatctctgcctcccaggttcaagcaattctcctatctcagcctcccaagtagctgggattacaggcacgtgccaccacgcctggctaatttttgtgttttcactggagaacagggtctcactacattggcctggctggcctggaattcctgacctcaaatgatccccccgcctcggcctcccaaagtgctgggattacaggcatgagccaccgcgcctggccctaataatgagaattcttatcaaactgtttacacagaataacatgagtgggtaatggtgaagctgagtttcacatttttatgcgatattcttcagtgttgctatttgttcagtacttttaagaattatataaattttttatagtctatacataaagtcaatattatgggtcccaaatatataaaatgtttgcttgttccattgtttatgttttgaatacaaattatattttgtatgatttcattaataatttgttgagaattttatggcctaacatgtggtctactttctaaaatattccagcttcatttgaaaaggatatgcattcttcagttgttaggtgtttgcttttgattgcttgtatttctcagtcaaatgtaggaagtggagattaagaaaagggctggcacttttggtgattgaggaggagaaagtatgagatagttgtcttggatagtggaagagtaaatgttctaaagaaatataaaatgatagttgagcagcactaagggcccatttgagtatgaatctaaagagggaccaatctgaatgcatgtgttttcatcagtgatttttatatgtgtgggtaaaagctctgagtagacagagataaactgaactcttttagagtttctttgttatctttggtgtttggatcctttgctttgatttgtatcggtacagtttttaaaaaattaaatgttatctcctctcagcagatctttttaacatgaacccagcatctttaacaccaataaaatttcttctattatttttcttccctgtgttttcattcgtcctccatctagagcttctctttagaattgtactccctggattgatcctcttatttcttacttttatgctcataatatttttttctttctgtctgtctctttctctttctgagtctaggacctgggagtttgtcttgactgtcttccaaattatgagtttgatcctttgagtcgtattattcaactctttcactgaattgtcatctatctctttttctttaatgtatagagaatttattatgcacagccacttgcaaactttaacaagtatgattagagcagcattttctataacagcaacacataagttggaacaacacaaatcttaaaataactggaatggatgagcaaattgggtggtccgaggctcagacatcagcaggtgttaaacacctgtgggaaaggagagaacgatccatttatttatttctataggaaatgcaaaagaggcaaaattaagaaaaatactgcttcatgataaagaataaagccgtgaagaatatccacaaaattgtgtatagtggctacatctgatacagaatggaaacagccaggatagagcagcacaggaacactatgaaatgcccaggctgtcttcattactagtcaggatttttttttttaattttgtaaactttatttattctctgctcctttttcataatctagtgatgctttatgttttcaaaatattcttaaatctctctgagaataccgagaaagattttaaaccaagttatcttccctgcattatctgtttcttctggggtcagttgttttctggtccattttggtcttactcttttattcctacaacccctgccccatccccatcctaactgtaataatccttgataatcattgcatatttatgctttttatgtgtgtgcagacaactgtttttatgcttatagatgccttcctctgtgtattttttttcttcagttaaaattttttttttttgcagtcacagtcttgctctgttgcccaggctggagtgaagtggtgccaacctagctcactgcaggctcaaactcataagcttaagccgtcctcccatttcagcctcccaagtagctagtactacaggtgcacactacatgctggctaatttttagatttcttttttgtagagacagggtctcgcaatgttgccggggctagtcttgagctccaggctcaaacgatcctctcgccttggacttccaaattgctgggattggaggcatgagccatcgcacctagcctatgtatgttttaaatagagtctatttcctctactctgtcattctagtcctatctacttttgatcttcctggaattactgtaaatttctgatttgctgatagcaccttttcttatttgtcggagccgccatgaattcgtttatataaacttttaattttactccttttagctactgttgttacctgttttacttttatatctattttaagccctaccatacaccgttattattcatgctttaaacaattgtcagttgtcttttttttttttagacggagtctcgctctgtcgcccaggctggagtgcagtaaacatgacctccgttgcaacctctgccttcggggttcaagcaattctcctgcctcagcctcccgtgtagctgggattacaggcgtgtaccactatgcccggctaatttttatatttttagtacagacagggtttcaccatgttggccaggttggtctcgaactcctgacctcaggtgattcacccgcctcggcctcccaaatgctgggattacaggcgtgggccaccacgcctggctgtcagttgccttttaatacatttaataaatggaagaagaataatattataattaatcacatatttactatttttgagctcttcattcctttctgtaaacctgagtttacatgtaatatttcctttaatccacatgattttctttatcagttcttgagtgtgagtttgttggtgatgtactctctcagcatccatttatctgaaaacatatttgttttgccttgaattttgaaaattcttattttttataatacaacagatccagtagtatgagaattatttttcaggattgtagaattctgggttgacagctttccccctctccctaccagtactttgtcttctggcctccattacttctgaagcgatgtcagttctatttcttgtcttggttctcctgtatgtatgtgactgcttttaagattatctttttgtctttggtttttagcagtttggctataatgtgacttaagtatggatttgtatagattggattcagatgaactttttggatcggtggtttgatttttttaaacaaacttggaaaacatttagccagtattttttcaagtatttcctctgttccacttatatgtatcagactttgttactcttgttgttcagtggtgtgatcacggctttctgcagcctcaaactcctgagcgcaagtaatcctcctacctcagcctcccaagtagctgggactacgggcacagagcaccatgcccagcaaattaaaaaaaaatttttttgtagagatggggtcttgctatgttgccagggctagtcttgaactcctggactcaagcaatcctcctgccttggcctcccaaaatgttgggattaaaggcatgagccatgactcctggcctagatttcttgatattgtagagtttacatatggcttctttatcttcatgcattatattaattttttactgtaaattctattacatatgtatcatagtaaacaaagtctttaaaataaattctaatatttgggtctgctttgggtccatttctattatatatattcttcttttcatgtttaataagtttcagctgactattgtacattgtgggtgatacagtgtagaaactccggatgatgtggatttcaatctttctctgaagtaatgagttttgttctagcaggcagttaaatttactagcagaccaacttgatcctgcggaggcttggttttaggctttgttgggacaggtctatttcagttttgccattacttctggtaagtggctcttattcttcaagtgtggcttttctggcgtttcagtggaaagcctgagatatttaccagttccctctaacactaaatcctgactctccaggaccagatagctgttgaaatctcttcccagttctttcagatttctagctattgcctgtccctgggcttcgattttcatcctatggatgggaattcaggagtcaggccccactgactcccattttcctgagatttctgccctcaatttttggcttttctagcagctccaaacttcattctctgatactttcacccagtaagactgcagctttttacaagagctctgtcccctcctctggcccctgcctgtacacaacagactgtgtatgtagttgtctcaggatggaagaagagtaagtatgggcctcattcagtgtattccccttctttcaagggtcatatccccccgatttgtatctgcttttgtttctttgacaatgccttcaaatggtgtttttataaatatatatttttaaaaagtttataattgtcgtcatcaggaacattagtgtagtataaactactctctcattatcaaaaatctgtatgttaaaaattacttaaaattgttgttatttatcatttccttggtgtttggggcagaagggaatgcacatgatttttctgaacttctcattaagggaggcaacccagccttggtctggagatcccgaaattataccgtatgtataataaaataattattttgttatttttatgagcatagcattaataaattaaatatttagtaagatttgtatctcaggatttttctacctgctaagaatagatcgtttgacaaggcagatgaggttctttgttgaattataaggtattgaagcctataatttagtagtggaaagagcacatagcaagagttgtatgatgaggttggagaggtaagcagcaaacagataatggaattttagtctaaacattcgtaaaatatgagggtggctcctgtgggagattaggttattgggaggcaaagtagacttagggaaaatagttaggaggacattgcaatagttcaggagagaaataatagctgtttagtgtatgatggtagttgtggaaaaaaaagccaatggatggatttgaaatatagtttggaagtaaaactatcagtacatattgatggactggatataggggtgaaaaaagagaagaataaaggttgaccaaattctttattatctcaaagtatgaaagcttgttaagacctcttttctgtttgtattttctttcttgctcaataagaaaacaacccaaagcactttttttctaataacttatatcttcttcttttgtgataaaaaaaaataggagtggtctttagagtacaatacaaaattcttttacatttcacctcaccatatttaggtttaccaaagtagtataggaataattgtaggaaaaacatagtatatctacttggactataaaattttggtatactaaagaaagtaaatcaaaatggttatatcttgcaatagaatgcaaaatcacatggatattaaaggtaaacatttaaatgtattttatattcttggcttcttcttcagaccactccattgccttttgggacatttctgtggaaaagttgagaagcactgacctatctgaaccttccaatccagccaaacttgtctctactttgttccaggaacatgctgtgtacattcctctttccatgttttgcatgcttttctccctgccaataatgccctgtttttcattacttgtcaaaattctattttccttttaaggtccagcctatgttttaattgttgtgtgaaacttctaaaacctttctttgttttaaataattatgatcattttcttcttgtcattttgtagcacttaatttttaaaatttattttgtacttagatgatgtgtaatttactataaatcatagatttttaagaattgggaggaacagcggaaatttaattaagtaattttattatacaagtgaggaagctgagattcatttgtcatgtaagtagtttgcaataagaaaggatgaaacttatttttaggtctcttggctcccaggttagtaatttttctaatctactgcattacttcttcatgtatatttattgatctgaaaagttgtgtctcttagaattatgtagtatatgagtaaagtttgaaaatatgaacttttaaaatgtgatatttgaggtactggtttttgagtgtatgtgtacagttgattaaaatttattataacttttatttactctttctttttttttttttttttttcgtagagacaggttctcactatgttgcccaggctggacttgaactcctgagctaaagtgatcctctcaccttggcttcccagagtgcagggattacaggtgtgagccactgtacccagcctcttatttactctttattcaacagatttgttaatcaacacatgttgaccagacttaattacagcttttatatactcttcatttattcaacaactttcatgtgtcagagagtatcctaggcactgagtgcagtagtaaataatacattaaggttcttaccttcaagaaactttcattctagtggtacaagacaatgagcaaaatcataatctaatctatggtgggaaaatatcagaacagctgtggccacttgagtggttggagcagggactgatggagaaggagcatggaagaactttctgggatgctgataatttcttagggctttgggttacataggtatatgcagtgtccaaacttattgactggtacacttaagatttgtgcatttgattgtatttaggagggaaaatcctgtaaaactagaatagatgtaacttatatgagagttataaatgacaatatgttaaacacccatgaaactaccacccaccccaggaactagaatgttgccagcaatttgcacctacatatgtgtttctccctagctattctcctgtctatcttgcagaagtaaccattgtgtattgtattttgggattaacatttccttgattttttattttttttttgcgggggcggggggagatttgtttaacacatgtatatgcctaaacaatgtactattcagttttgcttgtttttgaaatttagaaaaacggtattttacagcttacagttttctataatttactgcttttgcaacattgtatttttaagatttatccatgttgcataaagctatagttcatttattttaacaactgaggaacagattctgtagtataaatgcacaaaagtatttacctattttcctgatagtttgggttgtttgcagtttttgccattggaagctgaggcgcaatgaatattcttgtaatgtgtctcttggtgtaaatatgcatgaagtttgtaactagacgtagaattgtagcagttctcagaacgtggtctctagaggatgcctgggtatcctaaaaacctattcaagggtttaatgaaattaaaatgattttcataataatgccaagatgttaaatgtctttttcattgagttgacatatgcacaaatggtacagaagtaatagtgagttaaacggctggcaccttagcacaaatcaaagcagtaatgctggttgtagttgtgatcattgtattctttttctttttcttttcttttttttttttttgagacaaggtctcactttgttactcaggttggagtgcagtggcatgagcacaatcactgctcactgcggcctcggtctcctgggctcaagtgatcctattgttttctttctcgtcatgtacttccaggaaaagaaaaaagccaattcgagtcacttattcttttgattctttttcgtagcaaagcatcaatgcattttctaaatgattgaattcatttaaattcgggaaacatttactgagtgcctatggaattctgggatatgagtgtatgtttaaggcagtgtgatttccagttaccatcctttctgttctaaacacgattgtgtcatattaaaatataaaaagagtaaaaaatatcctgaataaaaatagatcaagctgtacatatatatagattataagtgcaaaatactgagtgtggttaaagcctatgctatgcttgctgggtttcctgtacagaagtaggcattggagacagttttgctcttgtggtacaacatggatgactagaggcaggtccaggatgttacttttactgccagccgtcgcttccctccaaatagactattggaaggggaacctcccgccaaacgctgcctactgctatagtgttggataagttgcaagcttaggaagatgagatgacatgatttaggaacttcaggatgaagtgaagtatctcctgccttgtgactgactggatctgcatcgtatcagatacctcctcaaggcaggaattttaacctgctgttataagacctggttctatatatggatagcccaggtaggctaagttgtggcagccacagattgttagatgaggagggacaccacagactgtgtatgtgtgtgtgttgagggcaaggtgaggtgaggaatggtgcaatgagcctgcaaaccaaattgcaaaatatatgaagaaatgtagtgctaagaaaaatagtcaacaaaattaaaaattgaaaaatgaattttttcctgataaaatttaaaaatgtaagtaaacctctaattgaagtgtaacacacaaacaggaaagtatgctactcataaatgcacagcttaacaaattttcataaagtgaacacacctttgttaaccactacttagatcaagaaatagagtatcacctgaattactggcaggaggcaccccagaggtctccctgtacctcctgccagttattctccatgccctcccactatcccaaccctgccaagctaaccattatcctaactttttttcaccatgagaaagaaatggaaggatatggaagtgagcttgagaggcctccatggtcagtgaacagttctgctaaaataatttagagggaataacaaagaagtagcatttgacggcatagtagctgagaatttcctagaatagaaaaaagacatgaatctttagattaaaagtatgtagtcatttttgatcaagataaagaagaatctacatcaaaacctttccaaaaatattgcagaacattgctgctaatgcaaacaagttttaaactacttgagggaaagccatgacatgtaggagtgatagcagacttcatatttatgttaatagataccacaaaacaatgcagtaatatctttaaagttctggggaaagaaaattataaataggattttgagagtgagggcaacatatttttttcaaagactacaacttaaaaacccacagagccccactgaaaggtctactaaaagatacatttcagcaggaaaaagtgagtcctgaaggaagacccaaaacaatgatgagcacaaaacaatccaaagtcagtggtgggcacaaactgataaaattctagcaaatttactccttaatgctaagaacttcgtttaaattaactttctatcttttcagaaaaccaactcttagatttgttaatcttttccatcatttttatagtttctatgtcatttatttctgctgtgaacttcattttttccttccttctgttagctttgggctttgttcttctttttctagttccttgaggtgtaatgtaatgttgtttgacatctttcttcctttttgatgtaggtatttattgctataaacttccctcttataactgcttttgctgcatttaatactgactataataagatacgatgtaatagatttcaaggaattatgtatttttgaataaattaattctttaaagttgcatatccagttgcagatgaacttcaaaaatcttgcagttttatatctgttacagtaattgccaggttttgttgttgttgttttgatacattagaagttctagaattgttatatcctcttgatgaattaatccctttatcattctagaattaccttgtctctttactgtttgtgacttaaagtctgttgtatctgatatacctttgcatggaatatctttttctatccctttactttcagtctatgtgtatctttaaaggtgagatgaggttttgtaagtggcatgtagttgggtcatgttttttagtccatttagccattctctatcttttaagtggaaagtttaatctatttacattcaagtttattcttgatatgtgaaggcttattcctgtcattttattaattgatttctggttgttctgtaggtcctttgttcttttctttctctcatattgtttagcattgtggtttgttggttttctatagtgataacatttgaatcctttcttgtctgtgtgtgtttgctttaccagtgggtttgatactttcgtcatctgtttttcataatggtagtaattgtcctttttgtttgtttgtttgtttcttttttgagacagggttttgctcttgttctgtcctccaggctggagtgcagtggtgtgatcatggctcactgcagcctcgacctccatggtctcaggtgatccttctgcctcagcctctcaggtagctgggactacagaaacctgccaccatgcctggctaattcttttgtatttttcgtagacatggggttttgccatgttgtccaggctgctcttgaactcctgggctcaagcagtctgcctgcctcagccacccaaagtgctaggattacaggcttgagccactgtgcctggcctgacattgttctttgacttccatatgtagaactccctcaagcatttcttgtaggtctggtctagtagtgttgaattcctcagcttttgcttgcctcagaaaaactatttttcctttgcttaatgaaggataattttgctgggtatagtatccttgacttgcaggtttttttctttcagcacttttcatatatcgttccattctcttcctggcctgtaatgattctgctgagaaatctgctgttagtctgatggagcttcccttagaagtgactagactcttttttcttgctgtttttagaattctctctttgtctttgacaagctgttgtctctgacaacagttctctctttgtctttgacaaactgttgacagtttgactctaatgtgttgtggagaacctgttggaattttgtctttttggggatctctgagcttctgtatctgaatgtctaaatctcttgatatacttgggtagttttcagctattatttcattaaccaggttttctattccttttgtattttcattgtcttctagaatactgaaaattctaatattagtttgctttatggtatcccatatgtcatgcaggctttgttcattcttttttctttatttttgtctaatggggttatttcagaagacctgtcttcaagttcagaaattctttcttcgtagatgctctagaatgtattttttatttcattaaatgaattcttcagtttcagggtttcttgttttctttttaaatgatatctctctctttggtaaatttctcattgatatcctgagttgtttttctggtttctttgtattgtttatctgtatgcgtttgtatctccctgagcttctttaatatcattatttttaattctttttctggcatttcatgaatttcttttgcattggaatcttttggtagaaaattattttgatcctttggagatgtcatatttccctatgttcccatgtttcttgtgaccttacttctttgatatccacacatctggtgtaatcatcacttccatttttttgaatttgctttcatagggtaggactttttcctgaagatttgactggggtgtttgttggccagggcactttgggtttgaatctgggtgcatgcagtagtgtagtctctgtaagattttttttcctttgtaaacagcatcagtggtgtctgtgatttcctcagtggcatagtgtgtggttgtggaggctgtggtgaacttttgctggggatggtgacaccagctggactgatcctcagtcctcagttgtggcagcagttggacaaccatgcctgtacattagccccagggtggcttacattagtaatggtgttagtgggtccaggcagtccaatttttgggtctccaggtgacttgtttgggtaccaggagtggcagtgatgggctgggcagctgagtgggtccacaggcccctgggcagtgagcatggcatgggttatgtcagtagcagtggtaggagaacctctggctgtccagttgtctgtgcttatgtcggcagtgacggcgattggctgggtaggcaagtcctaaaacctgcaggtggcaagtgtgagtgggaaccagctgtggtggtagtggcaggttgggtgggccacatcctcagacccccaggtggaatgctcagttgacactggacgtggacaaactggtgcgatcccaaggcccccagataacatgcttggatacgtgggagtggggtgctgagctgggcagggtgagagtatcctcaggccctccagtggtgttagcaggtgctgtttgtggtgggcaggagcaggatgatttccaatttcctggtggaatgttcaggtgggggcagcagtggctgtgctgtgccctgatgctggggagggtgcggttgctgtcagtgggagcagttgtagggagttggctaaggagtgtgcactgcagctgcaggtggaggctgtagatgtgatgaagctgtactcagggtgcatgcaaatttgcattttgacacctagcggcagcagcctgcaatggtggcagctgtaggtggtagagcttgtcctcagggcacataccaatatatggcagcccttctgctgggagcagtggggttattgccaatggcttgtgctttggtcccagaggcggcagccagcaatggaggtgactgtcggtggaggatgtcagtggggctctaggggtgtggatatgcaggggctgttgggctccagggtaggaggcattctggtgtgggttgggctttaaaaatggcaccgtgctgtagctgcttaggactcaggggtgtgttggaccagcataagctccctctctaaagcaatgtcattgtgcagtctccaggcagctccctatgttactcccagggcccatgaaagttgacgggctctcttgtgtctgggattgcaggagtttgcagtgaaaatgtgggccactgggagtctctcacttactctttccccacattgtgcaggctctctaggcttctggctgatcctggctgagcaggctgccccacttccctctccttccttgcattaggtgttttctatcacttctctgttgaatttccgtgttctctcttagatgacctattcaaagtgtgattatctactcgctattttggttcttctttgtggagcaggtgagtaccagataactctagtcaaccttctggacccctcttcccccaatttgagatctcttcttctgttgtctgtaactgagtttaatgcttgtttgttcatgttaggattttatatcatcgtcctcaattaggttgttaactggaattttataatctttgtccacaggaagtttaaaatgtatgatttcttgcattgtgctttgtatgtagtaatacacgatatttatccagttaatggatttgacagccattgctgtcaaggagcagtccttctttgtgtatgaagggtgccttatcaatattatttccatttgtaactttatttatttatgtattcatttttgagacagggtcttgctgtgtcacccagactggagtgcggtggagtgcggaggtttgctgcagcctcatcctcccaggttcaagcaattcttccgctccactcccagagtagctaggactacaagtgcgtgctgccacgcccagctaatttttttcttttgtatgtttttgtagagatgaggtttcaccatgttgctgaggcttgtctccaacttctgggctcaagctatctgcccgcctcggccccgcaaagtgctaggattacaggtgtgagacactgcgcccagcccatttgtaactttattgttttctcttacaggcaaatgttctgaaaaagactctgcatgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttgcagaagaaatctgtattgctgcttctaaagcttgtggtaagtattaaaaaacagcattttcctttttatgcatggattgttttaattatgctatgctaatactaggtacatgcataatatatatttttatttttttaatgcttgtatggctggcgtgtgtgttttcacatgcatagaaaatgaaagtgttactggagtacaatttatggtgaatctgccttgggctaggtatcaaaacaaattgatgcccataaatgtttgctgactattctttataattacatataaggtggttaaaaaatcctgtcatgggctatctcatgacataaggtaatattaaagctagatcctgagagcaacatgaaagcaaaaaattaatgttttgaaatatgtatttgatttaaaatcttgattaaatggctgacaaaccatcattttcttctagttagcttctgaagacctctgccaatctttcctcatatatatttcttatgtctttggtgtatcttgaaatcatttttactcttgagacctgattatattatctatggaccaaaactgtgaaccagagaactctttctatagagctaacacattttactagaccactgaggttactatagagcctactatcatggtatctcatttttaaatgttcttttaatagaaagactagttgacactattttgaagaatagtcgtatgattttatttgtagaggcaaattaaatgtctaatatagtatttataagaatgtatgattacatcaatttattctcttatttaagatcagtataggtcagaataaccattaactgtaagttggaggaagctaggtacatttcaagttccttctagctattttgaaaaatacaatacattgttgttaactatagtcaccctactcttctatcaaacatttgaacttgttccttctgtctgtatttttgtgcccattaaccaacatctcttcatttccctcttcccacccatataaccttgccagtctctgctaccaatccactctaccttcatgtgatcaactttttagctcccacatatgaatgagaacttgttatatttgtctttcagttcctggcttatttcactcgacataatgaccttcagttccatccatgttgctgtgaatgacatgattacattcttttttacgatgccactgggccccaggggagtacgcattctgttgtgagctgggcttcaaaatatcaccttgctgtagctgcttaggactcggggggagcgtgggacccagtgtgaacttcctcactggaataggaaatgcttttgtgctgtctctgggcagccctctatgtgaattttttgtcctgcaaggggctagggtctctcctgtgactaaaattccaggggttcacagtaggaatgtggaccattgggcatctctaacttaacctttccctgtgtggagtctctcctagcttcttgccaatcccggctgggcaggctgtcttgtttcgtctccttccttgcttttctgttgaataccagtgttcctcttggataatctactcaaagtgtgattatatactcatggttttagtttttagtggggaagtggatatgagagacctctggtcagttatcttgactatattgtaaagtctgtattttttgttgtgtgtagtctctgaaatctctgatcctttagcttatagtaagattttagcttgtaagatttttttagcttttaagattttttagcttgtaagatattttttagctagtaagattttagcttgtaagatttttagcttgggccgggcacggtggcttacacctgtaatcccagcactttgggaggctgaggcaggcagatcacaagatcaggagatcgagatcatcctggctaatatggtgaaacctcatctctgctaaaaatacaaaaaattagccaggtgtggtggtgggcacctgtagtcccagctacttgggaggctgaggtgggagaatggcatgaacccaggaggcggagcttgcagtgagccgagattgcgccactgcactccagcctgggcgacagagcgagactccatctcaaaaaaaaatttttttttggcttgtaagattcatttttagcatgtaagattttgctttagcttgtaagatttttttttgacagattttattgaattcctagggccaaaagaaaataatagaaaagaacaaaaaactctttcagtctttgcagattggctctgtgttggggctctcattcagtgtttacccagtccatttacaactctgccttagccttcccttcctgcttgtgctgactctaaagaacagcttgaggtgaaagcttagggtcttttcttctaagttctgttccttgggcatgcatatggcttttctactctccaatacatagaaatgcttttcagtgctgtcatttcccaaataaactctcctctgtcatctctgttttggttttcagtgtgtttattgtttgcctcaactttagacctctgccccagatagcaacagcttgttcatttgcaatgttttcaatgaatatcttctgtgaagctgcttttctgccctgagaaagtcctgaattaagtggaacataggtgtgctctttgcatcatttcttcagtcagtccccagtcagggcaaaagagagaaaaacagttttttgagattaaggttggctctgttcactccagagccagggaccagagtttcacactgggagcaccaattgccatcttcaagactttgcttaactagggggagtggagccggggctggtgggcaggacatgggcgtagtgggtggttaagggaaagtaaaaatgctgcacaactttcctgccatttttaagtggctgttttcttgattcagcatttatctgattgctgcatatctttgcctattttctgtagtttatatgaagttcattctgacagtttttactcattttttttttcctgtttctgggagaaggataggtccttggaactacctactccaccattttcactgatgttactcttttacttttctaatcatggaagtaaagtttaagatttttctatctatattggtgagattacccttggtatcgtagtcaaactaaattcacaaaatgtgtcaatttctctgttcgctcttggtctattctctgtgatagtatacttaagatggaattgtctttcatgtttggttgaactcaaatataaatcttgtctgggcctgatggtggttttttctttcttcattgttattttgttattcttcttccttcccttcttctgtctctttcttgctccttctttcttttcttcttcttttgtttaagtggatagagtttgtttcctttttttttttttgagactgagtcttgctctgttgcccaggctggagtgcagcagcatgattatggcacactgccacctccgccttccaagttcaagtgattcatttccctcagcctcctgactagctggactacaggcacccaccaccacacccagctaatttttgtatttttggtagagacggggtttgccatgttggccaagcttatctcaaactcctgacttcaggtgatccacctgcctcggcctctcaaagtgtgtgagccactgcacccagccagaatctatttctttaatggttatagttctgttgaagttttaaattaatgaatctttttaaagttacattttcacaaaaattgtccatctgtctatattttcaagtttattggcataatgttgttctagcactctttgtcttcataacttataattatgctttttaaaagttcttagtgtttatctgtgcctctttttttcttattatccttgacaaagatctattttgcaaagaatcatcttttattttgttacttctccctattggatttttatcatgtccatctctaacctttctttgggattactctattgtcttctactatattgagttagatacttagatcatttgctcttattttctaatataagcagataaagctacaatttttcctcttgagtttcaccttagttgtattccacaatttttagtacatgatattggtaatcattattcattataaatgcctcccaatgtatttttcctttgacttctgagttatttggaagttatttgtaaataaaagaatgaatgcaagtatactgtttaaaagttgctgctaaataatgttattataaataacttaccgaaattattacacatctgtaagtagacggtcgtgttaataatttaaattaagaatttaagtctttcttgtcagtttgtcatttgtgccgtttctatctacagtggaaaatagtgaaaacataactagaataaaatacttttgtgttctgtgagccttatgttttaaatatataggattaaaaaaattttacatattcatttctgatttaattgaagtgtggttagagaacatggtatgaatggttattctgtggaacttctaaagacttgttttgagttcacgtgattgttgtgtttgtgcttgtgtgtgtacgtgtatgcgtatgtgtgaatgttctatatatgcttgaaaatagcttgtattatttacttgtgtggtttaggtattctcttggttttttagttcagtggctttcaaccatttgttgatgtaccttctaaaatatcttttaagaaattacatatgcactcacattttaagttgatatttaaaatttttcattgtaaattaaaatagcccaaaggacataattattaatgtattgtgtaaaacttgacacattgttcttttaagagtattcatgacttctaaatatttttgtgatttgatacctattaattaaaacaactccttctgtgcaaccacatgcaagcatggatttttattatacctccagttcagggaaacttgaaaatttgaaccaacctttctatagaggacaactgaagaaaccagatgaaatgttttaaaaatatctgcttgaaagagtctcagcagttatattttaaaatactgacacacctcggagatattgtgggtttggttccagactatcgcagtgaagcaaatattgcaataaagcaaatcacatgaagttttaggtttcccagtgcatataaaagttatgtttaaattattctgtagtctgttaagtatgcaataatattatgtccaaaaaagtacataccttaatttaaaaatactttattgtcaaaaagcactcataatcatctgagccttcagtgagtcataatctttttgttagtggagagtcttgccttgatgttgatggctactgactgaccagggtggtggctgctgaaggttgggtggctatggcaatatcttaaaataagacaatgaaggttgctgcatcagtggactcttcctttcgtgaaagatgtctctgtagtatgcaatgctatttgatagcattttacccgcagtagaacttctttgaaaataggaagttgattcactcaaaccctgccactgctttgattaagttgatgtagtattataaatcctttgttgtcatttcaacaatattcacagcatcttcaccaggaatagattccatctcaagaaaccactttctttgctcatccataaaaagcaattccttatatgtccaagttttatcgtgagattacagcaattcagtcacgtcttcaagctccacttctaattttagttctcttgttacttctaccacatctgcagtgacttccttcactgaagattaaatccctcaaagatacccatgagagccagaatcagcttcttccaaactcctgttaatgttgacattttgacctcctctcatgaactacaaatgtttttcatgacgtctagaatggtgaactctttccataagtttttttatttactttgcttagatctgtgagaggaaacactgtgacagccataaccttactaaatgtgtttcccaaataataagatttgaaagtcaaattgctccttatccatgggctgcagaatggatgttgtgttagcaggcatgaaaacaacatgaaattcaatgtacatcttcatcagagctcttgggtgaccaggtgcattgtcaatgagtaataatacttggacaggaatctttttttctgagctttaggtctcaacggtggcttaaaatattcagtaaaccacgctatatacagatgtgctatcttctaggctttgttgtcccatttatagagcacaggcagggtaattgagcatagttcttaatggccatagattttcagaatggtcaataagcattggcttcaactaaaagtcacttgttgcattagctcctcagaagagagtcattcagttctttgaaactttgaaggcaagcactgacttctttctagctatgaaactactcctagatggtatcttcttccaatagaaggctgttttgtctacactgaaaatctattgtttatcagtgatctttgttagatctttggataacttgctgcatcctctccatcaacacttgctgcttcaccttgcacttttatgttagggacatggtttcttttcttaaacctcatgaaccagcctctactagcttcttgcttttcttctgcagcttcctcacctctctcagccttcacaggtttgaagacaattagggccttgctctggtttagggtttggcttgagggaatattgtggctggtttgatcttctatctagaccactcaaacttttgtcacatcatcaataaggctgttttgctctcttatcatttatgtatttactgcagtcgcatttttaatttcattcaaaaactttttctttgcattcagaacttgattgactggtgcaggaggcctggcttttagcctctcttggcttttaataataccttcctcacttagtttaattatttctagcttttgatttaaagtgagagatatgaaactctttaatatatgaaactcttcctttcccttgaatgcctagaggccattgtaggattattaattggcctaatttccatattgttgtgtctcagggaatagagaggcctaaggagagggagagacacaggaatggctgttgctggagcggtcagaacacacacagcatttgttgcttatgtttgtcatcttatatgggcacggttcatagcggccccaaatgattacaattgtaatgtcaaagatcactgatcacagatcatcataactgatataataataaaaaagtttgaagtattgcaagaattaccaaaatgtgacatagggacacaaagtgagcacgtgctgttggaaaaatggtgctgacagacttactagattcacacttgctctaaatccttattttgtaaagaaaaaaaccccacaatatctgcaaagtacaataatgcagggtgcactaaaatgaagtatgtttgtataaaaaaagattgtgattaataattcagttgtaggggttggtatatcaaaagatttcgactgctattacattttgttccgattttaagagttgttactttagcttcatttcaaattataggtgctatgtaaaaatattctgttgtgtacctttaataattcctttctctgcttcttttctaggtatcacacctgtgtatcataatatgtttgctttaatgagtgaaacagaaaggatctggtatccacccaaccatgtcttccatatagatgagtcaaccaggcataatgtactctacagaataaggtactttcttcagtaaagtaactcacttaatgctaaaaggcaaaatgggagaaattatcaaatattttttaattgcaaggtacttaataccagatacctgaaccaattagttagcactcatttaagatttcatttaagattctattctgtttctccatcagagaaactgtttatacatgttgtgtaagtagaatactctgagaataaagctgttttggtgggatgccacttaactccttatgattataattaaataagtaaacaaaatcacagtggcctttattaacaaaatcctaaatgtttgggatattgctggtttgtgcagcgttttgtgcaatagaatgcaatttcacatcttatctttataaagaactttttaaaaagttgacgtgaagaaaagagacttttcccagtgtgtatttgcagcctcaaattgtaagttaatttatataatttatggtaatgtgtaatgcctatttagagaaatctagaagtatttttttgctcgaaaggatgaaacaaagatacgtttgatttgtgtctcacaaatacctgtgatttttctaagcatttatatacatatatatataattcatcataacttcatgaggtgttaagatttccacattaaagataaagaatttggagcactgagaagtaatattactcaaatttattcatggtcacacaggtaggaattgggagtcaggttcaaatccaagcctggtttgcttcataagcttgcctcttaatcacctcatgtgtacttcattaaagagataatgtatatataatatttattattgtgcctatcacttggtgctctctcaataaattttagtattgttttgcttctttctcttcccctattctatataaaaatatgcagttggatgtgtttgcatttactgatgtctaatgtataatttgcactgagttcaaaaaaatattttttatataattattgaaaagacaattggtgaaaaaaataaatgttcaaagaaataatagatgtacaaaaatcaacagcattcttatatgcaagcaaccagttatataatagataaagaagatcctatgcagtgtagctacaaaaacccttaactaaccaggaatggtcttaataagaaaaaacagaagacagtataggaaaattagaaagttatttgaagaatatgaagaattaggacataacattggaatggggagatggaatattacaaagatcaatttctcttatgctatatccttagctctaagccaatcaaaatcctaacaaaggcattttacggaatttgacacattactatgtaaattgagaattattaaataagatagccatgagaaagaagacttacctggcaattgtaaaatattttgtcccaggagatattttcacattatatgaaactacaaaatggtatctattattaaagccacataattaaattcagaatcataaactaaataatgagaatgatggggccagtatatcttgaaagtactccttcatacatatagaaacataataatatgaagaaatcttttcatattaacgtggaagggagagattagtcaacaaatggtggtagaatagttgattagctgtttgaataaaattttagcttcttactttataatgtatatcagataaattatagattgattaaagatcagattgatatgtaaatagaaatgtaaagaaaatcaaactataaaagtctgaattggaactgaattcaagtccttgggaaaataccatttaagttgcaaaacaatagaaaaaatcatatgggaatgactgcaattgtcaactataaaaattttcaaatgtctgaaggtttcctcttaaaatgaaaaggcaggagggtggagccaagatgactgaataggaacaggtccagtctacagctcccagcatgggcgatgcagaagacgggtgatttctgcatttccaactgaggtgtaccgggttcgtctcactggggagtgtaggaaagtgagtgtaggacagtgggtgcagcacactgagcatgagccgaagcagggcgaggcatcgccacacccgggaagcgcaaagggtcagggaattccctttcctagtcaaagaaaggggtgacagacggcacctggaaaatcgggtcactcccactctaatactgcgctattctaacggtattagcaaatggcacatatcccgcgcctggctcagagggtcctacgcccacggagcctcgctcattgctagcacagcagtctgagatcaaactgcaaggtggcagcgaggctgggggaggggcgcccgccattgccgagggttgagtaggtaaacaaagcagccaggaagctcaaactgggtggagcccaccacagctcaaggaggcctgccggcctctgtagactccacctctgggggcagggcatagccaaacaaaaggcagcagaatcctttgcagacttaaatgtccctgtctgacagctttgaagagtagtggttctcccagaatgcagctggagatctgagaacggacagactgcctcatcaagtgggtccctgaaccccgagtagcctaactgggaggcacccccaagtagggggagactgacacctcacatggccgggtactcctctgagacaaaacttccagaggaacagtcaggcagcaacatttgctgctcaccaatatccgctgttctgcagccactgctgctggtacccaggcaaacagggtctggagtggacctccagcaaactccaacagacctgcagcagagggtcctgactgtcagaaggaaaactaacaaacagaaatgacatccacaccaaaaccccatctgtatgtcaccatcatcaaagacaaaaggtagataaaaccacaaagatggggaaaaaacagagcagaaaaactggaaactctaaaaatgagagcacctctcctcctccaaaggaacgcagctccttaccagcaacggaacaaagccggatggagaatgactttgacaagttgagagaagaaggcttcagacgatcaaactactccaagctaaaggaggaagtttgaactcatggcaaagaagttaaaaaccttgaaaaaaaattagacaaatggctaactagaataaccaatgcagagaagtccttaaaggacctgatggagctgaaaaccaaggcacgagaactacgtgatgaatgcacaagcctcagtagccgattcaatcaataggaagaaagggtatcagagatggaagatgaaatgaatgaaatgaagtgagaagagaagtttagagaaaaaggaataaaaggaaacaaacaaagccttcaagaaatatgggactatgtgaaaagaccaaatctacgtctcattggtgtacctgatggggagaatggaaccaagttggaaaacactctgcaggatattatccaggagaacttccctaatctagcgaggcaggcaaacattcaaattcaggaaatagagagaacgccacaaagatactccttgagaagagcaactccaacacacataattgtcagattcaccaaagttgaaatgaaggaaaaaatgttaagggcagccagagagaaaggttgggtaacccacaaagggaagcccatcagactaacagcagatctcttggcagaaactctacaagccagaagagagtgggggccaatattcaacattcttaaagaaaagaattttcaacccagaatgtcatatccagccaaactaagcttcatatgtgaaggagaaataaaatcctttacagacaagcaaatgctgagagattttgtcaccaccaggcctgccctaaaagagctcctgaaggaagcactaaacatagaaaggaacaactggtaccagccactgcaaaaacacgccaaattgtaaagaccatcgaggctaggaagaaactgcatcaactaatgagcaaaataaccaggtaacgtcataaagaccggatcaaattcacccataacaatattaaccttaaacgtaaatgggctaaatgctccaattaaaagacacagactggtaaactggataaagagtcaagacccatcagtgtgctgtattcaggaaacccatctcacgtgcagagacacacataggctcaaaataaagggatggaggaacatctaccaagcaaacggaaaacaaaaaaaggcagggattgcaatcctagtctcggataaaacagactttaaaccaacaaagatcaaaagaaacaaagaaggccattacataatggtaaagggatcaactcaacaaaaagagctaactgtcctaaatatatatgcacccaatacaggagcacccagattcataaagcaagtccttagagacctacaaagagacttagacttccacacaataataatgggagactttaacaccccactgtcaacattagacagatcaacaagacagaaagttaacaaggatatccaggaattgaattcagctctggaccaagcagacctaatagacatctacagaactctccaccccaaatcaacagaatatatattttcagcaccacaccacacctattccaaaattgaccacatagttggaagtaaagcactcctcagcaagtgtaaaagaacagaaattataacaaactgtctctcagaccacagtgcaatcaaactagaactcaggattaagaaactcactcaaaaccactcaactacatggaaactgaacaacctgctcctgaatgactactgggtacataacgaaatgacggcagaaataaagatgttctttgaaaccaacgagaacaaagacacaacataccagaatctctgggacacattcaaagcagtgtgtagagggaaatttatagcactaaaggcccacaagagaaagcaggaaagatccaattgacaccctaacatcacaattaaaagaactagaaaaccaagagcaaacacattcaaaagctagcagaaggcaagaaataactgagatcagagcagaactgaaggacatagagagacaaaaaacccttcaaaaaaatcaatgaatgctggagctggtgttttgaaaagatcaacaaaattgatagactgctagcaagaataataagaaaagagagaagaatcaaatacatgcaataaaaaatgataaaggggatatcaacccgatcccacagaaatacaaactaccatcagagaatactataaacacctctacatgaataaactagaaaatctagaataaatggataaattcctggacacatacaccctcccaagactaaaccagaaagaagttgaatctctgcatagaccaataacaggctctgaaattgaggcaataattaatagtttaccaaccaaaaaaagtccaggaccagatggattcacagctgaattctaccagaggtgcaaagaggagctggtaccattccttctgaaactattccaatcaatagaataagagggaatcctccctaactcattttatgaggccagcatcatcctgataccaaagcctggcagagacacaaccaaaaaggagaattttataccaatatccttgatgaacattgatgcaaaaatcctcaacaaaatactggcaaaccgaatccagcagcacatcaaaaagcttatccaccatgatcaagtgggcttcatgcctgggatgcaaggctggttcaacatatgcaaatcaataaacgtaatccagcatataaacagaactaacggcaaaaaccatatgattatctcagaggcagaaaaggtctttggcaaaattcaacaacccttcatgctaaaaactctcaataaattaggtattgatgggacgtgtctcaaaataataagagctatctatgacataccgacagccaatatcatactgaatggacagaaactggaagcattccctttgaaaactggcacaagacagggatgccctctctcaccactcctattcaacatagtgttggaagttctggccagggcagtcaggctggagaaggaaataaaggttatttgattaggaaaagaggaagtcaaattgtccctgtttgcagatgacatgattgtatatctggaaaaccccatcgtctcagcccaaaatctccttaagctgataagcaacttcagcaaagtctcagcatacaaaatcaatgtgcaaaaatcacaagcgttcttacccaccaataacagacaaacagagagccaaatcatgagtgaactcccattcacaattgcttcaaagagaatacctaggaatccaacttacaagggatgtgaaggacctcttcaaggagaactacaaaccactgctcaatgaagtaaaagaggatacaaacaaatggaagaacattccatgctcatgggtaggaagaatcaatattgtgaaaatggccatactgcccaaagtcctttatggattcaatgccatccccatcaagctacagatgactttcttcacagaattggaaaaaactactttaaagttcatatggaaccaaaaaagagcccacattgccaagtcaatcctaagccaaaagaacaaagctggaggcatcacgctacctgacttcaaactatactacaaggctacagtaaccaaaacagcatggtactggtatcaaaacagagatatagaccaatggaaagaaataatgctacctatctacaaccatctgatctttgacaaacctgacaaaaacaagaaatggggaaaggattccctatttaataaatggtgctgggaaaactggctagccatgtgtagaaagctgaaactggatcccttccttacaccttatacaaaaattaattcaagatggattaaagacttaaatgttagacctaaaaccataaaaaccctagaagaaaacctaggcaataccattcaggacataagcatgggcaaggacttcatgtctaaaacaccaaaagcaatggcaacaaaagccagaattgacaaatgggatctcattaaaccaaagagcttctgcacagcaaaagaaactaccatcagagtgaacaggcaacctacagaatgggagaacatttttgtaatctactcatctgataaagggctaatatccagaatatacaatgaactctaacaaatttacaagaaaacaacaaccccatcaaaaagtgggcgaaggatacgaacagacacttcttgaaagaagacatttatgcagccaaaagacatgaaaaaatgctcatcaccactggccatcagagaaatgcaaatcaaaaccacaaagagataccatctcacaccagttagaatggcgatcattaaaaagtcaggaaacaacaggtgctggagaggatgtggagaaataggaacatttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcggcactattcacaataacaaagacttggaaccaagctagatgtccaacaatgatagactggattaagaaaatgtggcacatatacaccatggaatactgtgcagccatgaaaaatgatgagttcatgtcctttgtagggacatggatgaagctggaaaccatcattctcagcaaactatcgcaaggacaaaaaaccaaacactgcatgttctcactcttaggtgggaattgaacaatgagaacacatggacacaggaatggaacatcacataccggggcctgttctggggtggggggatggaggagggatagcattaggaaatatacctaatgttaaatgacgagttactgggtgcagcacaccaacatggcacatgtatacatatgtaactaacctgcatgttgtgcacatgtaccctaaaacttaaagtataatagaaaaaaatgaaaaggcaaattgtaaagatagtttcaacaaatcaaataaacataaggttagtattcttgtaagtatgaaatttaaaacagtgtatccatttaacaattacttaatgtacatgaatatatagcgtcactagttatgagaataatgaacgagattgcttgctttagcacatagttacaactattcattattcttataactagtgatgctgagaattttttgaaaaggccattaatgatttgttcttcttttgttaaatatttcttcatgtacattaaataattgtttaatggatacagtgtttttaatgccaacaaattagaggatcaagatgaaatggacaaattcctagaaagacacaagttataggaactgctaaaagaaagaacagaaagtttgaataggtctatgacaaataaagaaatcaaattagcaatttttataaaagcccaggcccaagtggcttcacttgtgaattctatcacacattaaaaaaattattactagttattcacaaaaaatagaaaaggaaggaggatttctgagctctttctgtgagttcagtattaccctgataacaaattcagacaaagatgtctagaagaaaagaaaactacagaccaatgttgtaggtagaaaatcaacaaaatacttgcaaaccgaatccagcaatacagcttgaatatgtcttatctgaaatgcttgggaccagaagtgttttggattttagatttttttttttttttttggattttagaatatttgcagagtatacgctggttgaacatacctaatataaaaatctaaagtctgaaatgctctgatgaatatttcttttgcacatcaggttagcgctctaaaggttttgaattttggagcatttcggatttcagattttcaggttaggaatgctcagtttgtttataaaaagatgaaatactatgaccaggtgggatttatcccaggaaatacaaggctagtgtaacttccaaaaatcaatcaatgtaatacaccacattaatagaataaatgaccaaaaccacatgatcatcccaagagacacagaaaaagtatttgataaaatccagcatcccatcattataaaaaaactcaacacaataggaatggcaaggaacttcctcaatttgttaaagggcatctgtaaaaaattcaaaagtaatgtcatacttattagtgaaagactgaatgccttttccctatgatcaggaatgagatgaggatagctacttttaccactttgatttaacactatactgtagattcagggtagggaaattaggcaagaaaaagaaataaaaggcatttatattggaaaataagaagtaaaattgtagtcatcccgctgtatccatgggtttcacatccatggattaaaccaactgcagattgaaaatacttggaaaaaaagttgtgcttacactgaacatgtacagactttttcttgtcattactccctaaagaatacggtataacaactatttacataacatttacattgtattaggtattataaatagtctagagattttaaagtatactgaaggatgtgcacaggttatatgcaaatactatgcctttgtatatcaggaacatgagtatttgcagattttggtatgtgtgggaggttctggaactagtactgcatagataccaaaggatgattgtgtattcacagattacatgatcttgcatattaaaaatcctaaggaattaataaaaaaactattagaactaataaatgagctcaggtcagttgcagaatagaagatcaatatataaaaatcagttgtatttctatacagagacaaagaacaatccaaaaatgaaattaaaaaaatttcattaacaatagcataacaaatttttaggaataaacttaaagaagtgtaaaatgtatacactgagaaatataaaacatcattgaaagaaattaaggaaacacctaaataaatggaaagatatctcatagaggacttcatatttttaagatggcaatactccttaattgatctgtatgttcaatgcaattcctactgaattcctaaatgtctttattgcagaaattgacaggttaatcataaatttatataaaaagcaaagggacttagcatagctaaaacaatcttgaaacaatacaaagtttgaagacttatacttcctaattacaaaatttattacaaaaggactgtaatcaagacaatgtgatactaaaggatgaatatacagattaatggaaaggaattgacagtctcaatataatttctcacattgatggtgattgatttttgatcagggtgccaagacaattcatgggcatagaatagtcttttaaactaacagtgcggggacaactggatatccacatgtaaactaatgaagtaagacaatctacttcacactatatacaaaaaaaaaaagcttaaagtggatcataggcctatatatgagagctaaacttattaaaactccaagaagaaacacagaagtctttgtgtacttagattaggcagtggtttcttagatatgacaccaaaagctcaagtgacaaaagaaaaatagttaagttaggctttatcaaagttaaaaacatctgtgtgtcaaagcacactatcaaaaatgcgaaaagaccacccacaaatgggttccacaaaatggaagcaaatgtttgggaatcatatatctgataattgtcttatctccagaatataaaagaattcttacagctcaacaagacaatgacaacttaatttaaaaagtaggcaagggacttggatagacatttttccaaataagatatacaaatggccaaaaagcatgtaaaaagatgcccaacaggtgggcccctgagcgggcgtccgggaccgtggtgtgccaggcgccttccgcccttaacatgcggtggctggcccaggcggtgcaggagctggagcggggcccgagtggggcgccagagccccagcgcgagcaggagaggggccggagcgcggatccgcgccgcgctgctgaagcctggccggccacccagacgctgccggcagcctggccatggcggagccaaggaaagaatctctatacaaacaaatatgtggctatcaaattggagctgatcaagttccggaccccgcagctgcacctgggtaccggttctacaagcagctcagcgccatagagggcgtccctcaggtctactacctactacagcctggaggacctgttcgaccttcacgcccaagacggtgctcctgatcgccatccggctgatcacgcgcatggattatgtgcacaccaagaacctcatttaccaggacgtgaagcccgagaacttcctggtggggcgcccggggaccaagcggcagcacgccatccacatcatcgacctcgggctggccaaggggtacactggtctcaggaccaagaagcacatcccgtgcagccagcacaagagcttgacaggtacggcgtgctacatgagcatcaacatgcacctgggcaaggagcagagccactgcaacaacctggaggtgctgggccacatgttcatgtacttcctgtgcagcagcctcccctggcaggggctcaaggctgacacgatcatgagcggtacagaagatcggggacacatagcgcgccacgcccatcgaagtgctctgcgagaacttcccagaggagatggctacgtacctgcactacgtgcggcgcctggactttgagaagcccgactgtgactacatgcggcgcctggactttgagaagctcgactacgactacctgcggaagctctccagctacctcttcgaccgaagcggcttcgtgttcgactctgagtacgaggggctcgggaagcccttggcgacccccatcagcagtgtccacaccgacctgccctcccagcctcagcttcgggacaaagatcagccgcacagcaaaaaccaggcgctgaactccaccaatggggagctgaacgcggacgaccccatggccggccactccagcgcccatcagggcgcctgcagagatggaggtgggcgatgaaacgaaatgctgctgtttcttccccctgaatcttctccgtgcggccccttggggagcgagcttgtgtgagggccttggggcccacccacagcggcccagggccagacgctggctggaagccaggacacagactgcagggtcttggccggcggccccatccccgggacgaggggtcacttccttcacgtaagactggccaaaatttcttttttttttttttttttttttttgagacggagtctcgctttgtcgcccaggccggactgcggactgcagtggcgcaatctcggctcactgcaagctccgcctcccgggttcccgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaagactggccaaaatttctacacctgtgtctagtcctcccctccaagagcattaactatttaaaacaaggaataaaggaaaaaaaagaaaggccccctccacccccacccctccattactttgctgaagtgagtagtgggatcctggaggcccccagggctgaggcccagccagctgcccccgttagcgtcataaagtccagcttgtctccctcatccaaaggccgttttctcagtgggagggcaggcctggcctggaggggtgctgtggggccatcttgcccaggcccacctgggagggacacaggcattgctgccaggggtgaggctgtgccccaggcctccccaaaactaaaggggaacggaggggtggggccgcggctgaagccagccccgcaaccaaaatgctgcaccaaagctcggtcgccacaggcacggccaccgcagcctttcacagcctggccccggcgaggggcaggtgggccctgctaggagggtgcttctcgaggcacctgttccccgaggctgtgctccgaccctcagaagctgaggggggtgggccggctggcgtcgcgcggctcggcccctgggccctgctgtgtggaggcgcgcgggctcgtggcttcctgtctctgtgctccgccccctggcaagcagccgcagacaaaatgccttaaagcccccgacccagccccgcaggtgtatgtgcaggggggtctgcgggcggccctggactggctggcggactcccagcgggtcagcttgaggcagtgcccagggcggtggccgtgagtctggtttttgctttaccaagtgtacggaaatggcgtttacgtttctctgatgctcttttgaagccatacaacttaggggctttaaaaaaaaaaaggaaaaatgaaaccctccgaaaaaaagatgcccaacatcattggtcattagagaaatacaaatcaaaaccacgatgggataataataggtctacaaggatggcaaaaatcagaaagacaaacaataacaagtgttagagaatttggactaatttggatgcagtatattgctgttgggaatgtaaagtggtgctgctactttggaaaacagtttggccattccttaaaagggtaaacaaagagttaccatatgactcagcaattctacttctagatatatatgcaatagaaatgaaaacatatccacaaaaacttgtacatgactcttcatactagcgttattcacaatagaaaaataatagaaacaaacccaaatgtctgtcaggcgatgaatggatacagaaaaagtggtatattcatacaatgaaatattaatttggcaataaaaggaaatgaagtaatgatacatgctctaatgtggatgaaccttgaaaacattatgctgagtgaaagaaggcagacagaaaggccacatgttctaaaattagattgtgatatttgtacaatgctatgaataaactaaaaacattgaattttacactttaagtgggtggactttatggtatgtgaattatatctcaataaaggtgttactaaaagacaatatagagtgttctttgtttctctgaaggacaagtttttaacttccatttctccaaataagcaattatttgtttttataccaaattagcattttcagattccctactgatgttactggattaagctatgtttttaactttttgttaatttctacattttttgtttcctactattgcttctacattttgtgcactgaaggaggtagtatattgattttacacttacatttcttgtactttctgcctatattagtgttatccacatatccttttgtctcacatttatatttaatactgttagctgtgttttctaagtatgggataatacctttcagtatgctgtaggtgactatatatagatagtacgtttgtatttgaactatttggaagctgaccaaatgtttttattatcttgtagattttactttcctcgttggtattgcagtggcagcaacagagcctatcggcatggaatatctcgaggtgctgaagctcctcttcttgatgactttgtcatgtcttacctctttgctcaggtatgattatattatcttacttgtacatgagttaaatgataaatatcttgctgtttaataagtcacttaatcaggaaaaactttacatatgggaaaattgcagttctgtcttgcacagcaggtgcagagaagtaacaaaattgagtcttttagcactagtttttaatcccatggtttatggataatagaatctattttataaagtttttttggactgatccttttgaatttctttcttttttaggactttagatcattttaaggatttcgcaaagtatagactgaggtttacaacatgattcatgtagacatacgtggctaaaatattagtaacatttctttatggtttttaaaaaaatttttggacaatttcaggcttacacaatggacaatgaactgtagagaaagtaggttacataaaaaaatgagctctgatagtttgtttagctgtttataggaaggtgactggatgttgatacttagtctaagagctatattcaagttatttgttcactaatacagttatgtcaaatttttgtattgtgttggtatttcataatgctttcttctctattaccttgatttaaacagtaattgaaatattttgtcattaaataacttgtttttatgtgctgctagactagtaggaatagaaattaaaggaagaaaatatattagtgctcttgggtaaaaataggcacttggtatccccaaggtatcaggagttctaaatcagatttgctaatattgtaggaaacaagcccacagatcctcatggctcgcatttctgagaggaagcctagtaagcctagttcagtttatgaacaacaaaaggaaaaacatttctctattggggtatgagaccaacaaactttatttttattgtggtaagagatatataataaaaatgaccattttaaccattttaagtgtacagttcagttgtattaagtacaaatacattgctgtacaaccatcaccaccatccatctccagaacatttttcatcttcccaaatggaaacttcatacccattaaataataactctgtatttcccactcccaatggccttttgcaatcaccattctactttctgaatataaatctgccttttctatgtacctcatacaaatggagttatatagcatttgtccttttttgactggcttatttcacttagcataatgtctgtcaggttcatccatgttgtagcatgtgccagaatttctttcctttttaaggctgaataatattccattgcatatgtatactgcattttatttgttcattcatctgttgatggatacttgggttgctgctgtgaacatgggtaaacaaatatttccttgagtccctgttttcagttcttttcaatatatacccagaaatggaatcgctggatcatatggtaaatttataattttttttgaggaactgctacattgttttctgtagtggctgcactatttttcagtcctaccagcagtgcacaagtgttccaatttctcaacatcctcaacaatgctttgctttgtttgataatagccatctctatgggtttgaggtggtatcattgtgattttgatgcatacttctctaacaaccagtgatcatgagcatcttttcatatgcttgttggccatctgtttatcttctttgcagagatgttgcttgttggctatttgtttatcttctttgcagagatgtctactgaagtcctttgcccatttttaaatcaggttgtttgtttgttgttatattatagaaattattattctggatcttaactccttataagatacatgatttgtagatagtttttcccattctctaggttgccttttcattctgttgcttgtcttttgatggacaaaagttttaaatttggctgtattctaatttatctattttttgtttcctatgtttttggtgtcatatccaagaaatcattgccaaatccaatgttatgaacctttctttctgttttcttgtaagagttttatcattttagctcttacatttaggcattgggtccattttgagttaatttttgtctatcgtgaaggtaagggcccaacttcttttgcttgtgaatatccagttttcctagcaccatttgttgaaagactgtcttttctccattgaatggtcttggcacctttgttgaaaatcatttgaccaccaacctacttttttatacagctcctttatctgtatagccattatgaaaagagaggggaatggagagaggcttctaagaatagccttttgaaaacaggatattatgaggttacaactttctgttgcttttacgggtatattatttcacctgtgctgcagagctagtatattttgggggtaggctagttaagtcccatttataagccaagttttcccaaactattcattcagctactttagcctaatattaatactgcaatgtctagtatttttgatctagaaaaattttgggtgatttcagaatactcaattttatccttctaggaaggattgtcttatctagcatggcaaggtaattccaccatataattctaaattatgtctagatagtaccacaagcaattttctattttttaatgtttttacttctctaaatttgtgcccagaaaatatgatagtatttagattactctaagattgtactgttatcattttatattatatgcatgttgtagactatatatagcaaatgtgaccagtggcattaccagagtgtaagaatatcttgacatctttaaataaccaaaaaatagataagccactgaactgtctttaaagttcttaagacagtacctgtaggaagacagatttggaaaaggtaagcaaataaaaatcaaaagtaagatggcccttttaaattcagtttcctctgggaattaattgcctttatatcatcaaatatggctgctaagcaaataaactgctgacatgtgaacaacttttaattaattcatatctattcaacaacaattggatgtttacctcatgttcttggcatcatttctgattttgtgactgtgactgttttttatttccctggctaatgaagatgtaaatttcttaagttcaaattttgtcagctactcaaatgagaaaaggttttctttcttattttatttttttatagagattgaactcctgggctccagtgattgtcttgcttcagcctgtcagcctcctgagtagctaggtacaggtgtgtgccactatgcctggctaatttttttagttttggttttgtggagatggggtctcgctctattgtccaggctggtttcaaacacctggcttcaaatgatcctcctacctcagcctcccaaagtgctgggagtacgagtgtgagccaccacacctggcctgaaatttttcagtagttctaattaaatgaaatttctgagggtacatactataatatttaaggaatagtatttattatgttttggcatttgagactcttccatttgtaacttttctctagtgaatagtttattatgtttttagtattgccatcactcatttttcatatatttattgtcttctgatcatgacttccatagaatttccacatgagcagaatttgttatctaccagttcttttcttttctttctttttttttgagatggagtctcccactgttgcctgggctggagtgcaatggcgtgatctcggctcactgcaacctctgcctcccaggttcaagtgattctcctgactcagcctccctagtagctgggattacaggtgcctgccactacgcccggctaattttttgtatttttagtagagatggggtttcactatgttggccaggctggtctcgaactcctgaccttgtcatctgcctgccttggccttctaaagtgctgggattacaggtgtgagccactgcacccagcccatctactagttctatagggaaccaaggcaggctattaaaaagaatctaccaagtcattgatcatcttctacttaaacagtataacttacttgcctgttctcaaaagtgtggtgaaataagtgtttaaaattgagcaaaaatctgtctcctaccctgaattaattttgtattagcaacgtttaggcctttgttttgggtgatactgattatttgatggtgtggttcttaatagtttattttcttatatgaaaatatcttctatattttattaatagaaaagcaaatatacttttaaatatgtttcttttaataaaattagtttaaaaaggttccagtaaagctttaatttcatgagacaagttattacatcaagagaagagaaatacagatgtagagtatagagggcccttgtccggtttaaaaccttgattcgcattgttattttaggtaatatggctcttacctttttttctacaaagaaaattggtattatgtttagaatatttgtacttctgctttctttttctttctcccattacatgttcagtcagatttatctgtattcctaaatcctccaggtcaaaatcgtagaacctctgtgtttctctcttcttcattctttagacaatatatagttaataaagttatcagccttttttcagaatcttttagtatcttctgtttcctggatcagatccttattatttcgtatctgagccatacaccagcctcttaaagagcctccgtaaatacactttattttcttcaagcacttctatcattgctactactctgccaatggaagagacatgatgaaaacagatctccatagtttctaggatcaggtcattcaagggtacctgcagtcggaccccaacttacttttctaagttttaatccacattatttcttcacataaacttcaggccctaatcaaattagtttatgcatctgaacatatctggtgcttttgtgtgtgtgtcattccttctatttctttaccctgttttgtgtccatcatacatttctttatttttaaacacactgtgaagtttcaaatcttccatgaaaccctccttgattactccagctgaatataatcttaactttctccaagttcctgaaggagcttttgtgtggtgcttcctatatcatgtctggtgttataattatttgcttctgtttcgcttctaagctaaattttggtccccttgatgactgagaccacatcttatacagtcatgtgtcacttacttatggggatatattctgagaaatatgtcgttaggcaattttattgttctgtgaatatcatgtattgtacttatacaaacctatatgttatagcctagtatatgcctagtctgtatggtatagcctattattgctctaggctacaaacttatatagcatgttgctgtactgaatattgtaggcacttgtaacacaacggtaagtatttgtgtagttaaacatatctaaacataaaaaagatacagtaaaaatgcagtattacaatcttatggaaccatcgttatatatgtggtctgccattgaccaaaacattgttatggggcacatggctatttctttgtatccaacaccacttgtagtatgatacttccaacataattggagttcagtatatatttaactcagtaatatctactttaatttaggtaatttttatgtagaagatataatttgaagatatatttaatgaaataggttgatgttatatgtactctgtaattgggaacccagtgtaaatcagtttccatttgcaaatgaacttttattaaaattgtatcgcaaaatgaatgaaaattaaaggaggaatttatgccatttatttatttattaatcattttagagactgggtcttggtctgttacccagactagggtgcagtggtgtgatcatagctgaagagatcctcctacctcagccccccaagtagctgggactgcaggtatgtgccaccatgcctggataatttttaaattttttgtggagatgagatcttgccatgttgcccaggctggtctcaaactcctgggctcaagtgatcttcatgccttggcctcccaaagttctgggattacaggcatgagccactgagcctggccaatttgtatcttgtaaatgcatatgttctgaaaattatgattaaaatataatcatagattaaaacatgataatgaaacttacgatgagatatttccttcaaatttttggttttagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcaggtaattttcttttgcaaatccttacacataagtgtgagtagagattttatataattcgtatatattttctgtgtttacccatgccttttgattttgtaatactagttaagtactccttatctaaaatgcttggaatcagaaatgcttcagattttggatatttccagattttggaatattggcattgaacttaccagttgagcacccctaatccaaaatgctctaatgagcatttcctttgaacatcatgttgacgttcaaaaagttctggattttggaacatttcgtatttcagatatttgcaagagggatagtcaacctataataaaaaatcatatgggtaagttttatatcttgggagtaaaacacactttgtaaggtgaaattatttaaagagttgtactacaggaaatatcataggtattaaatatctattatttgatttcatttattctgagaaggctagggaagttcagaggaacagaagaaacacctggaggcatactttttgatagaagatcctccagttggctatataaatgacctgaataagtatttcccaaatggtggtgtatattttatttgcattagactcacgtgggggagcctgttaaaatcaaagatttctgggtcctaatccaagagatttggattcagtaaatctgagttgaagcccacaaatatgaatttttacagatgctctagggtattcttatacaaatggtccaaactctgcattcttcaaattattcttctgcatattgaacttgacaatcatggctaatataaaactgctttttaaaaaggtatatataagaatggtttaagtttgaaggcaaatatgtattttatatattacatacttcccagattaaaaatttgagtacatcatgagtgtggttaaagcttccttttttgaaattgttctcccaataactggcttcagtcatttctttgccatgtcatcaaaacagttacatacccaatttgcagagtatcaatttctgtatttctctctttggttttaaatattcttgttttactttcagatgtctgttaggtcttaacctaagggtgtaggccatagggtataattttaggaactcagaaatctagaagattccaaagcccaaaggaaaaaaaaaacacattcattcattcaacagctacttattgaatacttgctgtatgccaggctatagtagaacatagttggaggaagagtatcttagatgtcgttacatagaaactgaaggaattcaggggaacacagttgaagaacagaagctttgacccattgaagatgaatgttataaatatgaagccatctctagacttaagctatcgtggaatatttctgctttggaaaccatgctgtcatccaaagtcttggcacaatctttctatgtagattgtagtttcttccagtttgagaatcatgtcatctattgctcttatccctacattatttagtctagtgtcctaaacctaatgactatttagtaactatttatctgattcttttaactcatgctcttagccaggatataaacacagatgcaaaatgctgcatcatttttttttactgctttactttaaaaatagtgtagatattaaacattcatataagattccatgatattttaaaagagtttattgagataatttacaaatcataaatctcacccatttaaaatatacaatttaatattttgtattatattcacagggttgtataaagatgaccagaatctaattttagaacatttgcatcctttctgaaagaaaccccatgcccattagcattcagtcctcatcccactttcccccagcctctggaaaccacttatctttttgtttgcgtggattttcctgtctcaaacatttcatataaatagaatcatgcaaaatgtggtgtggcattttttttgtctggcttctttcacttaatatgatgtttccaaggttcattcatgttgtagaatgtatcagtacttcatttctttttattgctgaatcatttcattatatagatataccacattttgcttatttgttcttcacttgatgaaaatgtgggctgcttccatgttttggctattgtgactaatgtggctatgaacagttgtatatgagtaattttgtggatgtatttttttcattttttcttgtgcatatatttaggagtggaattcctggaacatatggtaactgtttaactttttgaggaactgcttaacttttcaaaagcagctgtgccacattacattcacactagcagtacatgaagagttccaactctttccgcacttgtttctgtctgtattttatccatcctagtgggtggaagtgctgtctcattctagttttgatgttcatttctctaatgactactgatgtttggcatcttttcatgtactttttggccatttgtatgccttctgtagagaagtgtctatttgaattcattgctcattttttaattgggttatttgtcttttaattattgagtttagaaaattctttttatattctggatacaagtctccacatataatcatatttatgatttgccattatttcctcccattctgtgtattgttattttactttcctgaaggtatcatttgtagcacaaaagttttaattttgaagtagtctaatttgccccatttttctttgtgtcttgtgccatgtggaaatgtggttttagcaacatggatgtctttcttggttttagcaagagcagtttctcttgaaataatggaacagaagccaaactggaatgagttgagggataaatggaaggcaagaaaatggaaatggctatgtacatgctttcaaaaagaggccagataggctgtggccagaaggaaatgtgggattaagagattttacattttatacgggacggacattaatttagcaagtcctttgtgcctgtggattctacatctaatatgccacagaatgaggtccagaaaggcttcctggattagatggtacttgagccttgtcgaatgagtaactagataggagatggatgattggaagaaagattagcatatattacggcatggaaaattatttaatggtacttcagaaataaaatgttccttagaagcacagaaataaattaccttctttagaatattgtacatagagatgaatgtacagaaaagtcagaatatttctaaatggaattgttttgatcacaaaggaattattaggagttgaagctggcctaacaaaataatatacagaagtatgtttgcataatgaaaatggcttccaacaaaatgtaacaatttccaaaattcaggtaaatgttggagcacagcatcataggaaatatttgtagcacagttcaatatatgccaaaatattatcttataaaccattaactctggtatgtgaaatagagaaaaggaatttttagagattcttattaactagactgaggattcatttcattaggggaagaagattaacatcttcttttgtaaacattgatgataacttagagtgtgtggatatatttatatcatcaaacaaaatcttaaagttttatactgtatggatgggggttatgtcaacttacgccacttggccactgtgttgtaaggcctacttaatcatggaaaaaggtggtaacttctttttcaatttttagatttatcttccaatttttgttttgttttgtttttctgtatgtgcttttttatccctagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggtaatccttaatgatatgttcttgttctttgttattttaagtacaatggaaataaaaacaaagtaattttaatcatttgcaacatggtattgcacttctcccatttgatagaagtggaagtttttaatagcgtgaacctatcaaggtcatataattctttgcctactattcttaaatggttttttcatttaattttttatgacaaaataattaccaatgactatattatagtttcagaaagatgtcaaattctaaaagtgattttaaaggagttttgcctttcactactagtgataacagaaggcataattataaaacttgttaactagaaaagattgatattaattgattttatgataatatatacctgctaaataatgaatttattttaggtttgcattgcaagttttgaatttgttaatatccgtgttgttcatagattgttactagagatttagagggatcattttttaatttttcatctttggtagtcacatttccagttttctggcagtggtttctactaatgttaattgaattgaagagtgccatagcacattttagattcctggcatcatttaatgccctcatttttaagtcaagcaagatacagcatagtcttagggttagattgatagagtaaatcacgtttaatgcttatctattgttatcaataccttttttattttaaagaatttggaaagaatgttgtcttcttaagtcttgttttaaaatggctctgtaaattctacccgtttttaattttacatgcttttaattataggatttacagttatattgcgattttcctaatattattgatgtcagtattaagcaagcaaaccaagagggttcaaatgaaagccgagttgtaactatccataagcaagatggtaaaaatctggtaagtttgctttatgattgaataatggtttcattttatagttctcagaaatgtgtattttagaatcttagtaccaaaattattttctggtaggaattttgattgtagttttaaatataactctaaacatcagttcagtaaactttttgataacatctagctttttgtattactatcaacaccatcttcctacagagtttcttgtacattactgtactttttttactcatttttatgattagcaaagcaccagttactttctcccccatccctactctagattatactagttctctgatgtaatgctcacccctgactaaaatattttatcaacagggatgtatatgtgccagttatactgcctaattaaaggagaaaaaataaatcaatgatgtctggaatttatataacaaaatgtaaatcaatcccaggtcagccccacccaagctgtaggacatggttgattctaaaagattaacgctttctctttttttaaatagcttcagaaatctaatttattttaatgtaaataggagaaatgaattattttatactttgctcttaagtttctcatttatcttctctgtcttctttttaactcagatgcttcttgacccttcctggcttaaactagtcctattaatgttatttgtctatttatcttaagtatttatatggcttacctgtctggctgttccagggttatattaccaaaattgtaactaacttgcaactcacttaattcagcatagttttctgttcttagataaaaatatgatagtacacctactgcctagtagactgtgagccttttgaaggtaaggatcatatttttatgtgtgtttgtaccccctacaccttgcacagtactcagggcctagtttagaaaaagcttgataaatattttatggatgcataaaaggatgattaacaattatcaacctcaatgtggatatataataaatgtttctgggagagtttattgatcttaatgtgaacaaactgtagtaacccaaagaacttctccatgggactgtatttggacttggcttaattttaagtctgcaatacagagaagttaagtaactttccaagggcacagtgttagttaagtggtagggctatttaaactcaaatgcatgctttgaaaacctaagctcttaagtgtgacactaacttctttgctaagtatccgtaaagctccttaaaaatattatactgacattttgttggaattgtgcaacaaactgggaagagttgacatttctttctcatattaaattttttattttagggatacattgtatttctccttgtatacaagtattattttatgtttttcagtaattcttgatcattttattcatattgatacatcatgtttcttgctgaattttattcatgatatgttatgctttttctgttgtttattaaaattaatacttcttctctgtgtattttcctaccaaattatttatggatataggaaagtaatttttgcttattattgcattttcccagtgtattatgtgttagtaacattttgtttttactgtcattttcctcttcattctggcatttatttctctttataattttggtaaaatatatataaaataaaatttagcatcttaaccatttttaagtgtacagtttagtagtgttaagtatattcacttttgcatccaatttccagaactcttttatcttgcaaaattgaagtctacacccattaaataaaaactcaccatttccccctcttcccaatccttgcaaccagcattctactttctttttttttttttttttttttgagatgagtcttgccctgtcatccaggctggagcacaatggcgcgatcttggctcactgtaacctgtgcctcctgggttcaagcaattttcctgcctcagcctcccgatagctgggattacaggtgcacgccaccatgcttggctaattttttgtatctttagtagagacggggtttcaccatgttggccaggttggtcttgaagtcctgacctcatgatccgcctgcctcatcctcccaaagtgctgggattacaggtgtgagccactgtgcccagcccctctactttcttattctatgaatttgactactctagatacctcataaaagcaggctgaaacaatactgtctttttgtgacaggcttatttcagttagtataatatactcaaggttcatttgtattacagcatgtatcaatttccttcatttttaatatatgtatgtattctgtgtcatgtatataccacatttgttcattcatccatcaatgaatattcaggtcacttttttactttttgacaattgtgagtaatgctgctgtgaacatgggtgtacaaatatctcttgaaaactctgctttcaattcctttggatatataccttctattagtccgttctcacactgctataaagatactacctgggactggataatttatttaaaaagagggtttaattgactcgcagttcggcatggctggcccaggaaacttaaaatcatggcagaaggtgaagggcaaggaagccatgtcttacatggcagcagaagagagacagtgtccaggggaaagtgccacttttaaaccatcagatctcatgagaactccctcactatcatgagaacagcatgggggaaacaacccccatgattcagtcacctcccaccatgtccctccctcgacacatggggattacaattaaagatgagagttgggtggggacgcagagccaaaccatgtcatacctagaagtagaattgctggatcatatggtaattctacttgtaattttttagggagccaccatgctgttttccatagcagcggcaccattttacattcctaccaggagtacattctccacatgctcatcaaaacttgttattttctgttttctgatagtagccatctgatgggtgtgaagtagtatctcattgtgattttgattcacatttccctaatgattagtgttgctgagcgtcttttcatatatgtattgccatttgtatatcttctttgaagaaatatatattcaagtcctttgctcattttttaatcaggttttttttgctgaattatagaaattatttatgtattctggatattaatcccttttcaaatatatgatttgcaaatattttctcccattccatagattgcttttcactatgttgcttgtgtcctttgatgcgcagatgttttaaagttttagctagttcaacttttgttgcctatttttctttttactttgttgagatataacatgaacccagtaaagcacactaatcttacgtgtatagctcaatgaatttttacatatttgtacatctttgtagccacacccacctcaaaaaacagaatagttctcttactcctagaaggtttccacatgcatcttcccacatattcacctccacccctaacttaagatacctatcatctaccatcacttagttttatctattaataaaggttgtataaatggaatgatactgtatgtattcttttaaaatctagattcttttagttagtataatgtttggagattcatttatgttgttacatgtgtcagttcattcctttttattgctgggtagtattgaattgtttgactgtacctcaaattttaaatgtattctgttgatggacatttgggttgctttcactttggggattttagggataaatttaccatgaacattcttatacatattttttggtggacttatgcactctttttttgtatatatatatcctagagataggattattgagtcatagtgatagctttagtatactgccaaacaattttttgtagttctatcagttcactcttctttcagtaatgcatgaaaattacagttgtctcatatccccatcaactcttaattttgtcagtctaaaaatgtcttagtttgtctggtggatgtgtactggtagctattgtagtttttattttcattgccctggtgagtaatgatgttcaatactttttcacttacttattgttcatctgaatatccttcttatgaagtgcctgtgacagtcttttgcacatttttcattgacttgtccctttctgatcaatctgtagagtctctatagattctaagtcttttgtaggatgtttgtaaaacgtatatagacatacgtcagagatatttctagttcagttctggaccactgcaataaagcaaattttgcaatgaagtgagtcacataaattttttggtttctcagtacatataaaagttatgtttacactataatcaagtctactaagtgtgcaacagcattatgtcttaaaaattaatttaaaacactttattgctaaaaaatcctaatgataatctgagcctccagagagttataatctttctgcttatgagggtattattttgatgttgatggctgctgaccgatcagtgtggtggctgcttaaggttgggttggccaaagcaatttcttaagataacaatgacatttactgcatcagtagactcttcatttcgttaaagttgtctctgtagcatgtgacattgtttggtaacattttacccacagtagaatttctttagaaatgagtcagtcctctcaaaccctgccactgctttatgtactaaactttattctaaatcctttgctgtcttttcaacaacattcacagcatcttcacccaggactagattccatctcaagaaaccatttttttatgcataagaagcaacttatctgtccaaattttatcatgagattgtagcaattcagtcacatcttcagctctacttctaattctagttctcttgctatttctaccacatcctagtgacttcctccattgaagtcgtgaacccctcaaagtcatccatgagggttggaatcaacttcttccaaattcctgataatgttaacactttgaccttcttccatgaatcactgatgttcttcctggcatcaagaatggtgaatcctttccataagtttttctatttacccagctccatcagatgaatcactatctatggcagcttagccttacaaaatgtatttcttagataataagacttgaaagttgaaattactccttgacccatgggctacagaatggatgttgtgtcaccaggtctgaaaataacatgaatatccttgtacatctctgtcagagcgcttgggtgaccaggtgcgttgtcaatgagagtaatactttgaaagcaatctttttttctgagcagatcttaacaatgggcttaaaatagtcagtaaaccatgctataaacaatagatgtgctgtcatccaagccttgttgttccatttatagagcacaggcagagtagacttagcataattcgcagagccctgggatttttggaatggtaaatgagcgctggtttgaatttcaagtcaccaatggcataggcccttagcaagagggtcagcctatcctttgaagtttgaaggcaagcactgacttctcctctctagctgtggaagtcctagatggcatattcttccaacagaaggctgttttgtttacatttgaaaatctgtttgttagtgtcaccatcttcatcaatggtccttactagatcttctggataacttgctgtagcttccacatcagcatttgctgcttcaccttgcacttatgctgtgcacatggcttcttttcttaaacctcatgaaccaacctctgctagcttccaacttttcttctgcagcttcctcacctctctcagccttcatagaatttaagagcattagggtcttgctctagattaggctttggcttaagggaatgttatggctggtttgatcttctatctagaactttctctgtatcatcaataaggctgttcactttcttataatttatgtgctcacaggagtagcactttcagtttccctcaaggacttttcctttggattcataacttgcctttttagtgcaagaggcctagctttcagcgtgtgttggctttcagcatgccttcctcactaagcttaatcatttctagcttttgatttaaagtgagagatgggtgaatcttcctttcacttgaatactcagtggtcattgtaggattattaattggcctaatttcattattgttgtgtctgagggaatagggaggcctgaggagagggaaaaagaaagggaaatagctattcggtggagcagtcagaacatatacaaatttatcacttaagttcaccatcttatataggcccagtgtgtggtgccccaaaacaattacagttgacccttggacatcacaggtttgaattgtgtgggtccacttatatgcaattttttttcagccaaacatggatggaaaatatagtattcacaggatgcaaaacctgcatatgtgtagggctgacattttgcatatatgggttctgcagggctgatttcagaacttgaatatgttcagattttggtatatgcaggggtcctgtaactaatcccccttgtattctgagggacaactgtacaatagttacatcaaaggtcattgatcacaaatcaccgtaacaggtataatagtaataaagtttaaattttgtgaaaattaccaaaacatgacacataggaagtaagcatatgctattggaaaaattgcactgatagacttgtacttgctccacttaagtttgtcagaaaccttccatttgtaaaaaaaaaaaaaaaaaaaaaaaaaaaaaaagggtcatatctgcaaggagcaataaagggaagtgcagtaaaacaaaatgtgtctgtatatcaataagagggatactagttagtgaactgctagttcaaagggtatgaatatttacaactttgatagattattaaaatacttctcaaaaggtgtttccaatgtatctgtacacctgttttcttgtatcctttgccaacactggatgttatcaatcttttaatttttctgccaaatcaatgggcaaaataatgctgtcctgttatatttcatttccttaattagaacctgagattgagcaatacctcatgtgtttataggtcagctttaatatttatacttctgtggattgccttttcatgtcctttgactagttttctttttttatttttaattgttttatacgttttattcccacaatgtatgttaggtatattcctttgttatacatgtttgtaatctccaagtcttttaattttgtttaggataccttttatagtacttgtttttttggctatttgtgttagctaaataccttttatagttcaaacatgtcacatgcttgtctctttattataatttttggttgaggactctattctgtgttctctttatgattatgtaaatattgttcattgctgggccaagaaatatgctgtaatcacattttcgttcttatataactttttccaggagttaattattgctttatgatttttcctttgtatctagctttattttcattttctacaagaactctgtaaagtagtggacttctcaatacaaaatttcacataatcaaacctgtcatatatgatagcatttttacttcttttctggagaagtacctcttcgatcacagcatcttactttgtagtgtggactggaagttttctgggtacagctattattttgtcagctgtaatttttggtcattcctttcttatcctggtaactatgttttcatctctcttatattggatctgattttctaaatctcatgtttgccctgtttttctaggtacagcctctggtatttgttggtatctttaatgtgattgagacaaattagaaaattaatttagagaggatttttacatttttatgatattgaattttcctaccatggttaatcttctatatatttaaataaaaagttgcataagagtgttttgaagtttttgttaattattgatattgcatcctctttgttacaaatggggcttttttcattatataactgactttttgtatgtaaaaatataatacgtctatatattttcccatgtaagtaacatgctgcatttttggctgactacatgttcacatatgtattaagatacaatcaggccgggcatggtgactcacgcgtgtaatcccagcactttgggaggccaaggcgggcggatcattaggtcaggaatttgagaccagcctggccaacatgttgaaactctgtctctactaaaaatacaaaaattagccgggcgtcttggcgtgtgcctgtaatcccagctttttgggagactgagacaggagaatcgcttgaacccaggaggcagaagttgcagtgagccaagatcgcgccattgcactccagcctgggcgacagagcaagactctgactgggcgggggccacaaaaaaatcatagcatagctacatatcctaacattttagtttgtagcatgaatactttagcagtatgtaattggtatgtagggctgatgccgtggctcacgcctgtaaccccaacactttgggagactgaggtgggtggatcacttgaggtcaggagttggagaccagcctggccaacatggcgagaacctgtctttactaaaaatacaaaaattagctgggcatggcggcatatgcctgtaatcccagctactcatgagggtgaggtgggtggatcgcttgagcctgggaggtggaggttgcagtgagccaagattgtgccagtgcacttcagcctgggcgatggagcaagactctcaaaaaaaaaaaaaaagaaaaaaggaaatgctcatgatttctaatgtcaacttttatatcatattaaatagatttctagctgagataactggtatattagtctaagaaggacattggaaaataaagtaaaatgatggctatagagtgaactataactgggaaggtatgataatctgtatttaggaggatcttaaatatcagacatgagaatttgtaattcatattgagtactgagccataaaagatatgagcaatttagaagaaaattgtatttaacatggaatgaagaaaattttcaatatttaacatggagttgactttctaaaaggtgctatttctttttcttttctctgcttaggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgtgagtaatacagacttaaaagtaaatttttagaaaagtaaatgctgtatttacaaagaagatttaacagagtgatacatgtatgtttagaaaaaaataatttgacaagttttttttaaacaaaaggctatttgcaatcagattacataataattagaattatttagtgtataatttaccatctgtatcccaatctataatatttataagttgtacaagtttaacatttgttaatcatgcctatgtgtgattcactcctgcatgttactaaaaaagaaagatctccaatttatgttttattaattttaaaatactgcaaggaagccacagtgcaaaatttgaaaattctttatgtttggatagtccatctccttctactgaaaggttcaaacacaagatatatatgatgtccacatttctagactagtgctatgtagaacttcctgcagcgatgaaaatattctatatctgtgctgtgtaacacagcagccactagctacatgtggctgtttagcatttgagatgtggctaatgcaaccgaggaactgaattttaatttaattttaatttctttacatttaaatagctacatgtggctagtaactatcacattggctcacacagttgtagatccttactttaatactgggtaaagctagctatcatgcataacatctatttagcttaagtcctaatgatctcttagctaggatgtggtttatgttgacaacagatttgaataactcgagcaaagggaaaatctgggatcatgagcatattatgttctttgcatttaacctacccctaaatatttgagaaaatacatcttgggtaatataaagagttgatttagtctatgcttaatatttatttagtaatgaatattgttgctatgaaaaagttgtactacttgaactttatgtctgtaatttacatgtttaatatttttaaaactccttgcctttattcatgtatccataaattcattcaaacattcttttatttatatttactgagtaactactatgtgcaagcattggtttgtatattagaaatatggtgataagtgaaacagaatgattctttcttttgtatagattatattttgcttttctttcagggtgtgcagcttcagaaaacataaaaaattttaaaaaccagtagtctttgtcagttgccatggttcttctcttagactttgttatcgtactgaataataaaatcatgcattcagatttttatgtcagtaactgctatggtagtagagatataagtattttctgatatataatctttatagttaaatgaaggtttctgagagtatggttttaaaaatattaactttgtaatcagcaggcagaaaaatcaaatgaacaaattgttctttgtgattttgtcttataaataccttttattggtttttaaagctatataattgtcccttgaagtggtttgaacttactgcaaaatagcttggtactttgattttttcctttgaaagattattgctaaacatataaagtagaggagacaattctgacagttttagatttgacttttgattgttttagatgacacttggtcataatattatggtgcttgatatattattcaaattgcttcttctttacctttaggatggattttgccattagtaaactgaagaaagcaggtaatcagactggactgtatgtacttcgatgcagtcctaaggactttaataaatattttttgacttttgctgtcgaggttagtatgtcacacttattagtggtaacactttatttagttcatttaatttcctctccatatttatttaccatatttcctttttaatactgagaattatagctttggatatgataactagtataatgcttaatttcctcagagattctgtacaaataaacaagttataattcccagggtttatataaaaatataaaataatttataatgtctatctttttattttgcatttattttattttctgatgttttggtgttaccagtgtgttaaaaggtatttcatcaagtgtcttgatgtttctttgtttgcaaaactggaaatctttgccacatcatgtagaacaaaataaatcggaagcaaattttctgtttattaacagtggttgcagaattagaggaaacagaattagagaaaactaggtcaataacaaacaaatagaaacattaaagcacttttaactgatgattttctaatatttttaagaatagtggtctacaatgcatgtttcaacggtaaaactgcaatgaaaccccactgttaatacagatcattttggatctcatctatgattatatactatcacttatgaggcaatttcatggtataaatcctaagaaactatagaagcttgcaaatttatcttgcttttttaaaacagagaaaaataagaactttgttattcaattattttaatttttataaaatgcaacttatatttggcatatgtagagggtagattacttacagaagggaggttatgccatcactttacctttgtgtaaaactggtaatctatcctaatttcaaagtatcctgttactataacagataatagtacattatattcaagtatgaattcaaaaaaatatatatatatattttatgttcactgtatgtgccaagcctaatatgagagctatgtattatagagtttatgctacagccctaccttcaggaaacttatctactggacaaacaaaaattttcaaatatacaaaaaattctaaatcgaacattgtaattatctagcataggcaaatatagacagtaacagacaggtttacaattattaagaaagggcagccaggtgtggtggctcacacctgtaataccagcactttaggaggccaaggcgggtggatcacgaggtcaagagattgagaccatcctggccaatgtggtgaaatggtgaaaccctgtctctaccaaaattacaaaaattagctgggcatggtggtgcgcacctgtagtcccagctactcgggaggctgaggtaggagaagcgcttgaacccgggaggtggaggttgcagtgagtcaagattgtgccactgcactccagcctggcgacagagcgagacacggtctcaaaaaaaaacaacaacaaaaaaaaaaaaaaacaagaaaggttatttggcataggaagaacctgattgaccttgaggtattggtagattttatataaatgtttctgagtagaatgaatatgtttataaaatgcaccttaaaaataggtgaacaagttcataatatagtgcataagacaaatatttaaaaactgcaaaatattaaaaatgtaatattaaagataattatacaaatacaatggtggtgcagtggaatggctgtatgttcacctttgcttgtgcaaagaggtgagcattagagaggacctcttagaaacagtggtacttgaactgagttttgatgaatgaataaaggttcattgctcagaagaagtgggtatacattcttaggtagaaagatagcatgaagaattatcaaggcatgaagcagcatggcatttgcttgaaatgatttaagtcatttaatatggctggaacgtaggttgtatgttggcagtggcaggagctgagattggagatggaggcagaaaccagctcatggaaggctctatatgctacatttgttttaggctttatcttataaatgatggaaaactattaaggatggtattgttgctattaattatcattgccttcttacatgctttttcataaaatcaacttttaaaccacttttgtaggctgagaaattgtaaattgcccttttgaggaactaagtacttctatcactatactggcactacatcggattcatggttcaaatgtttattctgttgcttgttcttgtgatatcattttgtcagaataatcactgtgatgtccattgtgactatccctccctttctttataattaaacttatacagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaaggtaagataattttctagttatttttaaattactggtcatggattgtttatgtggcgtgaagtatcttcagtacattgatttcaaaggatatatgaaagaagcagctctaaaagttaattttatcttattctattgtacaagcatcatcaaataagattgtttactttggttttggtggtctagaagtgacttgaagttcaattattctaaaatgagattttaaacataatgtgtggtatgatgtcatttattgaactggaagatctcactactaaattcttatgttgttttaagtaaaaattttcatatacttcgaggattttaatttctgtattttaaaaataaagacagtaaagttggaaattccttgaaataatgagccttactattaaaaattattaaaattcctgaaaaattgtatgagttaaggaagttactataattttgaattaatgaaataactggcaggaatacatcaaaatccaaattacattagttaaggaagtgattataattttgaatgtatgaagtaactaagaagaaatatcaaagttcaatgagttgacccctaaaataattttctattataaaaaaagaacaattaggagttattaagcatttcttatacgtagaacacatttcattttactcctctttggagcaattcatactttcagtgtattttgaagtgatatatatgtattttattttttcagataaatcaaaccttctagtcttcagaacgaatggtgtttctgatgtaccaacctcaccaacattacagaggcctactcatatgaaccaaatggtgtttcacaaaatcagaaatgaagatttgatatttgtaagtcattagatactcattactgtcttttttgtccttttaaaacaacatctgttttcttgatttacattcatgtgacattggaattattttgttatatacaaatttagttgtgatttaaatatttttcttatgaaaaatatgccaaccttgtgttagatgttagcaaaattaattatcttaattatcctaagaatggaatcttaattttctttttggaaatttaaaaatgattcttcacaaatctcaaattaaaaattaaaaatctacaaagacctatatcgcaactcccaagttctcaagaaagtaagggaaattcaaggggttaaaaataaagaagaaactgagaaaaaaatccagccatctctcagtgtccatgagggattggttccaggactacccatggataccaaaatctgaggatacttaagtggaacctgtggatatgaaaagttggccctctatatacatgggttttgcatcctatgaacactgtatttctttttttaaataactaattattttttaaaattatttatttatttattagagcaggacttgctgtgtcacccaggctggaatgcagaaatactatattttccaactgagtttccttgcagatgcagaacccgccctgccagtacagagggcccactggatttattgaaaaaaacccacatataaatggacctgtgcagtccaaacccatgctgttcaagggtcaactgtagtacataagatctgataatctggcagtcaggtggtgagggttgatgatcagccacatttatcaagggggttaagatttaagagcaatttaaaagggccaggtctcagacctgtgcaaggccacgagttaaaagtgagactatccctgagtaaaaccaggacacttaagtaaatacatcctcagtaaaacaatatatagaatgtgaaaaattcacccactagcaagcagagaagaaaaggaatattgtcatttttaactgcgcttctggtgaggaaaaggagtctctcctaagaatttgtcatcataagctttggaatttgggcttcattatactacctacatagactgagaaatcctaaattaaaagtggtactctcctaatattgtgtggtgcttggaagaaacaaaaaaatcttttcggaaccacatactcttaacctaggcaacccataattcccacagataaaagcattgcaaacacaagcttttaatagaaaatttagaaacatacaaggaaataatgcaggattaattaagagtcagtagaccaacaaacatcaaaattagaactccaggaacttcctatcacagaattttcagatacagactataaaatacatatacatgtttaaagatagaaaaggaattgaaaccacggagaaataacaagacattgttttaacaaacaaaaaagatgtcaggaaaaaggcatagaaatgataaatatcctcattgacattaaaacagaatatacaggatgaaaagtaaattacttatagctgaagagagatgtagtgaacctcaagacagatctgaagaaattaagaatgcagcagttagggagaaagaaatggattatatgaaagagggattaagtggcatggaaggcaaaatgagaaagacccaactcatatctgagctctataaggagacaatagatagaattagccagaatggtaaagacaagcatcttcatgtgagtaacaggaaacagagtggccaggtaacttgactaacattacaaatctaataaatagtagaccttggatttga

SEQ ID NO: 1431 - DNA, 5097 bp, Homo sapiens
ctgcaggaaggagagaggaagaggagcagaagggggcagcagcggacgccgctaacggcctccctcggcgctgacaggctgggccggcgcccggctcgcttgggtgttcgcgtcgccacttcggcttctcggccggtcgggcccctcggcccgggcttgcggcgcgcgtcggggctgagggctgctgcggcgcagggagaggcctggtcctcgctgccgagggatgtgagtgggagctgagcccacactggagggcccccgagggcccagcctggaggtcgttcagagccgtgcccgccccggggcttcgcagaccttgacccgccgggtaggagccgcccctgcgggctcgagggcgcgctctggtcgcccgatctgtgtagccggtttcagaagcaggcaacaggaacaagatgtgaactgtttctcttctgcagaaaaagaggctcttcctcctcctcccgcgacggcaaatgttctgaaaaagactctgcatgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttgcagaagaaatctgtattgctgcttctaaagcttgtggtatcacacctgtgtatcataatatgtttgctttaatgagtgaaacagaaaggatctggtatccacccaaccatgtcttccatatagatgagtcaaccaggcataatgtactctacagaataagattttactttcctcgttggtattgcagtggcagcaacagagcctatcggcatggaatatctcgaggtgctgaagctcctcttcttgatgactttgtcatgtcttacctctttgctcagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggatttacagttatattgcgattttcctaatattattgatgtcagtattaagcaagcaaaccaagagggttcaaatgaaagccgagttgtaactatccataagcaagatggtaaaaatctggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgatggattttgccattagtaaactgaagaaagcaggtaatcagactggactgtatgtacttcgatgcagtcctaaggactttaataaatattttttgacttttgctgtcgagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaagataaatcaaaccttctagtcttcagaacgaatggtgtttctgatgtaccaacctcaccaacattacagaggcctactcatatgaaccaaatggtgtttcacaaaatcagaaatgaagatttgatatttaatgaaagccttggccaaggcacttttacaaagatttttaaaggcgtacgaagagaagtaggagactacggtcaactgcatgaaacagaagttcttttaaaagttctggataaagcacacagaaactattcagagtctttctttgaagcagcaagtatgatgagcaagctttctcacaagcatttggttttaaattatggagtatgtgtctgtggagacgagaatattctggttcaggagtttgtaaaatttggatcactagatacatatctgaaaaagaataaaaattgtataaatatattatggaaacttgaagttgctaaacagttggcatgggccatgcattttctagaagaaaacacccttattcatgggaatgtatgtgccaaaaatattctgcttatcagagaagaagacaggaagacaggaaatcctcctttcatcaaacttagtgatcctggcattagtattacagttttgccaaaggacattcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccctagggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtcggcgtaatctaaaattaattatggaatatttaccatatggaagtttacgagactatcttcaaaaacataaagaacggatagatcacataaaacttctgcagtacacatctcagatatgcaagggtatggagtatcttggtacaaaaaggtatatccacagggatctggcaacgagaaatatattggtggagaacgagaacagagttaaaattggagattttgggttaaccaaagtcttgccacaagacaaagaatactataaagtaaaagaacctggtgaaagtcccatattctggtatgctccagaatcactgacagagagcaagttttctgtggcctcagatgtttggagctttggagtggttctgtatgaacttttcacatacattgagaagagtaaaagtccaccagcggaatttatgcgtatgattggcaatgacaaacaaggacagatgatcgtgttccatttgatagaacttttgaagaataatggaagattaccaagaccagatggatgcccagatgagatctatatgatcatgacagaatgctggaacaataatgtaaatcaacgcccctcctttagggatctagctcttcgagtggatcaaataagggataacatggctggatgaaagaaatgaccttcattctgagaccaaagtagatttacagaacaaagttttatatttcacattgctgtggactattattacatatatcattattatataaatcatgatgctagccagcaaagatgtgaaaatatctgctcaaaactttcaaagtttagtaagtttttcttcatgaggccaccagtaaaagacattaatgagaattccttagcaaggattttgtaagaagtttcttaaacattgtctgttaacatcactcttgtctggcaaaagaaaaaaaatagactttttcaactcagctttttgagacctgaaaaaattattatgtaaattttgcaatgttaaagatgcacagaatatgtatgtatagtttttaccacagtggatgtataataccttggcatcttgtgtgatgttttacacacatgagggctggtgttcattaatactgttttctaatttttccatagttaatctataattaattacttcactatacaaacaaattaagatgttcagataattgaataagtacctttgtgtccttgttcatttatatcgctggccagcattataagcaggtgtatacttttagcttgtagttccatgtactgtaaatatttttcacataaagggaacaaatgtctagttttatttgtataggaaatttccctgaccctaaataatacattttgaaatgaaacaagcttacaaagatataatctattttattatggtttcccttgtatctatttgtggtgaatgtgttttttaaatggaactatctccaaatttttctaagactactatgaacagttttcttttaaaattttgagattaagaatgccaggaatattgtcatcctttgagctgctgactgccaataacattcttcgatctctgggatttatgctcatgaactaaatttaagcttaagccataaaatagattagattgttttttaaaaatggatagctcattaagaagtgcagcaggttaagaattttttcctaaagactgtatatttgaggggtttcagaattttgcattgcagtcatagaagagatttatttcctttttagaggggaaatgaggtaaataagtaaaaaagtatgcttgttaattttattcaagaatgccagtagaaaattcataacgtgtatctttaagaaaaatgagcatacatcttaaatcttttcaatta

SEQ ID NO: 1432 - DNA, 3399 bp, Homo sapiens
atgggaatggcctgccttacgatgacagaaatggagggaacatccacctcttctatatatcagaatggtgatatttctggaaatgccaattctatgaagcaaatagatccagttcttcaggtgtatctttaccattcccttgggaaatctgaggcagattatctgacctttccatctggggagtatgttgcagaagaaatctgtattgctgcttctaaagcttgtggtatcacacctgtgtatcataatatgtttgctttaatgagtgaaacagaaaggatctggtatccacccaaccatgtcttccatatagatgagtcaaccaggcataatgtactctacagaataagattttactttcctcgttggtattgcagtggcagcaacagagcctatcggcatggaatatctcgaggtgctgaagctcctcttcttgatgactttgtcatgtcttacctctttgctcagtggcggcatgattttgtgcacggatggataaaagtacctgtgactcatgaaacacaggaagaatgtcttgggatggcagtgttagatatgatgagaatagccaaagaaaacgatcaaaccccactggccatctataactctatcagctacaagacattcttaccaaaatgtattcgagcaaagatccaagactatcatattttgacaaggaagcgaataaggtacagatttcgcagatttattcagcaattcagccaatgcaaagccactgccagaaacttgaaacttaagtatcttataaatctggaaactctgcagtctgccttctacacagagaaatttgaagtaaaagaacctggaagtggtccttcaggtgaggagatttttgcaaccattataataactggaaacggtggaattcagtggtcaagagggaaacataaagaaagtgagacactgacagaacaggatttacagttatattgcgattttcctaatattattgatgtcagtattaagcaagcaaaccaagagggttcaaatgaaagccgagttgtaactatccataagcaagatggtaaaaatctggaaattgaacttagctcattaagggaagctttgtctttcgtgtcattaattgatggatattatagattaactgcagatgcacatcattacctctgtaaagaagtagcacctccagccgtgcttgaaaatatacaaagcaactgtcatggcccaatttcgatggattttgccattagtaaactgaagaaagcaggtaatcagactggactgtatgtacttcgatgcagtcctaaggactttaataaatattttttgacttttgctgtcgagcgagaaaatgtcattgaatataaacactgtttgattacaaaaaatgagaatgaagagtacaacctcagtgggacaaagaagaacttcagcagtcttaaagatcttttgaattgttaccagatggaaactgttcgctcagacaatataattttccagtttactaaatgctgtcccccaaagccaaaagataaatcaaaccttctagtcttcagaacgaatggtgtttctgatgtaccaacctcaccaacattacagaggcctactcatatgaaccaaatggtgtttcacaaaatcagaaatgaagatttgatatttaatgaaagccttggccaaggcacttttacaaagatttttaaaggcgtacgaagagaagtaggagactacggtcaactgcatgaaacagaagttcttttaaaagttctggataaagcacacagaaactattcagagtctttctttgaagcagcaagtatgatgagcaagctttctcacaagcatttggttttaaattatggagtatgtgtctgtggagacgagaatattctggttcaggagtttgtaaaatttggatcactagatacatatctgaaaaagaataaaaattgtataaatatattatggaaacttgaagttgctaaacagttggcatgggccatgcattttctagaagaaaacacccttattcatgggaatgtatgtgccaaaaatattctgcttatcagagaagaagacaggaagacaggaaatcctcctttcatcaaacttagtgatcctggcattagtattacagttttgccaaaggacattcttcaggagagaataccatgggtaccacctgaatgcattgaaaatcctaaaaatttaaatttggcaacagacaaatggagttttggtaccactttgtgggaaatctgcagtggaggagataaacctctaagtgctctggattctcaaagaaagctacaattttatgaagataggcatcagcttcctgcaccaaagtgggcagaattagcaaaccttataaataattgtatggattatgaaccagatttcaggccttctttcagagccatcatacgagatcttaacagtttgtttactccagattatgaactattaacagaaaatgacatgttaccaaatatgaggataggtgccctagggttttctggtgcctttgaagaccgggatcctacacagtttgaagagagacatttgaaatttctacagcaacttggcaagggtaattttgggagtgtggagatgtgccggtatgaccctctacaggacaacactggggaggtggtcgctgtaaaaaagcttcagcatagtactgaagagcacctaagagactttgaaagggaaattgaaatcctgaaatccctacagcatgacaacattgtaaagtacaagggagtgtgctacagtgctggtcggcgtaatctaaaattaattatggaatatttaccatatggaagtttacgagactatcttcaaaaacataaagaacggatagatcacataaaacttctgcagtacacatctcagatatgcaagggtatggagtatcttggtacaaaaaggtatatccacagggatctggcaacgagaaatatattggtggagaacgagaacagagttaaaattggagattttgggttaaccaaagtcttgccacaagacaaagaatactataaagtaaaagaacctggtgaaagtcccatattctggtatgctccagaatcactgacagagagcaagttttctgtggcctcagatgtttggagctttggagtggttctgtatgaacttttcacatacattgagaagagtaaaagtccaccagcggaatttatgcgtatgattggcaatgacaaacaaggacagatgatcgtgttccatttgatagaacttttgaagaataatggaagattaccaagaccagatggatgcccagatgagatctatatgatcatgacagaatgctggaacaataatgtaaatcaacgcccctcctttagggatctagctcttcgagtggatcaaataagggataacatggctggatga

SEQ ID NO: 1433 - DNA, 22744 bp, Mus musculus
  misc_feature (1711)..(1743): "n" at positions 1711 thru 1743 can be any base
  misc_feature (5038)..(5057): "n" at positions 5038 thru 5057 can be any base
  misc_feature (20752)..(20771): "n" at positions 20752 thru 20771 can be any base
gcagaggagtgagaaggaagcctggccagtgggtgctgcccctgggagtcaggaggagcaagcaggaactgaaggatttaacaatccagataatgggtacagaagtcaaaacgttagacatgtccactggacattgtggctcgtggacaataatcctaacactggagctgttggaggcaggaggatcaccaagttcaaggttaccatttggggctaacctgaactctatgagattctttctcaaaaaccaaaatagacttgtgtaaacaagtggagactaataggtttttttcggccgaagaagtaagccaattcaagcggaattgagagtatgaaaggaggtttattgggggcggcaggttcaccgatcccaaggaaggaggctagggaagtcgccatgcagacagggtaagagggaggatgtgtacgcaaggagaaagaaatgcagagacagaaaaagagacagaggaggggaacgaggacaaaatgtctggattatataggtaagagcctttgggggaggggaagcccagttctggtatgccagctatatcctgcaagaggtgtgggctaagggatgctcggggaatctggaggccaggtctgctttgatgcgttacatatgcacctctgcagctcgtctgaaacccaacaacaggggcagaggacaaatacaggaagtcgtaaattaaatgcctttgttttcaagttaatggcaaagctaagtaatagctcggcacaagtgttaagcatgcttggatccctaaccgcctgaggcctcccagcaagtgtccagaggtgcctaaccgaggcctctgggatcgggatagcagtgggcggtaaccggctggagaaaaggccagtgagccccaaaacctgttaacagaggctccctcattcagtgggtcacttcgccgagctcccccgcctcacggccagccctttctgcagactgcaagttcacctgccattaccgttgtcgcgcgctcgtctgcttggactgctgcgggccccgagacctgggctgggactctgcactagagcgggatacgaacgtggtgagcgcggggtcgggggagggcgggccgggagggaagccgggactcggcggaggtgtgcagggttaatccctacgccgtgcataatgaacaccccagtgatcaatttcccggcatcagagatgctagtttcgctggcgggtttgtcaggcgaaggcgctccctggctgggagcacgcgcacctctcacaccccgcttccggccctaagggcagcggcggtgcacatgcgcacacgccccggcccgctgggaggcgggacctgagaggcggagccgagtggagatgcctctgcgatgaggtcatccgtcgagctgtagcgtcgtggccccgcccctcgacgtcttcaccccctcacccacctcgacaccagagctaaagtcgggctgtctaggtttcagtcctaacggttgccgcgcggcgctggcctccgcgcaagcgcgacctgacacgctcacacgcacgcacgcacgcacgcgcccgaggcggtggttagaggctctccacgcagtggactagggatcgggcgggtaaggcgatgggcgaggctgaaacaccttccttcgaaatgacctggagcagcacaaccagcagtggctactgcagccaggaggactcggactcggagctcgagcagtacttcacggcgcgtannnnnnnnnnnnnnnnnnnnnnnnnnnnnnnnncccgagtagaagcccagttccagcgcgatggtactgaggacccagggctacccctgcccttgcagtcacagaccggttgagccagggggaatcaactctgaagcttgaagggtggaccacaggcgggcgtttttcacccatgactaaagccagcctcgcaatccaaaccggcgtcttgatttcgcatttgggcgctcccactccctccctgggggaaatgaggaagtggaggaggagtccaccgggaagtgagaagttagtttgggaggggactctggccgtgccgtatgcggtcttggatcagccagcaaagtgcccagccgttgctcgaccaactctttgacaccagctgctggactcgatctttctttcctccatggtggaactgtgcagagggatttggggaattcaggaagagggccttaaaagactattaaaaaaaaaaaagtgtggtaccagggcagctgaacctctttaaaaagtctagatgtgcccaaattatccgactttctgggaatatcatagttgtggccaccaagctcggataacttgttctggagcgggaatccctcggaacagcacagaggccagcgaatcaggaaagtgaggacggagactgaggttagaaaacttagtagcactgaactagaactccttatttgagccaagaaagtggaattgtctgtgatgctgtaggtgagatttgatataaatttcctacaggtggactgctacttgacacctccaaaaccttagtccagactttagactcaatgtggggtgggagtgggggcgggagggtgtctctgggattgtctccataccactcaacctgagtcatcttctattatggagaggtgggggaaaatataagatactggccagttgaaaggcatacaaagagaagaattgtttaaaagcagctgaagtttatagctgacttagctgtagagtgcttagcattatatgtgtgatggatggcctgacttccaaccattaaggaaccaaaaaataagaaagaagaaaaggaagctaagaagtcccaaagagcagagtaaaagcctgagggctggggctgggctgcaggttcaatccccaacccagaccctcctagaattctcctgggaccaggcactgcctagcggtgatcccagctgtgtttgttccaattgcattccaatttagggcctttctgaaaccaacaggaagtaagactcacactgggagttgaggactgactgctcttccagaggtcctgagttcaattcccaggaaccacatggtggctcacaaccatctgtaataggatctgatgccctcttctgatgcatcagaaaacagctacagtgtattcacacatatataagtaaataaatcttaaaaaacaaaaacaaaccaggaagtaagactcaggcagttaggtcaagtgagtcctggctgccctgagcagcagggtgactccaccctcccgcagttcctgaagaaccttgtctctgggctaagtcttcagacagcgagggggaagaacagaagcctccctgcttgctgctggtaggacaggctctgctgggaaattgcctgtacacctctggcagatgagaacctgaattgaagctgccttctgtgtagcttgagtcagagggtaaatggtatgtcccagtgttacttcactatataagatgtggtgtggctggtcccaagaaacccactaaggcatcttacattatagagatcagctttcctctcctgtctactgtagttagactgctgatgcaccagctcccgtgctgcctaccctctcgggggtcatgttctgtgctgccgcacagtgggagagtgggctttcttctccagaacaaactgaccaaactagtgttctgggttcagctctacagtggagatgtgattgagatggggttttaatttttgtatgtggtgggggtggaaatcgaagggccttgtacattctgggaaattactctatcactgagctacattttatcccccaaagtgtttatactttaaacaagatttttcccttacagtccttcatggtttcctggcccctggacatgtgccttcatttatctgtttctgtgatgtcgttaggggccacaaccagtgctgaggtggccccagatagcagaaagccaaacggattctacctgtccttgctctctccatctatagcatgtaaaaccaggagcaatgatggcttcaggatgtatgggtttggtgacaggaccaaaatcaagttccaagccagaaggaccatccccatccccaccccacccaccaaagagccttggccttttcaagggccctgtatctatgctggcctgtctttcaggatgaggctgtagagcgggagacacccgatctttctcaagctgagactgagcagaaaatcaaggactacaatggccagatcaacagcaacctcttcatgagcctggtgagttggctgttcaggaatgtgggagaacagaagcccagctctgggccagatgtccagagagtcagagcaaagtattctggggtgtacccaagcagctatctgtgcagacctggctttaccctgcccctggacgactcaacctaactcttccatctccagtagaacttcctgacatggcatggttctccttttcctttctttcttttcagaataaggatggctcctacacaggcttcatcaaggttcagctgaaactagtgcgtcctgtttcagtgccttccagcaagaaaccaccttccttacaggatgcccggagaggtacggggcggagcacagccgtgaagcgccgcacctctttttacttgcctaaggatgctattaagcatctgcatgttctatcacgaacacgggcacgtgaggtcattgaggccctgcttcgaaaattcatggtcgtagatgatcctcgcaagtttgcactctttgagcgaactgaacggcatggccaaggtaggtttccagtctcagcactccctgtgtaagggttatagatcacatacctgtgtattaaggggctgaggcatctgagtctgtctttgtttattttcccccgcccaacctccagtatacctccggaagctgtcggatgacgagcagcccttgaagctgcggcttcttgcagggcccagtgaaaaagccctgagctttgtcctgaaggaaaatgactcgggagaggtgaacgtgagtccgtagtccttcttacttactttcttactttcttatcactaacaaagctagtgggggtgtagccatggtgaggatttcagggagaaaccgggnnnnnnnnnnnnnnnnnnnncacagcctgtccaagaatacacaggtcctctaatggaagtttaggcttccaggactctttgttttgttttgttttttgaaacagggtttctctgtatagccctggctgttctggaactcactttgtagaccagaatggcctcgaactcagaaatcctgcctgcctttgcctcccaagtgctaggattaaaggcgtgcgctacctctgccaaacagcttctgggactcttaagccaaggtctagagcctatcccaagaaactataggaagaagctgaatctagtggttcatgttataatcactgtactggggaggctgaaactggaggattgttacgagtttgagatcagtctggactaccaaaacaaacaaacaaaaacaaaaaacacacaagctaggaagaattgtcttcaggctttgttgtttcctggtgttgaaaatgagaacttgactaactcatagtgagccaagaccagttcagagctccatatatatgggctcagagatggctccacagtgcagaggatccacattctgtttgaagcactcatatcaagtggctcccactcacctgcaactccagcgccaaaggatttgtcttcctctgctggcatcagagggtgcctggagttatgtgcctgtgaccccacgcgcatgcgcaagcacacaactaggacaataggaaagatggctcagtggttaaaaacatgtattgttcatgcagaggacctggatttggttcttagacgcatgtaaaagcttacagttgcccataattgcagaccatacacacaatgtgcatacctgcgtgcaagcaacacacttatacacataaaacagattttttttaaagactttgtgtatgaatgttttgcctgcatgtatatatgtgtacacgtgcccacagaagtaagaagaaggtgttggctctcctagaacagagttacagatgatggaacccaccatgttggtctaggaattgaactctggtcctcttcaagagcaaccaatgctcttaaccactgaactatctttcgagcccctgaaacaaaccttaaaacaaaaagaaaaagaaaagagctttgcaggtataacctgaaaaacataaaggcctcttggaagcattgagacggtctgccagctaggacagatggcacaggcctataatctcatctacttgggaagctaaagcaggaggattgcctcaagttcaagactaggctggcctgtatagcaagatcctatctcacaaacaaacaaaccactcttcctagcaaggcctagggacagtggcttatactctcaactacttggaatgctaaagtgggaggatcactagttcaaagccttcctgggctacagagtgacttaaagggcaatctacgctaacttaatgagatcctgtctcaaaagtaaaaaggcttgggactgtagttcagtggtaaagtgttgagcaagcttagccctttgttcatgtcttagttaggtcttctattgctttgatgaaacactatgaccaaaaccaagttggtggggaaaaggtttatttatttggattacagttccatatgataatccatcattgaaggaagtcagggcaggaactcaaacaggacaggaacctgaaggcaggagctgaagtggaagccatggtgggcgctgcttactggcttgctcagcctgctttcttatagaactcatgaccaccagcccaggggtggcaccatacacaatgggctaggccctcccctatcagtcactcattaagaaaatgccttaaagctatagcttgtggaggcattgttttcaattaatagagaattaatattccctattttcagataactttaacttgtgtcaagttagccgaaaactagatagcacagtgcaatttccagtaatgtaaaaagaaagaaaaaaaaggacaatgactttttacatcggggttagttgtggcttagtggtaagaatagacgctcagcatgcacagagctcggcagcaaaaaaaagaaaagaaaaagaatagggtgggtacaagggctgtatgggaatgtagcttggtaaaaggtaatttgctaacatttatgagaccctaggtttgaatcagagcccattatattgagggagagaatatgagactatgcgggagaatacacctaacaacagatagagatatttcactacaaggagactgttttgtaggatctgttttctatacagactgctcatgaggatcctagcacagaccatttagtgaaaagcctaacaccaaggctagcattgtgataaatacttgtaatctcagcgttccggaagcagaagcaggagaatcacaagtttgagactagcctgggctacatagcaagttaaaggccaacctttgatatgtagaaagactatgactcaaaaaaacaacaaaaaaaaataggggacttaaagagttggcttagcagggctggagagatgggtcaacgattaagagtaccggctgctcttctgaaggacccgggttcaatacctggggttcagttcccaatacccacatggcagctcacaactgtctgtaattccagttccaggggatctgatgccctcacagtcttacatgcaggcagaataccaatgcacataaataaattataaaaccattaaacaacaacaaaaggagttggcttagtggttaagagtacatgttgttcttacagaggacatgggtttgatgcctagcacccagatggcagctcacaaccatctgtaactcttaattctgggggatctgataccttcttctgacctctatgtggaaacatgcatacacataagataataatgaaatgaaaaggaggtaatgtcaggagcgcagacctgctcatgggagaaccatcatggaccagtcttggaggagggtctgccaacttagctattcattgctgcagcccgtgtatctctcctctgccctttccagtgggatgccttcagcatgcctgaactgcacaatttcctacgaatcctgcagcgggaagaagaggaacaccttcgccagatcctgcagaagtattctcgttgtcgccagaagatccaggaggctctgcacgcctgtcctttggggtgaccttgggtctccatggatgacaggaggagaacaggcagtgcaaagagcgtgccgtgtgagtgtgacagggcctgtggggcctgaggagtgcgtgtgcatggaggtcctcctctgctgaccgggatgagcccagagaacagggaaagagccagccgtctacctgtggatatagtggggcggggctttgcatccctctgcccgtatgtactgggtcatactctgcgtagctgctcaagtcacagggtcgcagctgtgagaatcttagagactctacagacagaacaaggttatattttcacgggtaagagaccttacctatggaggaagattgttttgagtcatgaatgggtctcaggatagccctatcagagccaagggtagctgctcagaataatacaagcaattaaggtagagtctggggttccctcttaccgtgccttctgacttccaaacaaacaccctggggtcagagagggctggccagtacaacaactacagtggctcagtcagtgcctcctctaagggaaaggttgctggaccagaccctcttcttgtttgccaaagccagagtctccctcagatatttttgatggaagtgtatgaatgtatgtaatgttttgtggcctcaactgaatgcctcctgtggggaagggatgggggtgtgacagtcatcatcagggcctgatgcctgagagaattggctgaataaagatgtaagaatttttctggttttggactctatagatgtgggcccccagtcggggtaacacctaatgaaagactgccaacaaagattgacacatccagagtgcaccctctccaaggtcgcagtgggaccaatatgttcaggaaatgtatgcctgtggattcaggtgtctttcaaccctccagggctcaggtcatgaagagacaagaataagctacagttactacacaggaaacttttttctccaggccaactcagagaaaccatagcagtaaccccttctccaaaaaactactcgtgggtcccacacttcacatgctaccaggggaaagctggtaataattattttcctgaagaatgttctctggtgaacttacaacacttagtttaagttccttcagacctcaaatatactcttaagaaattgatcaaaaaagttttaaaaagaagtttggctccctgtgcggttggtcactcctttaatcccagtattcgggagacaggcatttgagcgtcagccatttatacatggcaagtgccaggccagctaaggctacatagtgagaccctgtctccaaaagaaaaaagaaaacaaaaacattaagcaagatccgtagtttctttacaggcaaatgtgacaactgcaaagacacagttgtgaaaacagccaaccttagcctcagacaggcctaaggtcccttaggggtggaggggtgaccctaattgactattgctactgggccggagttttgggcgtgtcagggacgtagagacaactataccgggtccgaccttaaagtcaacaacaacacattacctccgcctttctggaagggagctgtcccagctgacccttgggacccataggcttctgggacctggaggcagcgcatccctgtggtggtcagcctctgagagtggccattggttctacaccacagactgacgagacctttagccactcagaggaggcaccgtgcaggacgcgcggaagcggaagtgaggtttccgtggagacagcagagcctgcggaaggcggcggcggcggcacctgcgagtggaagctggggcagggcatggtcgcgcccgccgcgctgtgagagcggagcggccgctgggtccgccatgcgcccgcggcgctgacatgggcgccagcggctccaaagctcggggcctctggccctttgcctccactccggggggcggcggcccagaggcggcaggctccgagcagtctctggtgcggtctcgagcccgagcagtgcctcccttcgtattcacgcgccgcgggtaagggcatgggtatctgcctttgggaggacatccgggaatgagaaacgcccccctacatttgaatcagacgactgtcatattttgggtcccagtcaaagcaaggagaagggaaaaccaagcggcgttcagctcttgaccgcccagatggtctttttagagaattgcctgaggttcgtctcttagggagcagctccataattcagctaagacggcatctaagagtcttaaaacctccctttcatccaactcagcctgcaaattaaaggcatttatgtcccttctgttcttctaagccttagaagaaatctaagggaagatgaccttctgtttaggtgtcttgccttcctcactgtgaagttggacctccgagaatagtgtctggaaaagcagagaaaggcgtcagtgttgaaggtggggccacaacaaaaaaagtgccctcaaccagttgggttctctagatctggaacactaacctaaccttcttttttcccaggtgctcacacaaaatggcctggacctagtgagctcctagggactggcattccctgtgatggaaatttgaccgtaaataccagagagacccaacagtgtcgattagacagtgccagccactggggaatgacttggagtgcagccttctgggctcagacatccaccatcttggtctttggccctggaccagcagtgtctttagaagtgagaccagtatgcccaggccactaccccacccactccataaataagccctaggtgaagggcctgctactagaatcatgacctttgtgaaacagaccagtggtgaggactaactttagttgcctagagagggtgctctgatgtgacatcctgttggtatgacagggcaacagtggccttgtcacactgcctgcttccctccgggcaccaagcaaagagttcttccacggagattaccgttgtgcgtcttctcttggggttcagcgtacttccctgtggtctgtggcccttgccaaggccagggatgaggctccaatccagcctgttccccttctctccacagctccatgttctacgatgaagatggagatctggctcacgaattctatgaggagacaatcgtcaccaagaatgggcagaagcgagccaagctgaggcgggtacataagaatctgattcctcaggtgagggtccgagcagtgatcataaagcctacatcagtatgtcaacggagatacagatggggctttctgggggaagagctgggaagaacagagaggctcttagcatagaggcccagagctgatcttcactagcctctgtttccatggcagggcatcgtgaagctggatcctccccgaatccacgtggatttccccgtgatcctctatgaagtatgaacctgtgtgtggcatggcagacacgagcacccactgccccagcaagaaactcccaggatcaaggtgtagcttccattcaggagtccaggctggtgccacaaccttgaataaactaaactccgttggcccagaaccttcagttgtaagaggggttgtccctcagtgttaactggtattggcggatgtctgaacaataagaggttggtggctggtgagggctaaggacagaattaccagcccgtctcccccagccgcttgtgggagaagcatgacaggagacacgtgccggtcaggaatgcctggttcctggttacctgcctgacctgctttcttccaagcttgcctagggcccagccctcctagaagctacagcactttacaagcagagtctgccttcttccagcccctgggctgtaggggctctacccaagtgggaacttccttttccctcactccccttcccccctagtcagagcatttcagccgtttgctacctcgattcctcctgtatcggacagactggagatacataccagcctcacccttcctgcctacctaccacatgctcccgctcttaagctggacactttgctggctgttcaataagaatgaggaccagtgtgggaggcttctcctttcacccagggctggactgatctctcttgatttcaaccagttgccctcaagttgagagggtacaggccggggtcaggacaggctactgacgcctgtacctgtggggacttgccccaaaccacatattcgtcgtctcccttgtctttgcaccagtcccacaaatccccagttgtaggggagaggcagtccaccacctagtggtaagaaacgactggggctggtgccagtagctatgaggagcccatccccccccttctccttacagtatctttaccccttcagggtctgttaagagaaagtactggagctccttggtaaggatagaaaggaggggaaaatacataagaggcataattaaaatgtgaaggtttgtaaatagtctagactatgataatgttggggcagagtctgatttctatacagagatggctttaaaaaaaatacttccttgtggaagctctgtgcttctagagtgtgggaaatggcttgggacgagtgatccccagcacaggaaggctgttgtgttatttgttcaatttcaataaaagttatttgtagaccctgcacacgagagtggcgtccagtgagactttaacatccagtttctagactgctgatccggtaaggctagcaaacccttgcctgaacattgcctgtagcaataccagccgtggccaacaggtggctgtgtccaagaactgtctccagccctctcaagacgcagagggccactcacctgtccattctgtctgggaatttggaaacagaaggtcgtgtgggatcctagggagattgccctagtctgaggtgtgagtgtagccacacacacagttgtgagatggttctggtcccaacaataccagattatgtgaagtgaggttacagcctaaaccccacagatcaaggcctacctatacttgaacaacagacacttcccaccatggccttggcctccttccaggctctgaagtccacactcacctgacttcccaaggcagccatcagaaaggagagcacaggcttctgctgcagcctctattgtagggctcggcccaacacctcctcagctctctgccgccaatggacattctgcctacgtttctcaaggtcggctatgagcaggttctctgctcgcctagcctttggccataataaactcaagacgtttttaaaaagcaaaagcaaaacaaacaaacaaaaaaaaaaaccaattgggaagcaggagtttatcaactcagggcagttggccttcaagttgctcaaagctggaactggtcaagtcttagcctgttcaacatagatttgcggttctgtagaccaactgtcatccctgtaaaaagccaggagttaggttcctgtccaggagccaaggctccccatatcaggcagtatcctatctcaccaccaccatcctgctcgggaaactccctgtcctggacctgcctagctaaccccaaagctatgaacaataggagagtcagggcagtgtttccctactccatccggctgggctaggctcacttccttcctgctggcagcctaaggaagtgtccctgccctggacagtctcgcctggcctttgttttcccagtagtccccacccttggagcttcctagatttttgtcccttgtgaagccaacacaatggtgaccacagcctaggctatacacccagctctcctgctttctattggcagagggactccctagcactggggaggtgagccccttggaccaggtgaggggttgtcagtttaggtagatttgaggtcaggcaaatttgcctggacctccaaagaggtcttccaggaattcctattgtaagtttcctctcccatagggacacaattctccccccaccccatatcacacagccacaggcatcaacacattgtcatattgtctttgtcacaggttggatacttccgctctcaatggaaaaaaaaaactgactcagctactggaagagcccaccacccccaccccacccgttttcccctcgtgcaggatggtttcttctttggcacctgctctaggggaccattcgctcaaccacccagcaaattgactcccatgaatacagccagccacttgggccccctcacaccctactggatttgaggatgatgcaaaacttggagaaagatgagcccttggttcctaggcccatatccttcccatcacctggcacaactcatgcagaccttcctgggaggaagggtgcaaagggcagccagccaccaagggaaacagggtcaaggggctctcctccccgcccccctggccctttccgcctggagggcagcaggaagtgaggagaaagagcagggatgggaggcgggagggagtgggtgggaaggaatggggtttatcaaatccccagcagactgcccagagggcagcagctggcgcaaggaacctggctggagagactctactcaggtgagcgcagagtagtacataaagctagtccgcactgccataaatgcgtgtactcctgcggcgctccctagcttccaagcttgcggtagggaaaggggctggcggccagaagcggactttcggagatttgagtcgtgcattggagagcagatctaagaggcgagggtacaggtctaaacctagtcctcactggaaggggattgcaaggcagaaaggttcagaatatggagtcggggtactagggagacactgaagcctcctttctacgaagtcaggcccgaaactttggcaaattgctctttatttggagttgagtgggtacccctatggacaaccatcccaccttcacctcgtcgcagagactggtctggggagaatccagtaaattggcaagccctggcgtggatccggtgaaagtggctagatcactttcccctttggcccgactgaacttcaatccctttggcaaggcagcgacccacccccctggttaccaggacaaccactacgtctgctttgccaaaggagggctcagaagctgtactaggccccctcctctagacgagcaaaaggcggggtttccttctgaccgcagacagactagtggagggaacctgggctcagcgaaggcgggtcattaatgttccaagaggttctggatccactcgtgtcaaaatctcttacactagacaaagggcccactttgctagagtccatattcagacaggtgggattgaatccgcagctacccccagtcaaggcttcagctataagcttttatttcaaatgccattaccaccactacaccctcattccgctcgcgcccgccccatccaatgttctatccctttaagaggccagctgcaaagagtggattgttccactgacgacagattgtgggggtaatatctcaggctggttagctctggtggctaaaaccagcgggaatccccattccaggaggtattcaatctcagatacataactatgttcctctacagaagatctaagggtcctcgaactcgaaacgcagcactggcaaaaaggaagagaaacacaccctccctacgaggccgtaaattctgccatccacccacctccgaggcaggattcttaaagggcccgcgggcctcggggcggagccaacagaggctcgagctggggcagtgcttgggcgaagggccggatcgggcttggttggtaccaggatggcggcggccctggcgtgggtcctggtggcgcctggttcgaggtgagggcgggcgtcgcaagcctggtgactctcttcctgtgagatgggctctgaatctctaggggcgccctcataagtgacccaggaaccccacccccacccggctgaactctggccccacgtgcggggcgggggcggggtcccgcacaaagaccggagtggaatactctttacccgggaccccttgtgctgggaggtgagggtgtgggccggtcgcgaagtgctcacacagattcttggtggctgtggtgggaagggcaggtcggcgagcaccgcggtgggaagtccgctgcccctttgtccccggggcgcctcctcctatcctaagagtgtcggtgcccgagactaagtcctgacgttcttgctcttctgcttggcgcacattgcacagatagcagttcctctgcagtgtacctaacagcttcccagcttctgtatgcgttgtgccccaaatgctgtctcttctcagaatcaattctgagttcgtaatgagggtgggggacatggggtgttcagagtgttttaaaactatttactgtatggtatacaggcatgtaagtgactctagcagtgagtcggtagcctaatcagtccctttttcagaaaggatatggacctaaaggagattcttgcccaaccacgggcagctccctgctctagaaagagctctgtggtttcggtaaattccctaaggtcttttgcctacccatcagcatcctgctatctcccaaacctgttacagcctcggccatctgagcaggagcatggtgtgccgcacagtatgggtttggggagtttatgtgggatgaaggtgcgtacacatctctggaatttgctagactgacttgttctctctcacactttcttcagttcctgagctgctaccaggcaggtaacacttcctgtagcccccagcatgcgggcaggactaggtcccatcatcacactggccctagtgctggaggtagcatgggccggggagcttaagcccacagcgccgcccatcttcactggccgaccctttgtggtagcatggaacgtgcccacacaagaatgtgccccacgccacaaagtgccactggaccttagggccttcgatgtgaaggctacaccgaatgagggttttttcaaccagaatatcaccaccttctactacgaccgtctaggcctgtatccacgttttgatgcagccgggacatctgtgcatggcggtgtgcctcagaacggcagcctctgtgcacacctgcccatgctgaaggaatctgtggaacgctacatccagacccaggagcctggggggctggcagtcattgactgggaggaatggcggcctgtatgggttcgaaactggcaggagaaagatgtttaccgacagtcttcacgccagctggtggccagtcggcaccctgactggccatcagacagagtaatgaagcaggcccagtacgagtttgagttcgccgctcggcagttcatgttgaacactctccgttacgtcaaggcagtcagaccccagcacctgtggggcttctacctctttcctgactgctacaatcacgattatgtacagaactgggagagctacacgggccgctgtcccgatgtggaggtggcacggaacgaccagctggcctggctctgggctgagagcacggctctctttccctctgtgtacctggacgagacactggcgtcctccgtacacagccgcaactttgtcagtttccgtgttcgggaggcccttcgagtggctcacacccaccatgccaaccacgccctccccgtgtacgtctttacgcgtcccacatacacccgaggactcacggggctgagccaggtacgtgttctcccttcctctgggagccactgcatgcttgtgttatcggggaccagaagtactattccatatctgttttagtcttgtggaagggtgatgtcacccccattctgtagataagaccgaggcccagagatgctgagaggtagccaggagcctgtagcaagtccgtgaaaagtgcacagaactaaaccaggcatcctgactttggggtcagaatgtgtaacctttgactttgtgggctcatgcgtgggctcttggccttggagactaaggtccaaggtgaggatagaaatgggcagagcggcctctgcctgtctagaactgtcctaaggtcagcaggttagagcaggtctgttctgagtctcctgcgacaccgtctggtgccagtcttgctcaggaaccatccctccccacacaggtggaccttatctctaccatcggtgagagtgccgccctgggctcagctggcgtcatcttctggggcgactcggaagacgcttcaagtatggtaagggagacccacctggccttccagggctgatgaagagtgtatactttggcttctgccccccacctgggtgtacacactgagtatagcttatctcctaagcatagcagctttgtccctggacccaagagggaagaagggcacccccaccctgttcccaggaagaggaaatgctatcttgaacagctggagttccgcccttcctcatccacacagctgggctccagtctgtctcaaccccgcttctcactagggacaggggactgactataaaggctcgggaactctgtgtatatgtttacatacatatgcaaataaatatgccagggatgtgcctcagtagagtgcttgcctagtctagggttcaaactccaccactaccaaaagaaagaggcgctatcaccacagtttccgtcggggcttgggcaaaggtagctaacatcagacactcactccttaaccttggccttttccaggagacctgccaatacctcaagaattacctaactcagctgctggttccctacgtagtcaacgtgtcctgggccacccagtattgcagttggacccagtgccatggccatgggcgatgtgtgcgccgcaaccccagcgccaataccttcctgcacctcaatgccagcagcttccgcctagtgcctggccatacccccagtgaaccccagcttcgacccgaggggcagctcagcgaagccgacctcaactacctgcagaagcactttcgctgccagtgctatctgggctggggtggcgagcagtgccaacggaactataagggggcagctggaaatgccagcagagcctgggctggatcccacctcaccagcctgctgggtttggtagctgtggctctcacctggaccttatgagggatctctccccctggatatcagtccagctggcctctggtgcaaggatctccttggcatgaggggcctgttaggggggagacaaaagtctggagtaggcagtgctcccaggatgcttagcagagcacccataccatctgtcacccccctgttctaagggggagagaaacatcccctgagatgccctcatcttgccagagaagatggagaatcaagctaggccagagaaggcctgactctactccctgctcctggatagtttataattttggggtctcttttgtaaattaaatataaaacaactcctgtgcttcttgtctttttctgcttcgaggttagtgtgtgagagtgctcagggctacccaggaggtggagctcagctctttgaatccacatgctggaacttctcagcagtgtgttcactggggcctagggaagaagggctactgagtctgcacttgtgctggggcagggctcactagaataaaattcatactctaccctaacatcaactccactttatcttgatagaaatagagtggggcccaccattgtatgactgatagaactagctcttttatctgccacctgccccagtatcccaagcagggtcagcactagcttccttacctcaaccacacatagaaaaggggacatgatcttccctgatgttcctacaatagagcagcatttcttttccttttttttttttttttttttttttggttttttgttttttgagacagggtttctctgtatagccctggctgtcctgaaactcactctgtaaaccaggctggcctcgaactcagaaatccaccagcctctgcctcccaagtgctggaatcaaaggcatgcgccaccactgcctggcacagttgagcatttctgttccctgctcccaagggcagtggacctgttcctctccctgtctggttcatacccttcccttgaggctggcaggtaaggaggctggcaggggattaagatgtcagtcttgagctgtcagtctgtcactatgagtgtgaggtggtgctgttgggtactatccagatctggggagcagggtcaccctcaaagatcagctttggagctagaatgtgtgtgtgtgtgtgtgtgtgtgtatcagtgctttatcagtgtttatcagtgataaagcacttgcttggcatgtgcaaggccctgggattgatcactagcactatcttgaaaaattaaattaacctaacaagaatgttgagacaagagtctcactgtacagccctagctgccttagcactcagtatgtgtagatgaatctggtcttgaattcagagatccacctgcctctgcttcccattcactggaattacaggcctgtgtacaccagacttaataatttaaaacctgaagaagagggctggagagatggttcagcagttgagaacactgactgctcttccagaggtcctgagttcaattcccagcaaccacatggtggctcacgaccatctgtaacagggtctggtgccctcttcaggagcgtctgaagaatgcaatggtggtgtactcatgcataaaataagtaagtctttaaaaaaaaaatctgaccagtcgtggtggcgcacacctttaatcccaacacttgggaggcagaggcaggcnnnnnnnnnnnnnnnnnnnntctcaaaaaactaattaattaattaattaattaattaattaattaattaaatctgaagaagaccactcaaaaaaccaaccaaaaagataaataaaaataaaagaggaggaggaggaggaggaggagaaggagaaggagaaggagaaggagaaggggaagggtaaggggaaggggaagaggaagaagaagaagaagaagaagaagaagaagaagaagaagaagaagaagaagaagaagaagaagaagaagacagactaaaagcaatggagcttggcaaaggacggcaaagacaagggagacctcttgtcttcctcacacctgtgactcattctgttgtaaccttttctattcatccatgttctctatggtacctgtcaaccttctatgaacattgaccccccccaatatgtatggatacacacacaactgttagcccaagggtgggcatggaggacagaagaaacatctgcactttccccatgcctgtaatctgtcctacaagttgtgacctatgtccatctagctttgaacacactcttggggcaaatcctgtccaccacttcacatttcttcccctgaaaccccagggactatgtagctacttcctctaacttaaaaacattccctccaagaaggttaaacaaggcacataaaactcagctgccaagtgatggtggcagcggcacaggcctttgatcctaccactctggaggcagaggcaggcgaatctctgagtttgaggccagcctggttcctgagttccaggacagagaaaccctgcctcaaacaaactccttagaaagctaaggaaacttccctaagctctggagattcaagaagttaataatttgggtgagcaaaatggctcagagggtaaaggcatgtgagacctgatgacctaagctcaatgcccagagtcggggtgacagaggagaaaactactgacttcacaggccttccattgacctgtgtgtatgactgtgattatatgtcacctctgtgccagaagaagatgtcagcatctctggaactagttgcaagccacttggcacgggtgctgagaactgagctccagtcctctggaagagcagctaaattctcttgataattaaaaaaataaataaaaaatatacatgcacacataatattaaaaaattataagattcacaaggcccctctccaaaactaaaaagtaataaataattgctggagaggcgctacctacaagctggcaagctgtaccaaagctacaacttttgtcaactgttgttctggcctagggtcgaccttttggtgatgcagctgtctttgagtgtcccatgcttctgtaagcagctccctatgttcctccggtaatgtggccccgaaacctcattgatttaccaagctagacttagaatcaattctctcacctgtggtcacctgtggtgtctggaaatgaatagaagattgttcacggaaaaagtcacgtgacaccacagtctctgagggctaggggaaaggtcaggttaggaaggtggggtagatcaaaggcactaagcacacactgccagggaggccacgcctatatggtagccccaaggtgaatgcctaaggggttcggtcattcagaatcagacacaactgcaggcccagacaactgctttattctgggcggggccatgcctttcccttctactttcctaacttggcaggcaagcccggacctgagcaaccagatcatctcagtaagcagcctgtgattcagtgaacttgtaactcacaactgcatgaacacacacgttacttatgcgtgtactcactaatacacccctgctcatttccacggccatgcagatccagggtctcacgatcaccaaacagcaaggtctcgtacatcatcccaggaactgagtcctcacacttgcaggtataaatacctgggaatttgggcacgagcccagttaccaactagagcgtcacaaagatgcaat

SEQ ID NO: 1434 - DNA, 1482 bp, Mus musculus
ccggggggcggcggcccagaggcggcaggctccgagcagtctctggtgcggtctcgagcccgagcagtgcctcccttcgtattcacgcgccgcggctccatgttctacgatgaagatggagatctggctcacgaattctatgaggagacaatcgtcaccaagaatgggcagaagcgagccaagctgaggcgggtacataagaatctgattcctcagggcatcgtgaagctggatcctccccgaatccacgtggatttccccgtgatcctctatgaagtatgaacctgtgtgtggcatggcagacacgagcacccactgccccagcaagaaactcccaggatcaaggtgtagcttccattcaggagtccaggctggtgccacaaccttgaataaactaaactccgttggcccagaaccttcagttgtaagaggggttgtccctcagtgttaactggtattggcggatgtctgaacaataagaggttggtggctggtgagggctaaggacagaattaccagcccgtctcccccagccgcttgtgggagaagcatgacaggagacacgtgccggtcaggaatgcctggttcctggttacctgcctgacctgctttcttccaagcttgcctagggcccagccctcctagaagctacagcactttacaagcagagtctgccttcttccagcccctgggctgtaggggctctacccaagtgggaacttccttttcctcactccccttcccccctagtcagagcatttcagccgtttgctacctcgattcctcctgtatcggacagactggagatacataccagcctcacccttcctgcctacctaccacatgctcccgctcttaagctggacactttgctggctgttcaataagaatgaggaccagtgtgggaggcttctcctttcacccagggctggactgatctctcttgatttcaaccagttgccctcaagttgagagggtacaggccggggtcaggacaggctactgacgcctgtacctgtggggacttgccccaaaccacatattcgtcgtctcccttgtctttgcaccagtcccacaaatccccagttgtaggggagaggcagtccaccacctagtggtaagaaacgactggggctggtgccagtagctatgaggagcccatccccccccttctccttacagtatctttaccccttcagggtctgttaagagaaagtactggagctccttggtaaggatagaaaggaggggaaaatacttaagaggcataattaaaatgtgaaggtttgtaaatagtctagactatgataatgttggggcagagtctgatttctatacagagatggctttaaaaaaatacttccttgtggaagctctgtgcttctagagtgtgggaaatggcttgggacgagtgatccccagcacaggaaggctgttgtgttatttgttcaatttcaataaaagttatttgtagaccctgac

SEQ ID NO: 1435 - DNA, 333 bp, Mus musculus
atgggcgccagcggctccaaagctcggggcctctggccctttgcctccactccggggggcggcggcccagaggcggcaggctccgagcagtctctggtgcggtctcgagcccgagcagtgcctcccttcgtattcacgcgccgcggctccatgttctacgatgaagatggagatctggctcacgaattctatgaggagacaatcgtcaccaagaatgggcagaagcgagccaagctgaggcgggtacataagaatctgattcctcagggcatcgtgaagctggatcctccccgaatccacgtggatttccccgtgatcctctatgaagtatga

SEQ ID NO: 1436 - DNA, 23328 bp, Homo sapiens
agatccaactgttgagcaggcctctctgcctgtggccttccggccggtttccagacgcccaggtggccaacattagagtccgcgtagcagtgtgaggtaacccactgagataggtcgggcctgcggagcctggcgagcagcggccctctccctggggcttcccttcaatctccgggacatttccccgacctggagctcctccgcctcaccgccaggcctctctgcagattgcaagttcacctgccactaccgctgccgcgcgctcgtctgcctggactgttgcgggccccgggacctgggctgggaacccgcggtggagcgggacacgaacgtggtgagcgcggggccgagggcgtatgggaagggcgaggatgggcaggccacagtgcaggcattctcgagggctgcctgggtgccgcgcgcaaggagcgttctaattgccgatttcccggcggcacagagaggctaattctgcgcgggggctgggaggggagcctggattgccggctccgcaagtactccacccgctgcaagcggacccgggcccaggctgacccaggctccgcgcacgcgcacttcccgcaccttcccgccctcgcctccggccagaggccactcttgtgcgcttgcccggacgctggcacccgcccccgttccctgtggtaggtggggtctgtgagtggagctccggagcgatgaggtcattcctgggggcgaagcgtgcgtgtccccgccccggcgttcctgccccaatgagacaagagctagatcccggcgatctacgtttcagtcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggtgggagccagggggtgccggcgggcgggaggggaagcggtcgctggagctccgccctccccggtccgttgccgcgtcctgggtcggtgggcagccccaccctcctggctacgtggctccccgcgggtcctggccggggacctgcccgcggaaccgtgcgtaagaccccgattccaccgcctagatgctgggtgccggggcccccttggtttctgtcacagacaggttgaacacggaaaaagcagctgtatggcttgtggtagacctgagccgggcattatccagctatgactaaagccgaccgagcagtttggactagcacctcgatttccgcgttcgaatgctcctgctccctccttggggagactaggggaggatgtggagagggaagagtcctcgccaggaattgagaagtatgtttaggaaaacttgagaggcagagagagatcctgctcctccatctgcactcctgtatggagccagctgagccctcacctcttccctgttctggcctgtcaccagctgctggaatgtggaagattctgttcccttcctctagggtggatctggagaaagatttgggaatagataggaaagaagtcttgttttggaccataagcattcaggagcactttacccacaggaagggggaaagctagattataaaatgcctaaagaggtggaaaaagagatccaggttactaacccaggactgtaaggtgtctcggaacctcctaggtatccccattatcggagaactgtgtgccagatgccattggtgtgaccaccaggctcagagaaccaggcctaggcaccaggaaaaagaaacagggactgtgaagctcagtatgcctggcagaaatggggcggaaatccttatttaagtaaagaaagtggagttgtgagtgatgcttcagataaaattttacaaaattccttacaaaatgggtggtgctcagcacgccaaaatcttagcccagagcttgggtgcaagggttgagttgagtgtagacccctgggcttgtcttcatgtcagtcagtcctgagccattttccactgtggaaaggtgggaaaaccacaagacactaaccaattgaaaaggagggctagccacggaggtgcacacctgtaatcccagctacttgggagggtgaggcagaaggatcacttgaacctgggaggcagaggttgcagtgagccaagatcgtgccactgcactccagcctgagtgacagagtgagactctgtctcaaaaatagaaaaggaagccaagtacggtggctcacacctctaatgccaatgctttgggaggccaaggcaggtggatcatttgcaatcaggaattcgaggtcagcctggccaacatggtgaaaccctatctctactaaacatacaaaaattagccgggcatggtggtgtgtgactgtagtcccagctacttgggagactgaatcacttcaaccgggaggcaaaggttgcagtgagccaagatcgtgccactgcactccaacctgggtgacagggtgaggctctgtctcaaaaaaaagaaagaaggctgggcttggtgactcatgcctgtaatctcagcattttgggaggccaaggcaggcagatcacttgaggccaagagttcgagacctgccaggccaacatagcaaaaccccgtctgtactgaaaatacaaaaaaattatctggccatggtggtgtgtgcctgtaatcccagctactggggaggctgaggcaggagtatcacttgaacccagaagacagaggttgcagtgagtcgagactgggccactgcattccagcctggatgagagagcaagactctgtctcaaaaaaaaaaaaaaaaaaaaagaaagaataggaggctgagaagtcccaagttatatgttaaaaaaaaagaaaaaaacatcagttttaggccaggtgcagtggctcacacctttaatcccagcactttggaaagccgaggtgggtggatcatgaggtcaggagttcaagaccagcctggccaaaatggtgaaaccccgtctcgactaaaaatacaaaaaattagccagttgtggtggcaggcacctgtaatcccagctacttgggaggctgaagcagagaattgcttgaacccaggaggcagagattgcaatgagccaagatcgcaccactgcactccagcctggaaaacagagcgagactctgtctcaaaaaaaaaaccatcagtttttatggacagtggtagagtggagggtgggtccctatggtgcagaagggaaattccatggtcctgctgtgcatccgactgggatggctgttgaaatcctcttccagcaggcagctttggaaacagaaaaagaaactcttcctcctttagaatcctggaagggctgtgcagtgcctctaatccaagtctgttttctgagtgaagatagggaggttcatcaccagaagggaaggggctggaaatgaggtcactgcatcccagcccagggctcctgggtcatccaggaagggaagaaggagcaagctttctcattgttaggtaggagctcagagccatcacaagaacaagttagcaccatccctgtgccctccctgttctgcaaacaaaatgatcttccttcttgccctggcactagagtctgtctggcatttctcctgcccctagtactcctcccatctgggtacttcttcccgttggtgtactgaacaaacacatccactgctttattcacagcctccagccctcattttccagggcccacaccatttgtttttactaacccgacaaggttgcccactgtccccagtaaggtttgtactggggtttttactccagtgctcttctccatccaggagacctttggatacttggggaagaaaatgagcttaaattcccacccctccccctttacctttttcctgtaaggccctggccttagttcttagccccacatccttgctggctgcagaatagcagcgggttctgggtaaggagcattctgctaaaacgctccaccctgctccctcatctgtcctctccatttgtccccatcagatggtttaagtgcttaaggggactccagggcggagtcagggagaaccctggctctcctgggctaggcacaagatcattctacaggaaaccttgtgggaattcttctgggacaaattattggtcagcgctgagcttagctgtgtctgtgacactcgcattctaactagggcctatctgacgtcaacaggaagtaaggctgatgcagtggggccaagggagtctgggagaagaaagtcggttcagagccctggctgccctgtcccacactccacccttccggcaagaatccagtccctagatgaggtggggagtgagtggtcgagttaaaaatctctgggtcgggtacgatggttcacgcctgtaatcccagcactttgggaggtgaaggcaggcggatcacttgaggtcaggagttcaagaccaacctggccaatgtggtgaaatcccatctctactaaaaatacaaaaattagccgggtgttgttgtggcacgcgcctgtagtcccagctactcgggagtctgaggcaggagaatcgcttgaacccaggaggcagaacttgcagtgagccaagatccagccactgcactacagcctgggcgacagagtgaggcttcgtctcaaaaaaaaaaaaaatctttgggccaaatctccagacagcacaggcaggtgcagaaacccaccaggaagctgcctgtgtacctctggcagattggagcctggcctaaagctgccttttatgcagcttgggtcaaggttaaacatcatgtcacagtgatttttctcactatgtgtgagacatggagaactggctccaagtactactctgtccactggtggctggactactgatgtgcaccactctccactcctctcaccctgcagtgggtcatggccccgtgccggggcagaggagaaaaatgggctgccttctccaggacaaaccctcactccaactcaactagggtgctgtgatcagaatgtgcaattgaggtgtgattttactgattttttttttttttgagaccgagtttcgctcttgttgcccaggctggagtgcgatggcacgatctcagttcactgcaacctccacctcccgagtttgagcaattctcctgcctcagcctcctaagtagctgggattacaggcatgtgccaccacgcctggctaattttgtatttttagtagagacggggtttctccatgttggtcaggctggtctcaaactcctgacctcaggtgatccacccgcctcggcctcccaaagtgctagaattacaggcgtgagccaacgtgcccagcctgtttttgttttttgtgttttgaagcagggtctcactcagttccccaggctggagtgcagtgacacgataatagcttactgtagctgcaatctcccgggctcaaacgatcctcccacctcagcctcctgaacagttgggactacaggcacaccaccacacctggctaatttttttttttctttttttagtagagatgaggtcttgctatgttgcccaagctggtctcaaactcctgaggatcaagtgatcctcctaccttagcctcccaaaatgctgggattgcagatgtgagccaccacacccagcctgattttactttaaatgagagtccctcttcagagtccctcagctgttcctggcccctggccatgtgccttcagttgcccctgcttctgtggtatccttaaggctacattcagtgctgaggccctaggcaggcagcagagagaagccaaatgattctgtctttcccttatccacccagagcatgcaaaaccaggagcagtggtgggttcagggtgggcaccagctatgtatatgtacatcagggacagggggccaaaggcagtcagtttccaaagactgccccagaggccatttttcagagaagccctgggttcctcaagggccctgtgtccatgctggcccatcttgcaggacgagcctgtggagtgggagacacctgacctttctcaagctgagattgagcagaagatcaaggagtacaatgcccagatcaacagcaacctcttcatgagcttggtgagttgactgctcaggaagggggcgtggggaggagcaggtacccagctatgtgcctgatactcagagggtcacaactgaggttatcttgggtgggcgcaagcagtaatttgtgcatacccagcctagccccaagtagactgacatctcacctggaacctattatcaaggtttggtttctctatttctttagaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaaggtgggcttcccaccccaccctgccctatgtgagggtatatacgcatgcacctgagcatgcaggggctgagcagctggccctgtctctgatcattacttccccttcacagtgtacttgcggaagctgttggatgatgagcagcccctgcggctgcggctcctggcagggcccagtgacaaggccctgagctttgtcctgaaggaaaatgactctggggaggtgaacgtgagtacatagttcttagtttcttggttgtcactagacaggactgatgggctgtagctacagtaaggcttggaggaggaattgtgctggaagacaagccctgcaaaacagttccaggagtgtataggcattgtaactaaagcaaaggcttccagaccactcatgccaaagcctagggttgtcccaagaagccaggaagaattgccttggtgctttgatctttcctggtgtggaaaatcttctggagatgcaggagtccatctaatgacatgaggaggcccccttcagactttttacctggaagctttctggctccaaggtattaggcctgtggagtgaaattagactcagaatatgcctgacctgtccacaggtaattggggaacatctgacttggttgtctcagtaaggtgaccgttttgtagggcccatcttccatacaaactgctgtcagggatcctaccagagatcattcagccaagagcctgacatcagaaagcccagtcctagcttgtgtgaacatgaggtgctagtcttctctggggagggtctgctggcttggccatcccttctgcagcctgtacactccccttttgccccttgcagtgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcctgctgttggaatcttttatacatataaagtttttgtagagacatgagtctctctgtgttgcccaggatcctcccaacttggcctcccaaagtgttgggattacaggtgtgagccaccctgcccagcctggactctttattattataggcgcagagctgcagttgcccctcatggtgccagaagttgccaagggtgatggacaggctcccaggtgtcttgcaaagtcaccatggaccaatttgtgaagatgtagtatgcatacatacttggtcatcactcagctccctggggctcaggttgtggtggagacaaaaatggactgcagttagaacttagggaaactggctgggcatagtggctcacacctgtaatcccaacactttggttgggctaggtgggcagatcacttgaggccaggagttcgaggccagcctggccagcatggcgaaaccccatctctaccaaaaatacaaaaaaaatttagctgggcgtggtggtgggcgcttgtagtcccagctactcagaaggctgaggcaggagaatcgcttgaacccggcaggcagaggttgcagtgagtggagatcacaccactgcactccgatagagcaagactccaactcaaaaaaaaaaaaacggccgggcgcagtggctcaggcctgtaatcccagcactttgggaggccaaggcgggtggatcacctgaggtccggagttcaagactgcctgaccaacatggtgaaaccccgtctctactagaaatacaaaaaaattagccggcatggtggcagatgcctgtaatcccaagtactcgggaggctgaggcaggagaatcgcttgaaccctggaggcagaggctgcagtgagccgagatcgtgccactgcacattatcctgggcgacaagagtgaaactccatctcaaaaaaaaaaaaaaacaaaaccatcccttcaacacacacacaccacgctctgggagaaggtgtggcataactccttcaccaaatacagagctgccaccgtggaccagacactgctcgtgataccgagggtatagctgttaacaattcttgctttcattaagcatggactctgctgggtttgaaaacactgaattcgaagttcttcagaactgaatgtaactatgtgaatctggccagttccttaattttctttcaacttggttagttcacataagcgtggcaatcgcaaaaatacagctgtgaaaatagaagccagatgggcacccggcggtctggccttaggccctgaagtgcaggtttgaggattggtgcttgcgaagtcctgctaggcctgaactcaggtgttgggggacgtcagagccgccaaatacacccaaaagaccgggaggactcacggccaccactttcctcggtgggagctgtcccagctggtcagatcgcgcttgctgggacctgggatctcgcaacgcatgctgggatgcccagcatctaagggcgcccattggtcccgcccccacgacttgagcaacagccaatcagaggtggcagcgtgcggaagcggaagtgaggtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcgggtaagggcatgggttccaccctggcggggggaacaggcgggcggccaggcgtcccgcgccacgggggaacttccaccgctgtaccccactacagccaagccaggacgacccccatattttgagcctcattggagctgggggtggagaaagccgggcagtggtctcctggcggcctggccactctgaaagtctccctagggaagagtgggcctgaggcttgtcactggtcggaccttccgcacggtaaagctaagctagggcctccataagacctccataagatctcttcctttcatcccttccggctcagcctgcatactgaagggtcctagcctccctttcccccccagttattccaaggggataataaccctctgtttaggctgcttttcctgacagtagtggggctgaacctttgagcgtagtggctgggaaagcagggataggcctcagtattgggggtgaggctgaggaaaaaagaccctcacccagttatgttctccagatccagagcgctgacctacccacccaacccccagcccagtctcccagaggcccgcacaagagtaccagattggcttggctctagtgggctcctggagatgggcgctccctgtgctagagatttggctgtagacaccaggaagacccaacagtggcaattcaccagccacctggggtgtggggtcaggggagacgcagccttcattcctttgtgcttcttcctagcttaggcttctgctatttcagtctttgacactgggccagcagcatcttctggagtgagaccaacatgcccaggccaccaccctgcccactctagaagtcctgggtgaaggcaaagtcctgatattagaatggctgcccttgctgaacaaatcaaggatgagaactggccttggtggctgcctggatggtgtgctctggtgtgggctctcttcttgggggtctgacatagtagcactgcccacccatcacctcacttcccactttcttctagtagaccccaaaccccaggcaaaggattctccaggcaggccaggcaccgtggctcacgcctgtaatcctaacactttgggagatgaagacgagtggattgcctgagttcaggagttcgagaccagccagagcaacatggcaaaaccccgtctctactaaaatacaaaaaattagcagggtgtggtggtgcatgtctgtagtcccagctacttgggaggctgaggcaggagaattgcttgaacccaggaggcagaggttgcagcaagctgagatcgcgccactgcacctccagcctgggcaacagagtgagattctgtctcgaaaaattttttttaaaaaaaggattctccaggcatattatcctcttttcttcccacttggggttgggaagaccacagacttccccgtgacctgtgacatttgccatgcccaggtgtggggctccagcccagcctgtttccttctccctctacacagctctatgttctatgatgaggatggggatctggctcacgagttctatgaggagacaatcgtcaccaagaacgggcagaagcgggccaagctgaggcgagtgcataagaatctgattcctcaggtgaggggctgggcagcggtcacagagcctacactaagcgtgtggaggtggacccagatgggatctgttgtcatggtgggggcttttgcggggggatctgggaggaacaaggaagcttcctgaagtagaggccctgagctgacccttactagcctctgtttccatggcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcacagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgcacatgagagtggcatcctgtgggggctctgacacccagtgtctagactaccacctgggttcaataggtaggcctggcacaggactctggcaggccccctatgaccagcaaagcccaagagtaagtctgagcccagcctgtggccatcccaactgtggccagcaggtggctgtgtgttcacacagacctcactgcaggccccctgcagggtgggagggcactcatttatctgttgtgatccatgtggtggtgacccttggaatcagaaggccctgggatacttcactaaggattggccccacctgcctgatctaaggtgagagagtgtgacccaagatagttctggaatatctgtcttagctgtagcatcgccagctgatcctaagtggggtcatggcctgacccccatggacctcaaaggcccagctttaatggacagcagccagataggtgtccccacgcctttggcctactgccaggctcagcaacccaaactcatgtgcctcctctgaggcctgcctgcggacaccatgggagaatgagctcaggctgctgtttcagcaagcaaggctcggcccactagtattgcccctgctgtctgttgcccccatcttctcatcacctgcagcctgcccactgtggtcattctgcctgcacttctcaggggctgctataaggcagattctctactaggcttaggctttgactatcagtccaactcccagttaaagaggggagatttcagggacaggcttctgagtgtagggagctggtctgccagtctttcggaggtttgaacttgtcaaggctagggcaggatcaccatatccagcctggacttgcagttctgtggggtgcctccccatacccccataagatgccaaacatgaggccctgtcatcctccatggtccccctctactggctgttcaaggcccagggctctcccatgccagatagcatcctgtctcctaccaccactgtcccagcctgagggaactccctgtgctgggcctacccagctgaccccatcgctggaaacaatgggggtcaggcaacacttccccactctctcccgccgggctgtgctcacttccttcctgctggctgcctgaggaagtgtccctgccctgggacagtctggcctagcctttgtttccccgggggtccccacccatggagctttcaaggcttctggcccctgtgaagccagcacagtggtacagggacactgcaccttcccctaccatgtcttggactccttggtcctcagggccagactcctgggtattcacctacccctcacacagccttctgttgggggagaggctcctgggcattgggccattgggttgttgaggggttggctctgggtgatttgagggtaggtagatttgcacccctggagaggtctgctggaaccttgctgcagtcctccctagggccagccacaggaacacccctcccagaggagtatacccctttcctcatccatgttgtaaggagccccctactctgtatagtggactctgaaatccatccaggaatgaactccagcaggaaagcactctgcagaaccctcccagtccatcccctcctccccaacccacacagtcacactcactaacacattgtcctgtcacacaggatgcggaagctctcagtggaaaaaaacggactcagctactggaagtccccccgaccctccccccaaggctagttcccttcttgggcacctgctctgggggaccatcagctgaacgacccccaagtattttgactcccaaaagcaccaccacctgaccccatcctctcacaccctactggatttgaggatgggccccaatcctagggaaggagtgaagaggttccctagtgttggaagctgtgggtgtgggggagattggcacctgatcctgagcccatagccttcctgtcacctggcgcagctggcggggccagatcctactcgggaagggtggggagggcagccagccagcagggcattctggagggaaacagggtcaaggcgatctcctcccccacgcctgttcctggccctttcctctcagggggcagcaggaagtgaggagaaagggctgggatgggaggcgggagcggatgggagggaatggggtttatcaagtcctcggcgagctgcccaacgggcagcagctggcgcaagtagcctagctggagaggctcaccccaggaaggagggaggccaccgacctactgggccgacggactcccacacaggtgagcccagagcagacggctggtctgcacccccacagatgcgctcgcagttgcactccctccctctcctggcgcccgggagggttaggggctggtggtgcagacgcgggcccttttgggagttgagtctcgcacaagggagcggacctaggaagagccgaggtggtttcgcacggggctcgccagggtctaagcctgccccccaccgggagaggcctgtggagcgtagggggcgctggatacgggatggaggccctgggagacccctcttgctggctttctcggaggtccagccagaaactgctgcaaggaatggaggcctcctcggggttgagagggagccgggctcccaaaggacctcagagactgggcagaaaaggacgggatctcagggatgactgtcccgccctgatgcgagtcagggagaggggcggccaacctcctagacccctctgagcttccctgaccccaaccctgcggccacgccgcgacccagagccgggctgccaggataacgactgcctcggcccttcctgggccggctaagaagcggtgcttggccccttccctcagtctggcagggggcggggcctccctttagacggcggaccagagaagggggcccctgattcgtgggaggcggggcactactctccaggagaccagaggtcgcctcaggtcaaagtccctttttccacacaaaggggacccacggctggcgtctacgttagggggtgcagagccagatctggtgctgccccctgccaacctcggagtaccacagcacctcctgatggccgaacggggcaacgcctcctcctattcccccccccccccttcccgtccccctgccttgtccctcacactgtctctttaaagggctggcggcgccgcggagctgggaggactgaaccaccggcctcgggctgcaggggaaacatttcaggctgactggcgctcgtggctgagactcccatagaaagcccggctcagaggggcattagggtcctaaatgggcggccacgtccctctgcagaggacctggggctcttcgagcccgaaacgaggcaccggcaccgagaaaggtggaccacaccttcccgccccgtccgcaagtccaatcccgggcccacctccgcactggagtcttaaagggccagcgtgcctgggggcggagccagcagaggcgctgagccgggccgcgcctgggcgaacggccggagcgggctgggctgggcccgggatggcggtggccctggcgccggtcccggtggcgccccgcgcgaggtgagggcgggcggtgcaaacctggcggctctctccccttgggctggggtctgaatccccgggggtgctcgcggagaggcgtcccagaaaccccacccccacccgaccgggcgcaggccccacgtgtggggcgggggcggggtcccgcacaaagacccggcggagcgcgctctagccctgagcggccgggcgggggaggcgagcgcgcgcattcccggtggcggtggagggaagggccgggcggccggcgccgccgtgggaggtccgctgcccctttgtccctacggggcctcctccaagccgggagagtgtcagcgctcgagagaaagtccggagagcctcactcttctgccgggcgagtgttacacggatagaagcctcccggcagcgttccttccagtttcgtagcctcttgacgagctgttccctgctttacccaaatgctgtcgtttctctggatcaagggttcttcacggtgtacagggtgggcatcagctgttcagggttctctgaaaccatgtactggatggtatgcaggcatatatgtgactctggtgagcccaaattatctagttcttagaagggtcacagacctaatagagatttgtgccgagccacaggctacctgctccagaaaagagccctgtgcttctggcagtgagttcccagggtgccttgtctgccctgcagtggcctgtggtctctcaaacctattacagccatgagcacagtgcccccacacagcatgggctttgggagcatagatgggcttgaggtgggcacttccagtattccctagactgacttgttctccccaacccttcttccagttcctgagctggtgccaggcaggtgacacctcctgcagcccccagcatgcgggcaggcccaggccccaccgttacattggccctggtgctggcggtggcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgcaatgaccagctggcctggctgtgggctgagagcacggccctcttcccgtctgtctacctggacgagacacttgcttcctcccgccatggccgcaactttgtgagcttccgtgttcaggaggcccttcgtgtggctcgcacccaccatgccaaccatgcactcccagtctacgtcttcacacgacccacctacagccgcaggctcacggggcttagtgaggtatgtgtctccagggccctgccttttttctccttccttgaggatccactgcacatttgggttatcaggggccactataggactatacctgtagtttattggctgctccacatcccctcaaatcattctgtctataacctgaaagggtgacatcattatccccatttttcagatgagaacaattgaggcacagcgatgctgagaagtttgcccaaagcttcccagcaaatccagagcagagctgggactggggcccaggccttctaactttggaatccatcctgatagctgcacctaggctcaagtgtgcccttggcttgggaaactgagccccaaaagtggggtggaaatggacttaaatgtttaaaaaggaagcaaaacaaatgagcctctgcctggacgtgaaatgggggttgagctgggagttcagcaggttgaatcaggctggggtctgccctccttgtctgttcctgtcaccctgtggtctcagtcttccccagtgaccatcccttttcctgcatagatggacctcatctctaccattggcgagagtgcggccctgggcgcagctggtgtcatcctctggggtgacgcggggtacaccacaagcacggtaagcgagacccagcctgccagagctcagtctatgggacagacagagagttagggcctttggctaccaacctcaggtgggcaatcctagtctggtccccttgtctgtctcccacccgaggcatccctggtggcaacaggaggaggtcaccccggccctgctctcaggaaagaggaaatgctgtcctgaacagctgttgagttccgcccttccccatctgcccaactgggttccggtctgtacccccacccacttctcagcaggagcagggactgtgtggctcaggtgcagattgaatgtatgaatgtgtgcagttaaaataaggtatagtcatcacagtgtggacacagtttccatctgggcctgtgggctgaggcagctgaccctgacctgtggtccttgtcttctgcctccaggagacctgccagtacctcaaagattacctgacacggctgctggtcccctacgtggtcaatgtgtcctgggccacccaatattgcagccgggcccagtgccatggccatgggcgctgtgtgcgccgcaaccccagtgccagtaccttcctgcatctcagcaccaacagtttccgcctagtgcctggccatgcacctggtgaaccccagctgcgacctgtgggggagctcagttgggccgacattgaccacctgcagacacacttccgctgccagtgctacttgggctggagtggtgagcaatgccagtgggaccataggcaggcagctggaggtgccagcgaggcctgggctgggtcccacctcaccagtctgctggctctggcagccctggcctttacctggaccttgtaggggtctcctgcctagctgcctagcaagctggcctctaccacaagggctctcttaggcatgtaggaccctgcagggggtggacaaactggagtctggagtgggcagagcccccaggaagcccaggagggcatccataccagctcgcacccccctgttctaagggggaggggaagtccctgggaggccccttctctccctgccagaggggaaggagggtacagctgggctggggaggacctgaccctactcccttgccctagatagtttattattattattattttggggtctcttttgtaaattaaacataaaacaattgcttctctgcttggattttgtacctgggctaaagtgtatgcgagattccagaatttcccatggggtttgagctcagctctgtctctatgaaaccctctgctggggacttctcgtgtaagatgtattcaccaagacttgggggcccagagctgcccactctggagctgttctgctggggcaggagccaccccagtgggagtggagggacccacattccatcccaacaccaaggacgttgctttctccgtattggttgcaagggagtcaggccccgccttgtgtgagggacagggctcattgtgtttctgccacttgcccctgtcctcccagctggaccagtgccagcctccttgccaacccaagggagaaacgtttgatcttccctgctgttcccacaggcaagggtgtctcctccagtccctgctcccaagggcagtggacaccagccacatacacctctcatcagggtcacagccctccctcggatctggtggtgggaggtgggcaggggattgggatctgaatcgtgaggttcagtccctgtcccattctagagatgcctgatggggctgggaggtggcatcttgggcctgggagcaggaacatcttctaaggtctgctccgtcctggctgtgggagagtatggctagtctctggctgtccctgaggaaagaaggagcagctggagttgtcagaccagctctgagctgcttcactagccctgcctctgacgggagtgcattctgcctctcccctcagccagcaaccccacacctggggtcccgcccatgtccgtgatgactcaccacgcagccctgcttcaggaggctctggctctggggagacagactcaagaagccgttgagtggtgagggcagccagcagcaggggagcaggggtggtgcccttggagatgcttcccacattgggttctaaaaggtgagggcggcagctcgatgctcaggaacaaatcctgggcagaggctggaggaagttggaggtggtgaaggtgaacagttcagggctggggtgtggcttagtggctgctgtgggcagaggcaggaggggcagccctagagcagcaccaggcctgacttcacctaatactgacttactcattcagtaaacgctgagcacacagtgtgcctgtgctgggctaggtgctggggatgcatcgatgatgcatctatgaaccacaccaacaaagacccccgtccttgtgggagtgacaaaatagaggtagatgcacactagatgcaaagaccgagatgccagatgggagaaacaagcccggccaagccagtgccaacccaggctgtaaagatatccttccctcacctctttcgccggtgatgggtagagaatggagaggagagagtgaggtggtaacactggaaaggtgacgtggtaaattcacacagtgaaggaggaggtgcacatacaagtggaggggtcccaggtgctcatggccatggtggggggaggccaggctggagagaagattcaggtgttggtcaataaaatgatgggccgggtgcggtggctcacccctgtaatcccagcactttgggaggccaaggcaggtggatcacttgaggccaggagtttgagaccagcctggccaacatgctgaaaccctgtctctactaaaaatacaaaaattagctgggcatccgggcctggtggttcacgcctctaatcccagcactttgggaggccgaggcggacagatcacaaggtcaggaattagagaccagcctgaccaacgtggtgaaccccatctctactgaaaataaaaaattagccgggtatggtggtgcctgcttgtaatcccagctactcagaaggctgaggcaggagaatcgcttgaacccgggaggtggaggttgcagtgagccaagatcacaccactgcgctccagcctgggcgacagagtgagactctgtctcaaaaaaaaaaaaaaaaattagctgggtttgttggtgcacacctgtagtcctagctgcttgggcagctgaaacacaagaatcacttgaccccaggaggttgcagtgagcggagaatgggccactgaactccagcctgggtgacagagcaagactctgtctcaaaaaaaaagttgccacaataagatgatggcacttagcaaaaggacagcaggaaaggagaaaggagctgtggcctgtcccccatacctgtgacttcctgcacctgtgacctcccccacacagatgtgacccatgcatacctctgagctaccccacccacacccaacacacagaggtgatccagaccacaccactgtgacctttcccacctagctatgacccctacatacctgtaacccctcccatgtgtgaccccatacagctgttaccgtctccaaataactgactcctccgcaactgtgacctctcctgcatagctgtgaccagtacccatcgagctgtgaccccctccatataaacctttatgaacctcacatttcttcccccggaggacctaaaagatggtcctagggaaagtgcaactcagggagagccagcactgtcctgtggggaaagcggggagtgggtaggaataaggtaatggggagtgatgcggctcagagatctgaagtgttgaacaaccggagacagcaggcgggactggaccatcaagctgatggaccccagacatatgcgcacacacacaccatttgagccaatcctactggaccagcccagtaggagcaggcctgtgggcagggccctggggtggaggaggatttcaggcaccctcagcttcttcctatggttccaccattagagcttctcccttggactgaggccagctggagaatgctggcctggtggttacctggattgggccaactgcagcactaggtttctgggggcacca

SEQ ID NO: 1437 - DNA, 1691 bp, Homo sapiens
tgcggccgcgtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcatagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgc

SEQ ID NO: 1438 - DNA, 333 bp, Homo sapiens
atgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcggctctatgttctatgatgaggatggggatctggctcacgagttctatgaggagacaatcgtcaccaagaacgggcagaagcgggccaagctgaggcgagtgcataagaatctgattcctcagggcatcgtgaagctggatcacccccgcatccacgtggatttccctgtgatcctctatgaggtgtga

SEQ ID NO: 1439 - DNA, 24800 bp, Mus musculus
  misc_feature (7621)..(7653): "n" at positions 7621 thru 7653 can be any base
  misc_feature (10948)..(10967): "n" at positions 10948 thru 10967 can be any base
agcggtatcgagacaaaactacgcaggcgccaagctccctcgtttccatggcgacgacgactcaagcgcttcaacggcttggcaactgccctgtcccaagactttggtcctaccgctggactctgtagtcctaagtgtttcagttttccctattcgggttgcttcccaaaaccaaaggaatcttagcccctggcatgggtgacctggaactgctgctgcctggggaggctgaggtgctggtgcggggcctgcgcagcttccagcttcgggagatgggctctgaagggtgaggcagccgccacaggtggagtcactggtcttttagtggaggagcttggaactgacattggagaaggggttgccagtgtggaggggcctccaggtgggtaggcaaagctctctgagatagaagcgtatggcccccgtgcccctctggccccaggacaggatcatggtagtcttcagtaggatccaaccccaccctcactcccgttgcacatctggtcacccaatgtacatacatcccttcgggggcaggtggaataagcagcatgagagcctggagaagctgaacatgcaagccatccttgatgcaactatcagccaggctgagcccatccaggaactgctaatcaaccatgggaaggtacgtccaggtcccaggcaggattcctgccttctattgtacctcttggggacactaggcagcacctgttcttccttcaggcctggtacacctaagtgggaaagaaaaatatgtttgttttattttgagataaggtgttgatctgtagcccagatggccattagcctaactgtgtctgcctcccaagtgccggggctgcaggcatgcctcgctgtacctggctggctacatttcctattgtaccctcagtggatgcgagagtggatggagccatggatcctaggctccagggggagtgctcaagtgctgacatgagcctgaattgactgtaaggccaaagagatcctctctaaggaggaagtgaggctttccaaatggggaaggtagcacactaggagaaagtagaagccgggaaagatgcctggctggaggctgggccaagggcggccctagttctcctgcaagagaaaggcagagctgggtagcagggattggtctaggaacagggctcagtaaagggctgaagtaagagtaaggccaggtgacaaagaccagaataaggacaggaagagcagagctgccctaaagtggggtatccctggacggagggtggggtaaggtgcaagagggcaatggcagtaaaggccattcagaggaaacacaagagagttggagacttaagacaggctaaagctgggacaggaaagctgagggaccaaggcaggtccatttcacccctgcttctcccccgtcctccgcagatcccaacgctggtggaggagctgattgcggtggagatgtggaaacagaaggttttccctgtgctgtgccggctggaggacttcaagccccagaataccttccccatatacatggtggtgagctgggccctcagagtcctcagccgagaaagatagccagtccctgtctctccctctcagcccagccccgtcctcttcgacaggtacaccatgaggcctccatcatcaatctcctagagacagtgttcttccacaaggtgagacactactctgcaggcctgagcctggtgggctatgtcggccggggagggcatcgaaccccagaaatatcccctccctgaacccccccaggaggtgtgtgagtcagctgatgacaaggtcttggacctagtagactactgccaccgcaagctgatactgctagtggcccggaaaggcggtggtgacctgtctgaagaagaacagttccaggacagtacccctatgcaagtaagctacggtttcctggacttagcaaaatctcgatgtgagttctctccagcctccacaggcagggtgaatgctatgtgcctgtacccctacccccctctcccgcaccatcaggagctgcagaagcaggcggagatgatggaatttgagatctccctgaaagccctctccgtgcttcgctacatcacagactgcgtggataggtgggccaccctccaaggcccgggggcgagcacacaacaaggggctgtgtgtcctggcccatggcctctgctgaccacccttctaccctacctctagcctttccctgagcacactgaaccgcatgctcaggactcacaacttgccctgcctcttggtggaactgctggagcacagtccctggagccggcgggtaggaggtaaggctccccctcccatttgcctaagatgtaactggctgcttccagaacacccttcaggatcagtgtgaagggtacagggtacacatttaggattctgggatacctcacccgagatgggactagagtttgactctgaggcagacaagtcctgtgaaccatttgttgaagactccaccttgttctgacgtctggtggcccaggctttctaaccttgccaggcagtggtggacagtcctccggaccacacactctcaaagataacacaacacccaccggcatccagtgggctccttctcctcccccaggcaagctgcagcattttgagagtggccgatggcagacggtggccccctcagagcagcaaaagctgaataaactggatgggcaagtatggatcgccctgtacaatctactgctcagccctgaggcccgagcccgttactgccttacaagctttgccaagggacagctgcttaaggtggagaactcaatgaccccgcccagccccactgcccccctgcccagacccaccccccaggacatcctggcctgtccctgtcccctttcacaacttgggcttcaggcatcgacaggggagctggtaagatgcaaaccctccaaggacgctcagcccaacttcaggacttcctgtctcttggccctctggctaggaacagtttctcaatgtccttccctggatctcttgcagcttcaggccttcctcactgacacactactcgaccagttgcccaatcttgccgatctgaagggtttcctggcccacctgtccctggctgaaacccagccccctaagaaggacctagtgttagaacaggtaaggccctagaacatgcttgggagtgcttgggacggtggtccacttttccggctccttcctccctgtctccattacacttttttagatcccagaaatctgggatcgcctggagagagagaacaaagggaaatggcaggctatcgccaagcaccagcttcagcacgtattcagcctctcggagaaggatcttcgtcaacaagcacagaggtaaagtccactgagtggctgaagtcacgtgcataggaccaaggagggaaggtcacctagtgcttctgtgcacctacctgccaggtccgtccattcagctcttctcgactcctcccccaggtgggctgaaacctacaggctggatgtcctagaggcagtagctccggagaggccccgctgcggctactgcaacgcagaggcctccaagcgctgctccagatgccagaatgtgtggtattgctgcaggtgaggcgatcctgggaccttagttgcccccctaagctccaaccctgggttctcctacaagccctgtcattgtcatgcaacccaccccgctgcagggagtgtcaagtcaagcactgggagaagcacggaaagacatgtgttctagcagcccaaggtgacagagccaagtgaaggccgtagctgccgagggccgacagaagagcgcacccagactgtgactgagcttcagggactcgtggctcgcccctgtcagacctcaatttccctggtgagcacagctgagtcaagtagagctgcaaaccaccacactcttcacttcctgccccacccagcgaatacgcagaggaccaggccacagcatcagcaaactggcagacagggttggggggtgtaagcaagggccggatgtggagaccctcttcctttcgcacaataaagcagactcatgaaacgcaacagtgtggcgctgtacagtcatccttggggtcgggggagaagactggacggaaagattgggaaggggctctttgaaagggcccacccctgtgccgtgccccgcccacaagtccacacggtcggctcgcctaggtttccagcgcgtcctcctcggctctttcccgccgccctgcctggatcctgggggcggtgccgaagtcgcggcccgccctgcggcctcgcccgctcggtactcactagctgctagtccgctacagcaccggcctgaccgggccatgtcggcggagccagaactcattgaactacgcgagctggcaccgtccgggcgcatcggtccaggccgtacccggctggagcgtgccaacgctctgcgcatcgccccgggtacaacacgcaatccgtcacagcagcacgtcccgggtcgtggccaccgtttccagcctgcagggcccaccacgcacacgtggtgcgacctctgtggagacttcatctggggcgtcgtgcgcaagggcctacagtgcgcgcgtgagtaagcggccccacacagccagcgactacggaaagggaggcagcaccatagttgcgggtcaagcggcagtggagggctggtcagttgtgatgatcctgcagaccagatctcctggccttgctccatcagggagagtgcttgagaaaatggtttatcacttgtcacgctctgtccgtgccagttgggcagagttagttgtctgtgaataagaaggtgcttcaagtttgtctttaaagtgcttgtgccctttcttgaaaagcctttgtgcctgctgagctctgagcctacattccgaggcccgcctcttcccaacgattggctcactgtgttccccctctagattcctgggtgacgtctcccacattaatagggggccagaaaaagttagaaccttagttaggctccttgttagtaggaattctattgaaacttcagtcaaggttgttttgagtcaaggatgcagaggctaaaacatggagtccagccacacacacaatgagtggtccttctgacctaggaattaccagcaaacagaaccacgcaggacaatttataccttccagtctcctcgcgcctacttctcctctcagacttgttgactccgttgttgaaagtggaccttaggcatcctggtttttctgttttggtttggttttttggttgttttgttgtgttttaagacagggtttcactctgcagccctggcttgcctagaactctctatgcagaccaggctgtgacaagcaacccacctgcccctgcctcccaagttctgatgtatagttttgagttgagaatcggtgctttgggccatataggaacttaaaaatggcactgtaggcctgtgtgtgcctccagatcatctcatttactatacaagtatgtcacaaactcagctagtgtagcagtttgtgacagaatgccacatgagagcaagagctgcggcatctcagcattcacaaggagaaagaaagctgctctggggttcttgtctaggaagcaagacagtttgggagataaggaagaaaccaaaggcaaatggagggtttgcttcagattgggcttacagtgataacttgttgagataggaaccctggggtggagtgaagtggggaaaaaatgacattttggccatattcattagaaatcttcattagacattaatgtgaaggcactgcacataggatttggtctgaagaggccgatcagtgctgcctgggatctggatcaggtgagtgtagacagagctgggacagtacccaggtgagaaacctggacatcaactatgagacctgggcctttatagaactaaggagaggctgctggcaagagccgcagaggagtgagaaggaagcctggccagtgggtgctgcccctgggagtcaggaggagcaagcaggaactgaaggatttaacaatccagataatgggtacagaagtcaaaacgttagacatgtccactggacattgtggctcgtggacaataatcctaacactggagctgttggaggcaggaggatcaccaagttcaaggttaccatttggggctaacctgaactctatgagattctttctcaaaaaccaaaatagacttgtgtaaacaagtggagactaataggtttttttcggccgaagaagtaagccaattcaagcggaattgagagtatgaaaggaggtttattgggggcggcaggttcaccgatcccaaggaaggaggctagggaagtcgccatgcagacagggtaagagggaggatgtgtacgcaaggagaaagaaatgcagagacagaaaaagagacagaggaggggaacgaggacaaaatgtctggattatataggtaagagcctttgggggaggggaagcccagttctggtatgccagctatatcctgcaagaggtgtgggctaagggatgctcggggaatctggaggccaggtctgctttgatgcgttacatatgcacctctgcagctcgtctgaaacccaacaacaggggcagaggacaaatacaggaagtcgtaaattaaatgcctttgttttcaagttaatggcaaagctaagtaatagctcggcacaagtgttaagcatgcttggatccctaaccgcctgaggcctcccagcaagtgtccagaggtgcctaaccgaggcctctgggatcgggatagcagtgggcggtaaccggctggagaaaaggccagtgagccccaaaacctgttaacagaggctccctcattcagtgggtcacttcgccgagctcccccgcctcacggccagccctttctgcagactgcaagttcacctgccattaccgttgtcgcgcgctcgtctgcttggactgctgcgggccccgagacctgggctgggactctgcactagagcgggatacgaacgtggtgagcgcggggtcgggggagggcgggccgggagggaagccgggactcggcggaggtgtgcagggttaatccctacgccgtgcataatgaacaccccagtgatcaatttcccggcatcagagatgctagtttcgctggcgggtttgtcaggcgaaggcgctccctggctgggagcacgcgcacctctcacaccccgcttccggccctaagggcagcggcggtgcacatgcgcacacgccccggcccgctgggaggcgggacctgagaggcggagccgagtggagatgcctctgcgatgaggtcatccgtcgagctgtagcgtcgtggccccgcccctcgacgtcttcaccccctcacccacctcgacaccagagctaaagtcgggctgtctaggtttcagtcctaacggttgccgcgcggcgctggcctccgcgcaagcgcgacctgacacgctcacacgcacgcacgcacgcacgcgcccgaggcggtggttagaggctctccacgcagtggactagggatcgggcgggtaaggcgatgggcgaggctgaaacaccttccttcgaaatgacctggagcagcacaaccagcagtggctactgcagccaggaggactcggactcggagctcgagcagtacttcacggcgcgtannnnnnnnnnnnnnnnnnnnnnnnnnnnnnnnncccgagtagaagcccagttccagcgcgatggtactgaggacccagggctacccctgcccttgcagtcacagaccggttgagccagggggaatcaactctgaagcttgaagggtggaccacaggcgggcgtttttcacccatgactaaagccagcctcgcaatccaaaccggcgtcttgatttcgcatttgggcgctcccactccctccctgggggaaatgaggaagtggaggaggagtccaccgggaagtgagaagttagtttgggaggggactctggccgtgccgtatgcggtcttggatcagccagcaaagtgcccagccgttgctcgaccaactctttgacaccagctgctggactcgatctttctttcctccatggtggaactgtgcagagggatttggggaattcaggaagagggccttaaaagactattaaaaaaaaaaaagtgtggtaccagggcagctgaacctctttaaaaagtctagatgtgcccaaattatccgactttctgggaatatcatagttgtggccaccaagctcggataacttgttctggagcgggaatccctcggaacagcacagaggccagcgaatcaggaaagtgaggacggagactgaggttagaaaacttagtagcactgaactagaactccttatttgagccaagaaagtggaattgtctgtgatgctgtaggtgagatttgatataaatttcctacaggtggactgctacttgacacctccaaaaccttagtccagactttagactcaatgtggggtgggagtgggggcgggagggtgtctctgggattgtctccataccactcaacctgagtcatcttctattatggagaggtgggggaaaatataagatactggccagttgaaaggcatacaaagagaagaattgtttaaaagcagctgaagtttatagctgacttagctgtagagtgcttagcattatatgtgtgatggatggcctgacttccaaccattaaggaaccaaaaaataagaaagaagaaaaggaagctaagaagtcccaaagagcagagtaaaagcctgagggctggggctgggctgcaggttcaatccccaacccagaccctcctagaattctcctgggaccaggcactgcctagcggtgatcccagctgtgtttgttccaattgcattccaatttagggcctttctgaaaccaacaggaagtaagactcacactgggagttgaggactgactgctcttccagaggtcctgagttcaattcccaggaaccacatggtggctcacaaccatctgtaataggatctgatgccctcttctgatgcatcagaaaacagctacagtgtattcacacatatataagtaaataaatcttaaaaaacaaaaacaaaccaggaagtaagactcaggcagttaggtcaagtgagtcctggctgccctgagcagcagggtgactccaccctcccgcagttcctgaagaaccttgtctctgggctaagtcttcagacagcgagggggaagaacagaagcctccctgcttgctgctggtaggacaggctctgctgggaaattgcctgtacacctctggcagatgagaacctgaattgaagctgccttctgtgtagcttgagtcagagggtaaatggtatgtcccagtgttacttcactatataagatgtggtgtggctggtcccaagaaacccactaaggcatcttacattatagagatcagctttcctctcctgtctactgtagttagactgctgatgcaccagctcccgtgctgcctaccctctcgggggtcatgttctgtgctgccgcacagtgggagagtgggctttcttctccagaacaaactgaccaaactagtgttctgggttcagctctacagtggagatgtgattgagatggggttttaatttttgtatgtggtgggggtggaaatcgaagggccttgtacattctgggaaattactctatcactgagctacattttatcccccaaagtgtttatactttaaacaagatttttcccttacagtccttcatggtttcctggcccctggacatgtgccttcatttatctgtttctgtgatgtcgttaggggccacaaccagtgctgaggtggccccagatagcagaaagccaaacggattctacctgtccttgctctctccatctatagcatgtaaaaccaggagcaatgatggcttcaggatgtatgggtttggtgacaggaccaaaatcaagttccaagccagaaggaccatccccatccccaccccacccaccaaagagccttggccttttcaagggccctgtatctatgctggcctgtctttcaggatgaggctgtagagcgggagacacccgatctttctcaagctgagactgagcagaaaatcaaggactacaatggccagatcaacagcaacctcttcatgagcctggtgagttggctgttcaggaatgtgggagaacagaagcccagctctgggccagatgtccagagagtcagagcaaagtattctggggtgtacccaagcagctatctgtgcagacctggctttaccctgcccctggacgactcaacctaactcttccatctccagtagaacttcctgacatggcatggttctccttttcctttctttcttttcagaataaggatggctcctacacaggcttcatcaaggttcagctgaaactagtgcgtcctgtttcagtgccttccagcaagaaaccaccttccttacaggatgcccggagaggtacggggcggagcacagccgtgaagcgccgcacctctttttacttgcctaaggatgctattaagcatctgcatgttctatcacgaacacgggcacgtgaggtcattgaggccctgcttcgaaaattcatggtcgtagatgatcctcgcaagtttgcactctttgagcgaactgaacggcatggccaaggtaggtttccagtctcagcactccctgtgtaagggttatagatcacatacctgtgtattaaggggctgaggcatctgagtctgtctttgtttattttcccccgcccaacctccagtatacctccggaagctgtcggatgacgagcagcccttgaagctgcggcttcttgcagggcccagtgaaaaagccctgagctttgtcctgaaggaaaatgactcgggagaggtgaacgtgagtccgtagtccttcttacttactttcttactttcttatcactaacaaagctagtgggggtgtagccatggtgaggatttcagggagaaaccgggnnnnnnnnnnnnnnnnnnnncacagcctgtccaagaatacacaggtcctctaatggaagtttaggcttccaggactctttgttttgttttgttttttgaaacagggtttctctgtatagccctggctgttctggaactcactttgtagaccagaatggcctcgaactcagaaatcctgcctgcctttgcctcccaagtgctaggattaaaggcgtgcgctacctctgccaaacagcttctgggactcttaagccaaggtctagagcctatcccaagaaactataggaagaagctgaatctagtggttcatgttataatcactgtactggggaggctgaaactggaggattgttacgagtttgagatcagtctggactaccaaaacaaacaaacaaaaacaaaaaacacacaagctaggaagaattgtcttcaggctttgttgtttcctggtgttgaaaatgagaacttgactaactcatagtgagccaagaccagttcagagctccatatatatgggctcagagatggctccacagtgcagaggatccacattctgtttgaagcactcatatcaagtggctcccactcacctgcaactccagcgccaaaggatttgtcttcctctgctggcatcagagggtgcctggagttatgtgcctgtgaccccacgcgcatgcgcaagcacacaactaggacaataggaaagatggctcagtggttaaaaacatgtattgttcatgcagaggacctggatttggttcttagacgcatgtaaaagcttacagttgcccataattgcagaccatacacacaatgtgcatacctgcgtgcaagcaacacacttatacacataaaacagattttttttaaagactttgtgtatgaatgttttgcctgcatgtatatatgtgtacacgtgcccacagaagtaagaagaaggtgttggctctcctagaacagagttacagatgatggaacccaccatgttggtctaggaattgaactctggtcctcttcaagagcaaccaatgctcttaaccactgaactatctttcgagcccctgaaacaaaccttaaaacaaaaagaaaaagaaaagagctttgcaggtataacctgaaaaacataaaggcctcttggaagcattgagacggtctgccagctaggacagatggcacaggcctataatctcatctacttgggaagctaaagcaggaggattgcctcaagttcaagactaggctggcctgtatagcaagatcctatctcacaaacaaacaaaccactcttcctagcaaggcctagggacagtggcttatactctcaactacttggaatgctaaagtgggaggatcactagttcaaagccttcctgggctacagagtgacttaaagggcaatctacgctaacttaatgagatcctgtctcaaaagtaaaaaggcttgggactgtagttcagtggtaaagtgttgagcaagcttagccctttgttcatgtcttagttaggtcttctattgctttgatgaaacactatgaccaaaaccaagttggtggggaaaaggtttatttatttggattacagttccatatgataatccatcattgaaggaagtcagggcaggaactcaaacaggacaggaacctgaaggcaggagctgaagtggaagccatggtgggcgctgcttactggcttgctcagcctgctttcttatagaactcatgaccaccagcccaggggtggcaccatacacaatgggctaggccctcccctatcagtcactcattaagaaaatgccttaaagctatagcttgtggaggcattgttttcaattaatagagaattaatattccctattttcagataactttaacttgtgtcaagttagccgaaaactagatagcacagtgcaatttccagtaatgtaaaaagaaagaaaaaaaaggacaatgactttttacatcggggttagttgtggcttagtggtaagaatagacgctcagcatgcacagagctcggcagcaaaaaaaagaaaagaaaaagaatagggtgggtacaagggctgtatgggaatgtagcttggtaaaaggtaatttgctaacatttatgagaccctaggtttgaatcagagcccattatattgagggagagaatatgagactatgcgggagaatacacctaacaacagatagagatatttcactacaaggagactgttttgtaggatctgttttctatacagactgctcatgaggatcctagcacagaccatttagtgaaaagcctaacaccaaggctagcattgtgataaatacttgtaatctcagcgttccggaagcagaagcaggagaatcacaagtttgagactagcctgggctacatagcaagttaaaggccaacctttgatatgtagaaagactatgactcaaaaaaacaacaaaaaaaaataggggacttaaagagttggcttagcagggctggagagatgggtcaacgattaagagtaccggctgctcttctgaaggacccgggttcaatacctggggttcagttcccaatacccacatggcagctcacaactgtctgtaattccagttccaggggatctgatgccctcacagtcttacatgcaggcagaataccaatgcacataaataaattataaaaccattaaacaacaacaaaaggagttggcttagtggttaagagtacatgttgttcttacagaggacatgggtttgatgcctagcacccagatggcagctcacaaccatctgtaactcttaattctgggggatctgataccttcttctgacctctatgtggaaacatgcatacacataagataataatgaaatgaaaaggaggtaatgtcaggagcgcagacctgctcatgggagaaccatcatggaccagtcttggaggagggtctgccaacttagctattcattgctgcagcccgtgtatctctcctctgccctttccagtgggatgccttcagcatgcctgaactgcacaatttcctacgaatcctgcagcgggaagaagaggaacaccttcgccagatcctgcagaagtattctcgttgtcgccagaagatccaggaggctctgcacgcctgtcctttggggtgaccttgggtctccatggatgacaggaggagaacaggcagtgcaaagagcgtgccgtgtgagtgtgacagggcctgtggggcctgaggagtgcgtgtgcatggaggtcctcctctgctgaccgggatgagcccagagaacagggaaagagccagccgtctacctgtggatatagtggggcggggctttgcatccctctgcccgtatgtactgggtcatactctgcgtagctgctcaagtcacagggtcgcagctgtgagaatcttagagactctacagacagaacaaggttatattttcacgggtaagagaccttacctatggaggaagattgttttgagtcatgaatgggtctcaggatagccctatcagagccaagggtagctgctcagaataatacaagcaattaaggtagagtctggggttccctcttaccgtgccttctgacttccaaacaaacaccctggggtcagagagggctggccagtacaacaactacagtggctcagtcagtgcctcctctaagggaaaggttgctggaccagaccctcttcttgtttgccaaagccagagtctccctcagatatttttgatggaagtgtatgaatgtatgtaatgttttgtggcctcaactgaatgcctcctgtggggaagggatgggggtgtgacagtcatcatcagggcctgatgcctgagagaattggctgaataaagatgtaagaatttttctggttttggactctatagatgtgggcccccagtcggggtaacacctaatgaaagactgccaacaaagattgacacatccagagtgcaccctctccaaggtcgcagtgggaccaatatgttcaggaaatgtatgcctgtggattcaggtgtctttcaaccctccagggctcaggtcatgaagagacaagaataagctacagttactacacaggaaacttttttctccaggccaactcagagaaaccatagcagtaaccccttctccaaaaaactactcgtgggtcccacacttcacatgctaccaggggaaagctggtaataattattttcctgaagaatgttctctggtgaacttacaacacttagtttaagttccttcagacctcaaatatactcttaagaaattgatcaaaaaagttttaaaaagaagtttggctccctgtgcggttggtcactcctttaatcccagtattcgggagacaggcatttgagcgtcagccatttatacatggcaagtgccaggccagctaaggctacatagtgagaccctgtctccaaaagaaaaaagaaaacaaaaacattaagcaagatccgtagtttctttacaggcaaatgtgacaactgcaaagacacagttgtgaaaacagccaaccttagcctcagacaggcctaaggtcccttaggggtggaggggtgaccctaattgactattgctactgggccggagttttgggcgtgtcagggacgtagagacaactataccgggtccgaccttaaagtcaacaacaacacattacctccgcctttctggaagggagctgtcccagctgacccttgggacccataggcttctgggacctggaggcagcgcatccctgtggtggtcagcctctgagagtggccattggttctacaccacagactgacgagacctttagccactcagaggaggcaccgtgcaggacgcgcggaagcggaagtgaggtttccgtggagacagcagagcctgcggaaggcggcggcggcggcacctgcgagtggaagctggggcagggcatggtcgcgcccgccgcgctgtgagagcggagcggccgctgggtccgccatgcgcccgcggcgctgacatgggcgccagcggctccaaagctcggggcctctggccctttgcctccactccggggggcggcggcccagaggcggcaggctccgagcagtctctggtgcggtctcgagcccgagcagtgcctcccttcgtattcacgcgccgcgggtaagggcatgggtatctgcctttgggaggacatccgggaatgagaaacgcccccctacatttgaatcagacgactgtcatattttgggtcccagtcaaagcaaggagaagggaaaaccaagcggcgttcagctcttgaccgcccagatggtctttttagagaattgcctgaggttcgtctcttagggagcagctccataattcagctaagacggcatctaagagtcttaaaacctccctttcatccaactcagcctgcaaattaaaggcatttatgtcccttctgttcttctaagccttagaagaaatctaagggaagatgaccttctgtttaggtgtcttgccttcctcactgtgaagttggacctccgagaatagtgtctggaaaagcagagaaaggcgtcagtgttgaaggtggggccacaacaaaaaaagtgccctcaaccagttgggttctctagatctggaacactaacctaaccttcttttttcccaggtgctcacacaaaatggcctggacctagtgagctcctagggactggcattccctgtgatggaaatttgaccgtaaataccagagagacccaacagtgtcgattagacagtgccagccactggggaatgacttggagtgcagccttctgggctcagacatccaccatcttggtctttggccctggaccagcagtgtctttagaagtgagaccagtatgcccaggccactaccccacccactccataaataagccctaggtgaagggcctgctactagaatcatgacctttgtgaaacagaccagtggtgaggactaactttagttgcctagagagggtgctctgatgtgacatcctgttggtatgacagggcaacagtggccttgtcacactgcctgcttccctccgggcaccaagcaaagagttcttccacggagattaccgttgtgcgtcttctcttggggttcagcgtacttccctgtggtctgtggcccttgccaaggccagggatgaggctccaatccagcctgttccccttctctccacagctccatgttctacgatgaagatggagatctggctcacgaattctatgaggagacaatcgtcaccaagaatgggcagaagcgagccaagctgaggcgggtacataagaatctgattcctcaggtgagggtccgagcagtgatcataaagcctacatcagtatgtcaacggagatacagatggggctttctgggggaagagctgggaagaacagagaggctcttagcatagaggcccagagctgatcttcactagcctctgtttccatggcagggcatcgtgaagctggatcctccccgaatccacgtggatttccccgtgatcctctatgaagtatgaacctgtgtgtggcatggcagacacgagcacccactgccccagcaagaaactcccaggatcaaggtgtagcttccattcaggagtccaggctggtgccacaaccttgaataaactaaactccgttggcccagaaccttcagttgtaagaggggttgtccctcagtgttaactggtattggcggatgtctgaacaataagaggttggtggctggtgagggctaaggacagaattaccagcccgtctcccccagccgcttgtgggagaagcatgacaggagacacgtgccggtcaggaatgcctggttcctggttacctgcctgacctgctttcttccaagcttgcctagggcccagccctcctagaagctacagcactttacaagcagagtctgccttcttccagcccctgggctgtaggggctctacccaagtgggaacttccttttccctcactccccttcccccctagtcagagcatttcagccgtttgctacctcgattcctcctgtatcggacagactggagatacataccagcctcacccttcctgcctacctaccacatgctcccgctcttaagctggacactttgctggctgttcaataagaatgaggaccagtgtgggaggcttctcctttcacccagggctggactgatctctcttgatttcaaccagttgccctcaagttgagagggtacaggccggggtcaggacaggctactgacgcctgtacctgtggggacttgccccaaaccacatattcgtcgtctcccttgtctttgcaccagtcccacaaatccccagttgtaggggagaggcagtccaccacctagtggtaagaaacgactggggctggtgccagtagctatgaggagcccatccccccccttctccttacagtatctttaccccttcagggtctgttaagagaaagtactggagctccttggtaaggatagaaaggaggggaaaatacataagaggcataattaaaatgtgaaggtttgtaaatagtctagactatgataatgttggggcagagtctgatttctatacagagatggctttaaaaaaaatacttccttgtggaagctctgtgcttctagagtgtgggaaatggcttgggacgagtgatccccagcacaggaaggctgttgtgttatttgttcaatttcaataaaagttatttgtagaccctgcacacgagagtggcgtccagtgagactttaacatccagtttctagactgctgatccggtaaggctagcaaacccttgcctgaacattgcctgtagcaataccagccgtggccaacaggtggctgtgtccaagaactgtctccagccctctcaagacgcagagggccactcacctgtccattctgtctgggaatttggaaacagaaggtcgtgtgggatcctagggagattgccctagtctgaggtgtgagtgtagccacacacacagttgtgagatggttctggtcccaacaataccagattatgtgaagtgaggttacagcctaaaccccacagatcaaggcctacctatacttgaacaacagacacttcccaccatggccttggcctccttccaggctctgaagtccacactcacctgacttcccaaggcagccatcagaaaggagagcacaggcttctgctgcagcctctattgtagggctcggcccaacacctcctcagctctctgccgccaatggacattctgcctacgtttctcaaggtcggctatgagcaggttctctgctcgcctagcctttggccataataaactcaagacgtttttaaaaagcaaaagcaaaacaaacaaacaaaaaaaaaaaccaattgggaagcaggagtttatcaactcagggcagttggccttcaagttgctcaaagctggaactggtcaagtcttagcctgttcaacatagatttgcggttctgtagaccaactgtcatccctgtaaaaagccaggagttaggttcctgtccaggagccaaggctccccatatcaggcagtatcctatctcaccaccaccatcctgctcgggaaactccctgtcctggacctgcctagctaaccccaaagctatgaacaataggagagtcagggcagtgtttccctactccatccggctgggctaggctcacttccttcctgctggcagcctaaggaagtgtccctgccctggacagtctcgcctggcctttgttttcccagtagtccccacccttggagcttcctagatttttgtcccttgtgaagccaacacaatggtgaccacagcctaggctatacacccagctctcctgctttctattggcagagggactccctagcactggggaggtgagccccttggaccaggtgaggggttgtcagtttaggtagatttgaggtcaggcaaatttgcctggacctccaaagaggtcttccaggaattcctattgtaagtttcctctcccatagggacacaattctccccccaccccatatcacacagccacaggcatcaacacattgtcatattgtctttgtcacaggttggatacttccgctctcaatggaaaaaaaaaactgactcagctactggaagagcccaccacccccaccccacccgttttcccctcgtgcaggatggtttcttctttggcacctgctctaggggaccattcgctcaaccacccagcaaattgactcccatgaatacagccagccacttgggccccctcacaccctactggatttgaggatgatgcaaaacttggagaaagatgagcccttggttcctaggcccatatccttcccatcacctggcacaactcatgcagaccttcctgggaggaagggtgcaaagggcagccagccaccaagggaaacagggtcaaggggctctcctccccgcccccctggccctttccgcctggagggcagcaggaagtgaggagaaagagcagggatgggaggcgggagggagtgggtgggaaggaatggggtttatcaaatccccagcagactgcccagagggcagcagctggcgcaaggaacctggctggagagactctactcaggtgagcgcagagtagtacataaagctagtccgcactgccataaatgcgtgtactcctgcggcgctccctagcttccaagcttgcggtagggaaaggggctggcggccagaagcggactttcggagatttgagtcgtgcattggagagcagatctaagaggcgagggtacaggtctaaacctagtcctcactggaaggggattgcaaggcagaaaggttcagaatatggagtcggggtactagggagacactgaagcctcctttctacgaagtcaggcccgaaactttggcaaattgctctttatttggagttgagtgggtacccctatggacaaccatcccaccttcacctcgtcgcagagactggtctggggagaatccagtaaattggcaagccctggcgtggatccggtgaaagtggctagatcactttcccctttggcccgactgaacttcaatccctttggcaaggcagcgacccacccccctggttaccaggacaaccactacgtctgctttgccaaaggagggctcagaagctgtactaggccccctcctctagacgagcaaaaggcggggtttccttctgaccgcagacagactagtggagggaacctgggctcagcgaaggcgggtcattaatgttccaagaggttctggatccactcgtgtcaaaatctcttacactagacaaagggcccactttgctagagtccatattcagacaggtgggattgaatccgcagctacccccagtcaaggcttcagctataagcttttatttcaaatgccattaccaccactacaccctcattccgctcgcgcccgccccatccaatgttctatccctttaagaggccagctgcaaagagtggattgttccactgacgacagattgtgggggtaatatctcaggctggttagctctggtggctaaaaccagcgggaatccccattccaggaggtattcaatctcagatacataactatgttcctctacagaagatctaagggtcctcgaactcgaaacgcagcactggcaaaaaggaagagaaacacaccctccctacgaggccgtaaattctgccatccacccacctccgaggcaggattcttaaagggcccgcgggcctcggggcggagccaacagaggctcgagctggggcagtgcttgggcgaagggccggatcgggcttggttggtaccaggatggcggcggccctggcgtgggtcctggtggcgcctggttcgaggtgagggcgggcgtcgcaagcctggtgactctcttcctgtgagatgggctctgaatctctaggggcgccctcataagtgacccaggaaccccacccccacccggctgaactctggccccacgtgcggggcgggggcggggtcccgcacaaagaccggagtggaatactctttacccgggaccccttgtgctgggaggtgagggtgtgggccggtcgcgaagtgctcacacagattcttggtggctgtggtgggaagggcaggtcggcgagcaccgcggtgggaagtccgctgcccctttgtccccggggcgcctcctcctatcctaagagtgtcggtgcccgagactaagtcctgacgttcttgctcttctgcttggcgcacattgcacagatagcagttcctctgcagtgtacctaacagcttcccagcttctgtatgcgttgtgccccaaatgctgtctcttctcagaatcaattctgagttcgtaatgagggtgggggacatggggtgttcagagtgttttaaaactatttactgtatggtatacaggcatgtaagtgactctagcagtgagtcggtagcctaatcagtccctttttcagaaaggatatggacctaaaggagattcttgcccaaccacgggcagctccctgctctagaaagagctctgtggtttcggtaaattccctaaggtcttttgcctacccatcagcatcctgctatctcccaaacctgttacagcctcggccatctgagcaggagcatggtgtgccgcacagtatgggtttggggagtttatgtgggatgaaggtgcgtacacatctctggaatttgctagactgacttgttctctctcacactttcttcagttcctgagctgctaccaggcaggtaacacttcctgtagcccccagcatgcgggcaggactaggtcccatcatcacactggccctagtgctggaggtagcatgggccggggagcttaagcccacagcgccgcccatcttcactggccgaccctttgtggtagcatggaacgtgcccacacaagaatgtgccccacgccacaaagtgccactggaccttagggccttcgatgtgaaggctacaccgaatgagggttttttcaaccagaatatcaccaccttctactacgaccgtctaggcctgtatccacgttttgatgcagccgggacatctgtgcatggcggtgtgcctcagaacggcagcctctgtgcacacctgcccatgctgaaggaatctgtggaacgctacatccagacccaggagcctggggggctggcagtcattgactgggaggaatggcggcctgtatgggttcgaaactggcaggagaaagatgtttaccgacagtcttcacgccagctggtggccagtcggcaccctgactggccatcagacagagtaatgaagcaggcccagtacgagtttgagttcgccgctcggcagttcatgttgaacactctccgttacgtcaaggcagtcagaccccagcacctgtggggcttctacctctttcctgactgctacaatcacgattatgtacagaactgggagagctacacgggccgctgtcccgatgtggaggtggcacggaacgaccagctggcctggctctgggctgagagcacggctctctttccctctgtgtacctggacgagacactggcgtcctccgtacacagccgcaactttgtcagtttccgtgttcgggaggcccttcgagtggctcacacccaccatgccaaccacgccctccccgtgtacgtctttacgcgtcccacatacacccgaggactcacggggctgagccaggtacgtgttctcccttcctctgggagccactgcatgcttgtgttatcggggaccagaagtactattccatatctgttttagtcttgtggaagggtgatgtcacccccattctgtagataagaccgaggcccagagatgctgagaggtagccaggagcctgtagcaagtccgtgaaaagtgcacagaactaaaccaggcatcctgactttggggtcagaatgtgtaacctttgactttgtgggctcatgcgtgggctcttggccttggagactaaggtccaaggtgaggatagaaatgggcagagcggcctctgcctgtctagaactgtcctaaggtcagcaggttagagcaggtctgttctgagtctcctgcgacaccgtctggtgccagtcttgctcaggaaccatccctccccacacaggtggaccttatctctaccatcggtgagagtgccgccctgggctcagctggcgtcatcttctggggcgactcggaagacgcttcaagtatggtaagggagacccacctggccttccagggctgatgaagagtgtatactttggcttctgccccccacctgggtgtacacactgagtatagcttatctcctaagcatagcagctttgtccctggacccaagagggaagaagggcacccccaccctgttcccaggaagaggaaatgctatcttgaacagctggagttccgcccttcctcatccacacagctgggctccagtctgtctcaaccccgcttctcactagggacaggggactgactataaaggctcgggaactctgtgtatatgtttacatacatatgcaaataaatatgccagggatgtgcctcagtagagtgcttgcctagtctagggttcaaactccaccactaccaaaagaaagaggcgctatcaccacagtttccgtcggggcttgggcaaaggtagctaacatcagacactcactccttaaccttggccttttccaggagacctgccaatacctcaagaattacctaactcagctgctggttccctacgtagtcaacgtgtcctgggccacccagtattgcagttggacccagtgccatggccatgggcgatgtgtgcgccgcaaccccagcgccaataccttcctgcacctcaatgccagcagcttccgcctagtgcctggccataccc

SEQ ID NO: 1440 - DNA, 1564 bp, Mus musculus
ggcacgagggggatcgggcgggtaaggcgatgggcgaggctgaaacaccttccttcgaaatgacctggagcagcacaaccagcagtggctactgcagccaggaggactcggactcggagctcgagcagtacttcacggcgcgtacctcgctggttcgcagaccgcgtcgggaccaggatgaggctgtagagcgggagacacccgatctttctcaagctgagactgagcagaaaatcaaggactacaatggccagatcaacagcaacctcttcatgagcctgaataaggatggctcctacacaggcttcatcaaggttcagctgaaactagtgcgtcctgtttcagtgccttccagcaagaaaccaccttccttacaggatgcccggagaggtacggggcggagcacagccgtgaagcgccgcacctctttttacttgcctaaggatgctattaagcatctgcatgttctatcacgaacacgggcacgtgaggtcattgaggccctgcttcgaaaattcatggtcgtagatgatcctcgcaagtttgcactctttgagcgaactgaacggcatggccaagtatacctccggaagctgtcggatgacgagcagcccttgaagctgcggcttcttgcagggcccagtgaaaaagccctgagctttgtcctgaaggaaaatgactcgggagaggtgaactgggatgccttcagcatgcctgaactgcacaatttcctacgaatcctgcagcgggaagaagaggaacaccttcgccagatcctgcagaagtattctcgttgtcgccagaagatccaggaggctctgcacgcctgtcctttggggtgaccttgggtctccatggatgacaggaggagaacaggcagtgcaaagagcgtgccgtgtgagtgtgacagggcctgtggggcctgaggagtgcgtgtgcatggaggtcctcctctgctgaccgggatgagcccagagaacagggaaagagccagccgtctacctgtggatatagtggggcggggctttgcatccctctgcccgtatgtactgggtcatactctgcgtagctgctcaagtcacagggtcgcagctgtgagaatcttagagactctacagacagaacaaggttatattttcacgggtaagagaccttacctatggaggaagattgttttgagtcatgaatgggtctcaggatagccctatcagagccaagggtagctgctcagaataatacaagcaattaaggtagagtctggggttccctcttaccgtgccttctgacttccaaacaaacaccctggggtcagagagggctggccagtacaacaactacagtggctcagtcagtgcctcctctaagggaaaggttgctggaccagaccctcttcttgtttgccaaagccagagtctccctcagatatttttgatggaagtgtatgaatgtatgtaatgttttgtggcctcaactgaatgcctcctgtggggaagggatgggggtgtgacagtcatcatcagggcctgatgcctgagagaattggctgaataaagatgtaagaatt

SEQ ID NO: 1441 - DNA, 813 bp, Mus musculus
atgggcgaggctgaaacaccttccttcgaaatgacctggagcagcacaaccagcagtggctactgcagccaggaggactcggactcggagctcgagcagtacttcacggcgcgtacctcgctggttcgcagaccgcgtcgggaccaggatgaggctgtagagcgggagacacccgatctttctcaagctgagactgagcagaaaatcaaggactacaatggccagatcaacagcaacctcttcatgagcctgaataaggatggctcctacacaggcttcatcaaggttcagctgaaactagtgcgtcctgtttcagtgccttccagcaagaaaccaccttccttacaggatgcccggagaggtacggggcggagcacagccgtgaagcgccgcacctctttttacttgcctaaggatgctattaagcatctgcatgttctatcacgaacacgggcacgtgaggtcattgaggccctgcttcgaaaattcatggtcgtagatgatcctcgcaagtttgcactctttgagcgaactgaacggcatggccaagtatacctccggaagctgtcggatgacgagcagcccttgaagctgcggcttcttgcagggcccagtgaaaaagccctgagctttgtcctgaaggaaaatgactcgggagaggtgaactgggatgccttcagcatgcctgaactgcacaatttcctacgaatcctgcagcgggaagaagaggaacaccttcgccagatcctgcagaagtattctcgttgtcgccagaagatccaggaggctctgcacgcctgtcctttggggtga

SEQ ID NO: 1442 - DNA, 27589 bp, Homo sapiens
acaaataaaagtgccggttaattacaaaaaaaaaaaaaaaaaaaaaaaaaaatcgtcctgatgcggtgactcacctgtagccccagctactcaggaggctgaagtggggggatcatttgaggccacgagttggaggctacatttagctgtgatcccatcactgcaccccagcctgggtgacagagcaagaccccatctcaataataataataataataaataaacctagaaagaagcagatgtagccaggcgcggtggctcatgcctataatcccagcactttgggaggctgaagcgggcagatcacctgaggtcagatgttcaaaaacagcctggccaacatagtgaaaccccatctccactaaaaaaaaatacaaaaaattagccaggtgtggtggtgcacacctgtaatcccagctactcaggaagctgaggcaggagaatcacttgaacctgggaggcagaggttgcagtgagccaagatcatgccactgcactccagcctaggtgacaggagactcaatttcaaaaaaagatgtgatcaagagtgagttgggttggaggcagggactgctctggattaaatggccaagaaaggccatgctgaggtgtaaactgagccctgaaggaaaagtattccaggcaaagtgcaaaactctgaggcaaaaacctctttggaatgtatgagggaggttcagggaagcaaggaggagaggaaagaatccaagtcccgaggtacaggagaggacaagaagtagatcttgcagagctgctagtaagcggcatcccacctaacattttgagggccagaagtagccacagagcccctctcacgcaagggagtaatgtctatatgctttttttttttttttgagacggtctccctttgttgtccaggctggagtgcggtggtgcaatcttgcctcactgcaaactccacctcctgtgctcaagcgattctcctgcctcagtctcccatgtagctgggactacaggtgtgtgctaccacacctgtctaatttttgtacttttagtagagacagggtttcaccatgttgcccaggctggtctcaaactcctgacctcaagtgatccgcctgcctcggcctcccaaagtgctgagattacaggtgtcagccaccgcgcccggcctgatatacacttttaaggctccgggctgtccatgaggatcaagcgtggaagtaggtctacagaaaaggctgccgcagttcacccatgacaggtgatgacagtctggacatagggaggatggagagaagtcgtgcgccctggcagtatttcaggagccaactagtggagccgggacgcgagaaatagaggaaccaagaagccataaggaggaggaagagcagcgggtaggtcaagatgccacagccgcaggaggggctgttggggtcggggttacccccatccctgtgcaggcggacttggcgtctgaggacagagtccagaccacaaggatctggagctcaggagagactcgtgggccacagcccgagaaagcgctgggaatccaaatactatggcgattggcagtcgcgtaggcgaggcgggctagagacccgcccggatttaggcgcgagccacctccaggggcggggcccaggccgcactgcgcaggcgcggctaacccgtttccatggctgcgagaactgacgctccccaaccgtcccgcaactgtcctgtcccagactttggcaccgtcggggtccgtcgtccccgaatgtgacagcatccccaccccggctgctgcccaggatccgccggaccccggcctcgatatgggagacctggaactgctgctgcccggggaagctgaagtgctggtgcggggtctgcgcagcttcccgctacgcgagatgggctccgaagggtgaggcacccgggtcaggcggagtcccggagtcattgtccttgagtcggggagctggggcctgactcgggggaggggctgcccagtgtggaggggctcccaaatgggggagcagagcgttccgagacaggagtattactgctcctgagccccctgtgtcccctcaggatcaggttaggcttcagtaggatccagcccccatccccactcctaatgcacacacgtggacgcacatgcacttaccctctgaggcaggtggaaccagcagcatgagaacctggagaagctgaacatgcaagccatcctcgatgccacagtcagccagggcgagcccattcaggagctgctggtcacccatgggaaggtaccccgaggtcacaggcagggttcctgccttcccccatacctcacctactctacccctccggagtcccctgtgtgcccttcccctctggcctggtacacctgttctccctgaaggacaaagaggaatgtgttacatgtttcattttgtatccctattggacaggactctggcacaccaggctgggtgcagggcatgagttgattagggagaaagctgtaggtcctagaacagcttaggcttcaaggggaaggcccaaatgctaaaggcatctgtgaattgactgtaaggctggtggtggggaaggggtggggaggggttggggagggcgggagggaggggagataacctaactggaggtggaacttcggcatggaaggaagcagccttcccaacatgaaagggggaagttagaaaccagggagatgcctggctggaacatggaccagggagtgtcaccagcagatgacctgagatatcaattgaccaaaaaaaaaaaaaagccgggcatggtagctcatgcctgttatcccagcattttgggaggccaagacgggtggatcatctgaggtcaggagttcaaggccagcctggccaacatggtgaaaccccacctctactaaaaatacaaaaatttgcagagcatggtggtgcacacctgtaatcccagctactcgggaggctgaggcaggagaatcgcttgaacctgggaggcagaggttacagagagccaagatcatgccactgcactccagcctgggtgacaagagtgaaactccgtctcaaaaaaaaaaaaaaaaaaaagaaaggtcctttgcaaaagaaagatggaactcatactaggggataggataggaacagggcactgtgaagggtcctgagtaggagtgaggccaaggcacacaagagctttggaggaccacagacagggactagagggagggcatgaggagaagggctggcttgaaagggatgcctgaatgggcgggcagaggataagggtgcaggtgcaggcagggcaaggcagtctgggaactgggcaggagccagtcacataagcatgagggacatccacagaggtgttgggagcagctggtaatgaaggtccaaggtgcaagagagaagtcaggaaggatactcatgggtctggaatagtttaggggcccagcagtgtttggggatatcagggttgagctgagccggggatgggagggttgccaggcaaaggtaggcccatctcatccctgtcctttaccctacccttcaaaggtcccaacactggtggaggagctgatcgcagtggagatgtggaagcagaaggtgttccctgtgttctgcagggtggaggacttcaagccccagaacaccttccccatctacatggtggtgagctgggcccctggttcatacctcttctcactccttcagagggctctggaccggggaggagagctggtagcccctatcccttcctcaggccctgtccttctctttatctgacaggtgcaccacgaggcctccatcatcaacctcttggagacagtgttcttccacaaggtgagggactatctctgcccatgggccacagttccgggtcagggcctggcaggaagggagattgtgtctgtgtggggaaggcatcagacacagaaagtttccctcctccttttcccaggaggtgtgtgagtcagcagaagacactgtcttggacttggtagactattgccaccgcaaactgaccctgctggtggcccagagtggctgtggtggcccccctgagggggagggatcccaggacagcaaccccatgcaggtgggttgaggttacctagggttgtgaaagcctaggtctgggttccccaaggcctgcgcaggtgagggtggcccagcgtgaacactgtgtgacctcccaggagctgcagaagcaggcagagctgatggaatttgagattgcactgaaggccctctcagtactacgctacatcacagactgtgtggacaggtgagcagtccgactgggcctgggcctactgtggagggctggaagaccgggcctgtagcctgcctctactcacctccttcacaacgtccctgcccctagcctctctctcagcaccttgagccgtatgcttagcacacacaacctgccctgcctcctggtggaactgctggagcatagtccctggagccggcgggaaggaggtagggtcctcccccaccagcctaagccccaggctactgcttcagggtatctttttgatagaggggggcagcttgcacacacgaagacaaaccctgtccccaagcccactgaggataccaggatgcctcagccaaggttggcctagacctgagctctgcagcaggccaggcccatgtgtccactactgaggctcaccctgctctggggtcagcagccctatagcctgggcaagtcctgcagcccaggttctcccattcccaggcagtggtcagtctcccagcccccacagctggctcacttgaagagaattcaacgtctgcacccagtgtgctggttcctctccccaggcaagctgcagcagttcgagggcagccgttggcatactgtggccccctcagagcagcaaaagctgagcaagttggacgggcaagtgtggatcgccctgtacaacctgctgctaagccctgaggctcaggcgcgctactgcctcacaagttttgccaagggacggctactcaaggtcagactccctccgcaccagcccccacagccccagtaccgccctccccatcctaccccgactgcgtccctgctgtttatctttgcccacccacctcaaccccagtgctcttttcagtccttgggcctcaggtgacacaccagctagtgggacatgggcccccacaggcattctcagcccaacccagccccttccttttccttggccccctggccagcacctgcatcacactggcctccactggacacccttgcagcttcgggccttcctcacagacacactgctggaccagctgcccaacctggcccacttgcagagtttcctggcccatctgaccctaactgaaacccagcctcctaagaaggacctggtgttggaacaggtaggcactggaaagttagctgctcaggaccactgtcccactttaccagcaccttcctgccactctccacttctctctcctagatcccagaaatctgggagcggctggagcgagaaaacagaggcaagtggcaggcaattgccaagcaccagctccagcatgtgttcagcccctcagagcaggacctgcggctgcaggcgcgaaggtaaggcctgtggaaatggcagggagggtggaggggatgcaggaggcatggatgtgggtggggtgcccccaccttccagggccagtcagaccttcctgactttcccccaggtgggctgagacctacaggctggatgtgctagaggcagtggctccagagcggccccgctgtgcttactgcagtgcagaggcttctaagcgctgctcacgatgccagaatgagtggtattgctgcaggtgagggtatcctagaaccttggacctctaagccctactcccacatcccccacatgcattgccatcctcaatacccacctgcctgcagggagtgccaagtcaagcactgggaaaagcatggaaagacttgtgtcctggcagcccagggtgacagagccaaatgagggctgcagttgctgagggccgaccacccatgccaagggaatccacccagaatgcacccctgaacctcaagatcacggtccagcctctgccggagccccagtctccgcagtggagagcagagcgggcggtaaagctgctgaccgatctccctcctcctcaccccaagtgaaggctcgagacttcctgccccacccagtgggtaggccaagtgtgttgcttcagcaaaccggaccaggagggccagggccggatgtggggaccctcttcctctagcacagtaaagctggcctccagaaacacgggtatctccgcgtggtgctttgcggtcgccgtcgttgtggccgtccggggtggggtgtgaggaggggacgaaggagggaaggaagggcaaggcggggggggctctgcgagagcgcgcccagccccgccttcgggccccacagtccctgcacccaggtttccattgcgcggctctcctcagctccttcccgccgcccagtctggatcctgggggaggcgctgaagtcggggcccgccctgtggccccgcccggcccgcgcttgctagcgcccaaagccagcgaagcacgggcccaaccgggccatgtcgggggagcctgagctcattgagctgcgggagctggcacccgctgggcgcgctgggaagggccgcacccggctggagcgtgccaacgcgctgcgcatcgcgcggggcaccgcgtgcaaccccacacggcagctggtccctggccgtggccaccgcttccagcccgcggggcccgccacgcacacgtggtgcgacctctgtggcgacttcatctggggcgtcgtgcgcaaaggcctgcagtgcgcgcgtgagtagtggccccgcgcgcctacgagagcggaaggggcagccaaggggcagcgcagtcgccgcgggtcaagtcgcggcagagggggtcggcggggacagctcccgaggactaggtccgttactttcgccccatcgctgaagagtgcgcgaaaatggtttatcccttgtcgcactccactcgtatctgggccacagatgagcagaggtggctgcttatatgtaaaaatacgctgattttaagtttcttatctttaaaatgccttggcccttcttgagaaagggtttgtgcctactgtcctcggagtccatcttcccaggcttgcctcttctcaaacactcatgaccccctccagaacctttagggtgaagggaaattaccacctatgggagggagcctggaaaaatttagaacctttggtgggccccctgcaagcaggagttttgttgagtctttatttagcaaacacccttttctgacccagtgaatcagatgctaaaatatgcacgcagccacacacccagcagtccttctgcacccctgggaatcgccagcaagcaaaggttgctctcccctgggtagacaccagctggaatcaccaggggtgcttttacagtcctccccgctagcctggatcccaccgcagacctgttgaatcaactgctgggagtggaccctaggcatcagtaaattttaaaaactccccaaattattgtaacatggagtctgggttgagcatcactgctctggcctatttaggaacttgtggatggatagtgtcccaggtctgtgtgtgcatggagaccctctcatccggtacaagaggacatcacaaattcagctggggggagcacaaagttgtgacagaatgcaaagaatgaacaaggggccgagcgcggtggctcatgcctgtaatcccagcacttcggaaggcggaggcgggtggatcacctgaggtcaggagttcaagaccagcctggccaacatggtgaaacctcatgtctactaaaaaataaaaaaaaatgagccaggcgtagtggcgggtgcctgtaatcccagctactcgggaggctgaggtgggagaattgcttgaacacaggaggcggaggttgcagtgagccgagatcgtgccactgccctccagccttggcgacagagtgagactctgtctcaaaaaaaaaaaaaaaaaaaaaaagaccaaggctgggacattgcagcgttctcaaagagaaataaagtagccatggagataagaagcaggatgatttgggcatgtttatcagaggtagagacaagggagaaatcaaagataagtttgggcttttgtctccagtaactgggagcctagtggccatttttgctgcaaagaggaagctgggcaagtgtagcagtgaggctgaagaaaagggaattaaattttggccatgttcacttgaaacgtcttttagacatcctagtgaaggtactggcacggaggatctagtctgagggtttaggtcagtgtttcagccgtggatctggggcagatgaatgtagacagaccaggccagtgatcaggactgagcccagacttcatcgtgagatatggaagttgagtcagaatctgcaaaggagctgagcaggagctgcagggggtaggaggaaaactgggagagtgtagcccctgggagtcaaagggagcaagcttcaaatgatgctgagggggtgagaatggagaatggaacactggattccatttggtagtacacagatcgctgaggaccctgtcccgggcagtttcctggaggaagaggcaagcctggctggagtgggtagaggggagagtgaaggcgaaggattagagtgtatagagaccagtgtcttggtctgaggggagtagagacaggtgacaaccacagggcagacgtaggttaaaggtgtttagtttttccttcaagtaaatgggcagatgtattccatatacgttcccagtgaagggccgggtgcggtggctcaagcctgtagtcccagcactttggaaggccgaggcgggtggatcacctgagatcaggagtttgagaccagcctggctaacatggtgaaaccccgtctctactaaaaatacaaaaattagctgggcatggtggcgggcgcctgtaatcctaggtactcaggaggctgaggcagaagaatcgcttgaacccaggaggcggaggttgcggtgagccgaaatcgcgccattgcactccagcctgggtgacaaaagcaagacgcagttttttgttgttgtttttttaattgccaatgaggaaaggggaagttctgtgctaggcgatagagatccaactgttgagcaggcctctctgcctgtggccttccggccggtttccagacgcccaggtggccaacattagagtccgcgtagcagtgtgaggtaacccactgagataggtcgggcctgcggagcctggcgagcagcggccctctccctggggcttcccttcaatctccgggacatttccccgacctggagctcctccgcctcaccgccaggcctctctgcagattgcaagttcacctgccactaccgctgccgcgcgctcgtctgcctggactgttgcgggccccgggacctgggctgggaacccgcggtggagcgggacacgaacgtggtgagcgcggggccgagggcgtatgggaagggcgaggatgggcaggccacagtgcaggcattctcgagggctgcctgggtgccgcgcgcaaggagcgttctaattgccgatttcccggcggcacagagaggctaattctgcgcgggggctgggaggggagcctggattgccggctccgcaagtactccacccgctgcaagcggacccgggcccaggctgacccaggctccgcgcacgcgcacttcccgcaccttcccgccctcgcctccggccagaggccactcttgtgcgcttgcccggacgctggcacccgcccccgttccctgtggtaggtggggtctgtgagtggagctccggagcgatgaggtcattcctgggggcgaagcgtgcgtgtccccgccccggcgttcctgccccaatgagacaagagctagatcccggcgatctacgtttcagtcttaacggttgcggcgcggctctggcccgggcgcacgcgcacactgacacgcgtacacgcacgcacgcgaccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggtgggagccagggggtgccggcgggcgggaggggaagcggtcgctggagctccgccctccccggtccgttgccgcgtcctgggtcggtgggcagccccaccctcctggctacgtggctccccgcgggtcctggccggggacctgcccgcggaaccgtgcgtaagaccccgattccaccgcctagatgctgggtgccggggcccccttggtttctgtcacagacaggttgaacacggaaaaagcagctgtatggcttgtggtagacctgagccgggcattatccagctatgactaaagccgaccgagcagtttggactagcacctcgatttccgcgttcgaatgctcctgctccctccttggggagactaggggaggatgtggagagggaagagtcctcgccaggaattgagaagtatgtttaggaaaacttgagaggcagagagagatcctgctcctccatctgcactcctgtatggagccagctgagccctcacctcttccctgttctggcctgtcaccagctgctggaatgtggaagattctgttcccttcctctagggtggatctggagaaagatttgggaatagataggaaagaagtcttgttttggaccataagcattcaggagcactttacccacaggaagggggaaagctagattataaaatgcctaaagaggtggaaaaagagatccaggttactaacccaggactgtaaggtgtctcggaacctcctaggtatccccattatcggagaactgtgtgccagatgccattggtgtgaccaccaggctcagagaaccaggcctaggcaccaggaaaaagaaacagggactgtgaagctcagtatgcctggcagaaatggggcggaaatccttatttaagtaaagaaagtggagttgtgagtgatgcttcagataaaattttacaaaattccttacaaaatgggtggtgctcagcacgccaaaatcttagcccagagcttgggtgcaagggttgagttgagtgtagacccctgggcttgtcttcatgtcagtcagtcctgagccattttccactgtggaaaggtgggaaaaccacaagacactaaccaattgaaaaggagggctagccacggaggtgcacacctgtaatcccagctacttgggagggtgaggcagaaggatcacttgaacctgggaggcagaggttgcagtgagccaagatcgtgccactgcactccagcctgagtgacagagtgagactctgtctcaaaaatagaaaaggaagccaagtacggtggctcacacctctaatgccaatgctttgggaggccaaggcaggtggatcatttgcaatcaggaattcgaggtcagcctggccaacatggtgaaaccctatctctactaaacatacaaaaattagccgggcatggtggtgtgtgactgtagtcccagctacttgggagactgaatcacttcaaccgggaggcaaaggttgcagtgagccaagatcgtgccactgcactccaacctgggtgacagggtgaggctctgtctcaaaaaaaagaaagaaggctgggcttggtgactcatgcctgtaatctcagcattttgggaggccaaggcaggcagatcacttgaggccaagagttcgagacctgccaggccaacatagcaaaaccccgtctgtactgaaaatacaaaaaaattatctggccatggtggtgtgtgcctgtaatcccagctactggggaggctgaggcaggagtatcacttgaacccagaagacagaggttgcagtgagtcgagactgggccactgcattccagcctggatgagagagcaagactctgtctcaaaaaaaaaaaaaaaaaaaaagaaagaataggaggctgagaagtcccaagttatatgttaaaaaaaaagaaaaaaacatcagttttaggccaggtgcagtggctcacacctttaatcccagcactttggaaagccgaggtgggtggatcatgaggtcaggagttcaagaccagcctggccaaaatggtgaaaccccgtctcgactaaaaatacaaaaaattagccagttgtggtggcaggcacctgtaatcccagctacttgggaggctgaagcagagaattgcttgaacccaggaggcagagattgcaatgagccaagatcgcaccactgcactccagcctggaaaacagagcgagactctgtctcaaaaaaaaaaccatcagtttttatggacagtggtagagtggagggtgggtccctatggtgcagaagggaaattccatggtcctgctgtgcatccgactgggatggctgttgaaatcctcttccagcaggcagctttggaaacagaaaaagaaactcttcctcctttagaatcctggaagggctgtgcagtgcctctaatccaagtctgttttctgagtgaagatagggaggttcatcaccagaagggaaggggctggaaatgaggtcactgcatcccagcccagggctcctgggtcatccaggaagggaagaaggagcaagctttctcattgttaggtaggagctcagagccatcacaagaacaagttagcaccatccctgtgccctccctgttctgcaaacaaaatgatcttccttcttgccctggcactagagtctgtctggcatttctcctgcccctagtactcctcccatctgggtacttcttcccgttggtgtactgaacaaacacatccactgctttattcacagcctccagccctcattttccagggcccacaccatttgtttttactaacccgacaaggttgcccactgtccccagtaaggtttgtactggggtttttactccagtgctcttctccatccaggagacctttggatacttggggaagaaaatgagcttaaattcccacccctccccctttacctttttcctgtaaggccctggccttagttcttagccccacatccttgctggctgcagaatagcagcgggttctgggtaaggagcattctgctaaaacgctccaccctgctccctcatctgtcctctccatttgtccccatcagatggtttaagtgcttaaggggactccagggcggagtcagggagaaccctggctctcctgggctaggcacaagatcattctacaggaaaccttgtgggaattcttctgggacaaattattggtcagcgctgagcttagctgtgtctgtgacactcgcattctaactagggcctatctgacgtcaacaggaagtaaggctgatgcagtggggccaagggagtctgggagaagaaagtcggttcagagccctggctgccctgtcccacactccacccttccggcaagaatccagtccctagatgaggtggggagtgagtggtcgagttaaaaatctctgggtcgggtacgatggttcacgcctgtaatcccagcactttgggaggtgaaggcaggcggatcacttgaggtcaggagttcaagaccaacctggccaatgtggtgaaatcccatctctactaaaaatacaaaaattagccgggtgttgttgtggcacgcgcctgtagtcccagctactcgggagtctgaggcaggagaatcgcttgaacccaggaggcagaacttgcagtgagccaagatccagccactgcactacagcctgggcgacagagtgaggcttcgtctcaaaaaaaaaaaaaatctttgggccaaatctccagacagcacaggcaggtgcagaaacccaccaggaagctgcctgtgtacctctggcagattggagcctggcctaaagctgccttttatgcagcttgggtcaaggttaaacatcatgtcacagtgatttttctcactatgtgtgagacatggagaactggctccaagtactactctgtccactggtggctggactactgatgtgcaccactctccactcctctcaccctgcagtgggtcatggccccgtgccggggcagaggagaaaaatgggctgccttctccaggacaaaccctcactccaactcaactagggtgctgtgatcagaatgtgcaattgaggtgtgattttactgattttttttttttttgagaccgagtttcgctcttgttgcccaggctggagtgcgatggcacgatctcagttcactgcaacctccacctcccgagtttgagcaattctcctgcctcagcctcctaagtagctgggattacaggcatgtgccaccacgcctggctaattttgtatttttagtagagacggggtttctccatgttggtcaggctggtctcaaactcctgacctcaggtgatccacccgcctcggcctcccaaagtgctagaattacaggcgtgagccaacgtgcccagcctgtttttgttttttgtgttttgaagcagggtctcactcagttccccaggctggagtgcagtgacacgataatagcttactgtagctgcaatctcccgggctcaaacgatcctcccacctcagcctcctgaacagttgggactacaggcacaccaccacacctggctaatttttttttttctttttttagtagagatgaggtcttgctatgttgcccaagctggtctcaaactcctgaggatcaagtgatcctcctaccttagcctcccaaaatgctgggattgcagatgtgagccaccacacccagcctgattttactttaaatgagagtccctcttcagagtccctcagctgttcctggcccctggccatgtgccttcagttgcccctgcttctgtggtatccttaaggctacattcagtgctgaggccctaggcaggcagcagagagaagccaaatgattctgtctttcccttatccacccagagcatgcaaaaccaggagcagtggtgggttcagggtgggcaccagctatgtatatgtacatcagggacagggggccaaaggcagtcagtttccaaagactgccccagaggccatttttcagagaagccctgggttcctcaagggccctgtgtccatgctggcccatcttgcaggacgagcctgtggagtgggagacacctgacctttctcaagctgagattgagcagaagatcaaggagtacaatgcccagatcaacagcaacctcttcatgagcttggtgagttgactgctcaggaagggggcgtggggaggagcaggtacccagctatgtgcctgatactcagagggtcacaactgaggttatcttgggtgggcgcaagcagtaatttgtgcatacccagcctagccccaagtagactgacatctcacctggaacctattatcaaggtttggtttctctatttctttagaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaaggtgggcttcccaccccaccctgccctatgtgagggtatatacgcatgcacctgagcatgcaggggctgagcagctggccctgtctctgatcattacttccccttcacagtgtacttgcggaagctgttggatgatgagcagcccctgcggctgcggctcctggcagggcccagtgacaaggccctgagctttgtcctgaaggaaaatgactctggggaggtgaacgtgagtacatagttcttagtttcttggttgtcactagacaggactgatgggctgtagctacagtaaggcttggaggaggaattgtgctggaagacaagccctgcaaaacagttccaggagtgtataggcattgtaactaaagcaaaggcttccagaccactcatgccaaagcctagggttgtcccaagaagccaggaagaattgccttggtgctttgatctttcctggtgtggaaaatcttctggagatgcaggagtccatctaatgacatgaggaggcccccttcagactttttacctggaagctttctggctccaaggtattaggcctgtggagtgaaattagactcagaatatgcctgacctgtccacaggtaattggggaacatctgacttggttgtctcagtaaggtgaccgttttgtagggcccatcttccatacaaactgctgtcagggatcctaccagagatcattcagccaagagcctgacatcagaaagcccagtcctagcttgtgtgaacatgaggtgctagtcttctctggggagggtctgctggcttggccatcccttctgcagcctgtacactccccttttgccccttgcagtgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctgtgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcagggcctggggcctgagagaattggctcaataaagatttcaagatcctcctgctgttggaatcttttatacatataaagtttttgtagagacatgagtctctctgtgttgcccaggatcctcccaacttggcctcccaaagtgttgggattacaggtgtgagccaccctgcccagcctggactctttattattataggcgcagagctgcagttgcccctcatggtgccagaagttgccaagggtgatggacaggctcccaggtgtcttgcaaagtcaccatggaccaatttgtgaagatgtagtatgcatacatacttggtcatcactcagctccctggggctcaggttgtggtggagacaaaaatggactgcagttagaacttagggaaactggctgggcatagtggctcacacctgtaatcccaacactttggttgggctaggtgggcagatcacttgaggccaggagttcgaggccagcctggccagcatggcgaaaccccatctctaccaaaaatacaaaaaaaatttagctgggcgtggtggtgggcgcttgtagtcccagctactcagaaggctgaggcaggagaatcgcttgaacccggcaggcagaggttgcagtgagtggagatcacaccactgcactccgatagagcaagactccaactcaaaaaaaaaaaaacggccgggcgcagtggctcaggcctgtaatcccagcactttgggaggccaaggcgggtggatcacctgaggtccggagttcaagactgcctgaccaacatggtgaaaccccgtctctactagaaatacaaaaaaattagccggcatggtggcagatgcctgtaatcccaagtactcgggaggctgaggcaggagaatcgcttgaaccctggaggcagaggctgcagtgagccgagatcgtgccactgcacattatcctgggcgacaagagtgaaactccatctcaaaaaaaaaaaaaaacaaaaccatcccttcaacacacacacaccacgctctgggagaaggtgtggcataactccttcaccaaatacagagctgccaccgtggaccagacactgctcgtgataccgagggtatagctgttaacaattcttgctttcattaagcatggactctgctgggtttgaaaacactgaattcgaagttcttcagaactgaatgtaactatgtgaatctggccagttccttaattttctttcaacttggttagttcacataagcgtggcaatcgcaaaaatacagctgtgaaaatagaagccagatgggcacccggcggtctggccttaggccctgaagtgcaggtttgaggattggtgcttgcgaagtcctgctaggcctgaactcaggtgttgggggacgtcagagccgccaaatacacccaaaagaccgggaggactcacggccaccactttcctcggtgggagctgtcccagctggtcagatcgcgcttgctgggacctgggatctcgcaacgcatgctgggatgcccagcatctaagggcgcccattggtcccgcccccacgacttgagcaacagccaatcagaggtggcagcgtgcggaagcggaagtgaggtttccgtggagacagccgagcctgcggaaggcggcggcggcggcacctgcgatcagcggctggggcaggttatggtagtgcggactgcggtgtgagcagagcggccacggggcccgccatgcgccggcggccctgacatgggcgccagcgggtccaaagctcggggcctgtggcccttcgcctcggcggccggaggcggcggctcagaggcagcaggagctgagcaagctttggtgcggcctcggggccgagctgtgccccccttcgtattcacgcgccgcgggtaagggcatgggttccaccctggcggggggaacaggcgggcggccaggcgtcccgcgccacgggggaacttccaccgctgtaccccactacagccaagccaggacgacccccatattttgagcctcattggagctgggggtggagaaagccgggcagtggtctcctggcggcctggccactctgaaagtctccctagggaagagtgggcctgaggcttgtcactggtcggaccttccgcacggtaaagctaagctagggcctccataagacctccataagatctcttcctttcatcccttccggctcagcctgcatactgaagggtcctagcctccctttcccccccagttattccaaggggataataaccctctgtttaggctgcttttcctgacagtagtggggctgaacctttgagcgtagtggctgggaaagcagggataggcctcagtattgggggtgaggctgaggaaaaaagaccctcacccagttatgttctccagatccagagcgctgacctacccacccaacccccagcccagtctcccagaggcccgcacaagagtaccagattggcttggctctagtgggctcctggagatgggcgctccctgtgctagagatttggctgtagacaccaggaagacccaacagtggcaattcaccagccacctggggtgtggggtcaggggagacgcagccttcattcctttgtgcttcttcctagcttaggcttctgctatttcagtctttgacactgggccagcagcatcttctggagtgagaccaacatgcccaggccaccaccctgcccactctagaagtcctgggtgaaggcaaagtcctgatattagaatggctgcccttgctgaacaaatcaaggatgagaactggccttggtggctgcctggatggtgtgctctggtgtgggctctcttcttgggggtctgacatagtagcactgcccacccatcacctcacttcccactttcttctagtagaccccaaaccccaggcaaaggattctccaggcaggccaggcaccgtggctcacgcctgtaatcctaacactttgggagatgaagacgagtggattgcctgagttcaggagttcgagaccagccagagcaacatggcaaaaccccgtctctactaaaatacaaaaaattagcagggtgtggtggtgcatgtctgtagtcccagctacttgggaggctgaggcaggagaattgcttgaacccaggaggcagaggttgcagcaagctgagatcgcgccactgcacctccagcctgggcaacagagtgagattctgtctcgaaaaattttttttaaaaaaaggattctccaggcatattatcctcttttcttcccacttggggttgggaagaccacagacttccccgtgacctgtgacatttgccatgcccaggtgtggggctccagcccagcctgtttccttctccctctacacagctctatgttctatgatgaggatggggatctggctcacgagttctatgaggagacaatcgtcaccaagaacgggcagaagcgggccaagctgaggcgagtgcataagaatctgattcctcaggtgaggggctgggcagcggtcacagagcctacactaagcgtgtggaggtggacccagatgggatctgttgtcatggtgggggcttttgcggggggatctgggaggaacaaggaagcttcctgaagtagaggccctgagctgacccttactagcctctgtttccatggcagggcatcgtgaagctggatcacccccgcatccacgtggatttccctgtgatcctctatgaggtgtgaccctgggaggtggcagacagaagcaccccctgccccggcaagaaactcccaggctcaatcaaggtgtggcttccattgaggagcccaggctggggccacaaccctgaataaactctgttggcccataaccttcagctgtgagcgggtcggtcccacagtattggttgggtgttggtttgtgtgtggacaagaggtggttggtgggtggtgaaggctaatggcagagttagcaccccactctcccaagccacccctgcaagcagcacagcagggcatataccagtcaggaatgcccgttacctggttccttgcctggtctgctttcttccaagtttgcctggggcctagccctgctagaggctacagcactttacaagcaaggtatgctttcttccagcccctaggctgtgggcactgtatacaagtaggaacttcctttccttcacttcccttttaacccctagtcagagcatttcagccgtttgctacctcgattcctcctgtgttggacagaggctgggggcagtgccagcctgattcttccgacctacctgccatttgttcccgccttcagatggatggacagtttgctggctattgataggagtggggactgggtgggggcttctccctctacccagggctgggctgatccccctactgcaactaactgttgccccccaaccccgaacccccagttgaggagttgagagagtgcaggctggggtcaggacaggctgcggatgcttgtgcctatggggagttactccaacccacctattctgtctaatctccatggctttgcaccaaatcctccacccctccaattgggaggggactgttcaccaccttgtggtaagggacaacaccctaaggctggtgccagtagttatgagtagcctaccaccccctcccttacagtaacccccaccccttcaggatcagtcaagggaaagcactagaacccctgggtagggaaagaaaggagggaaaaaccataaaaggaatacttataatgtgaaggtttgtaaatagtccatgatgatgtcgtggcagagtctgatttctatatagaggtgactttttttttaagtactgtgcaagctctgtgcttctataatgtgggaaatggcttggggaggatggcccctagcttaggaagactgttgtgttatttgttcaatttcaataaaatgatttgtagatcctgcacatgagagtggcatcctgtgggggctctgacacccagtgtctagactaccacctgggttcaataggtaggcctggcacaggactctggcaggccccctatgaccagcaaagcccaagagtaagtctgagcccagcctgtggccatcccaactgtggccagcaggtggctgtgtgttcacacagacctcactgcaggccccctgcagggtgggagggcactcatttatctgttgtgatccatgtggtggtgacccttggaatcagaaggccctgggatacttcactaaggattggccccacctgcctgatctaaggtgagagagtgtgacccaagatagttctggaatatctgtcttagctgtagcatcgccagctgatcctaagtggggtcatggcctgacccccatggacctcaaaggcccagctttaatggacagcagccagataggtgtccccacgcctttggcctactgccaggctcagcaacccaaactcatgtgcctcctctgaggcctgcctgcggacaccatgggagaatgagctcaggctgctgtttcagcaagcaaggctcggcccactagtattgcccctgctgtctgttgcccccatcttctcatcacctgcagcctgcccactgtggtcattctgcctgcacttctcaggggctgctataaggcagattctctactaggcttaggctttgactatcagtccaactcccagttaaagaggggagatttcagggacaggcttctgagtgtagggagctggtctgccagtctttcggaggtttgaacttgtcaaggctagggcaggatcaccatatccagcctggacttgcagttctgtggggtgcctccccatacccccataagatgccaaacatgaggccctgtcatcctccatggtccccctctactggctgttcaaggcccagggctctcccatgccagatagcatcctgtctcctaccaccactgtcccagcctgagggaactccctgtgctgggcctacccagctgaccccatcgctggaaacaatgggggtcaggcaacacttccccactctctcccgccgggctgtgctcacttccttcctgctggctgcctgaggaagtgtccctgccctgggacagtctggcctagcctttgtttccccgggggtccccacccatggagctttcaaggcttctggcccctgtgaagccagcacagtggtacagggacactgcaccttcccctaccatgtcttggactccttggtcctcagggccagactcctgggtattcacctacccctcacacagccttctgttgggggagaggctcctgggcattgggccattgggttgttgaggggttggctctgggtgatttgagggtaggtagatttgcacccctggagaggtctgctggaaccttgctgcagtcctccctagggccagccacaggaacacccctcccagaggagtatacccctttcctcatccatgttgtaaggagccccctactctgtatagtggactctgaaatccatccaggaatgaactccagcaggaaagcactctgcagaaccctcccagtccatcccctcctccccaacccacacagtcacactcactaacacattgtcctgtcacacaggatgcggaagctctcagtggaaaaaaacggactcagctactggaagtccccccgaccctccccccaaggctagttcccttcttgggcacctgctctgggggaccatcagctgaacgacccccaagtattttgactcccaaaagcaccaccacctgaccccatcctctcacaccctactggatttgaggatgggccccaatcctagggaaggagtgaagaggttccctagtgttggaagctgtgggtgtgggggagattggcacctgatcctgagcccatagccttcctgtcacctggcgcagctggcggggccagatcctactcgggaagggtggggagggcagccagccagcagggcattctggagggaaacagggtcaaggcgatctcctcccccacgcctgttcctggccctttcctctcagggggcagcaggaagtgaggagaaagggctgggatgggaggcgggagcggatgggagggaatggggtttatcaagtcctcggcgagctgcccaacgggcagcagctggcgcaagtagcctagctggagaggctcaccccaggaaggagggaggccaccgacctactgggccgacggactcccacacaggtgagcccagagcagacggctggtctgcacccccacagatgcgctcgcagttgcactccctccctctcctggcgcccgggagggttaggggctggtggtgcagacgcgggcccttttgggagttgagtctcgcacaagggagcggacctaggaagagccgaggtggtttcgcacggggctcgccagggtctaagcctgccccccaccgggagaggcctgtggagcgtagggggcgctggatacgggatggaggccctgggagacccctcttgctggctttctcggaggtccagccagaaactgctgcaaggaatggaggcctcctcggggttgagagggagccgggctcccaaaggacctcagagactgggcagaaaaggacgggatctcagggatgactgtcccgccctgatgcgagtcagggagaggggcggccaacctcctagacccctctgagcttccctgaccccaaccctgcggccacgccgcgacccagagccgggctgccaggataacgactgcctcggcccttcctgggccggctaagaagcggtgcttggccccttccctcagtctggcagggggcggggcctccctttagacggcggaccagagaagggggcccctgattcgtgggaggcggggcactactctccaggagaccagaggtcgcctcaggtcaaagtccctttttccacacaaaggggacccacggctggcgtctacgttagggggtgcagagccagatctggtgctgccccctgccaacctcggagtaccacagcacctcctgatggccgaacggggcaacgcctcctcctattcccccccccccccttcccgtccccctgccttgtccctcacactgtctctttaaagggctggcggcgccgcggagctgggaggactgaaccaccggcctcgggctgcaggggaaacatttcaggctgactggcgctcgtggctgagactcccatagaaagcccggctcagaggggcattagggtcctaaatgggcggccacgtccctctgcagaggacctggggctcttcgagcccgaaacgaggcaccggcaccgagaaaggtggaccacaccttcccgccccgtccgcaagtccaatcccgggcccacctccgcactggagtcttaaagggccagcgtgcctgggggcggagccagcagaggcgctgagccgggccgcgcctgggcgaacggccggagcgggctgggctgggcccgggatggcggtggccctggcgccggtcccggtggcgccccgcgcgaggtgagggcgggcggtgcaaacctggcggctctctccccttgggctggggtctgaatccccgggggtgctcgcggagaggcgtcccagaaaccccacccccacccgaccgggcgcaggccccacgtgtggggcgggggcggggtcccgcacaaagacccggcggagcgcgctctagccctgagcggccgggcgggggaggcgagcgcgcgcattcccggtggcggtggagggaagggccgggcggccggcgccgccgtgggaggtccgctgcccctttgtccctacggggcctcctccaagccgggagagtgtcagcgctcgagagaaagtccggagagcctcactcttctgccgggcgagtgttacacggatagaagcctcccggcagcgttccttccagtttcgtagcctcttgacgagctgttccctgctttacccaaatgctgtcgtttctctggatcaagggttcttcacggtgtacagggtgggcatcagctgttcagggttctctgaaaccatgtactggatggtatgcaggcatatatgtgactctggtgagcccaaattatctagttcttagaagggtcacagacctaatagagatttgtgccgagccacaggctacctgctccagaaaagagccctgtgcttctggcagtgagttcccagggtgccttgtctgccctgcagtggcctgtggtctctcaaacctattacagccatgagcacagtgcccccacacagcatgggctttgggagcatagatgggcttgaggtgggcacttccagtattccctagactgacttgttctccccaacccttcttccagttcctgagctggtgccaggcaggtgacacctcctgcagcccccagcatgcgggcaggcccaggccccaccgttacattggccctggtgctggcggtggcatgggccatggagctcaagcccacagcaccacccatcttcactggccggccctttgtggtagcgtgggacgtgcccacacaggactgtggcccacgcctcaaggtgccactggacctgaatgcctttgatgtgcaggcctcacctaatgagggttttgtgaaccagaatattaccatcttctaccgcgaccgtctaggcctgtatccacgcttcgattctgccggaaggtctgtgcatggtggtgtgccacagaatgtcagcctttgggcacaccggaagatgctgcagaaacgtgtggagcactacattcggacacaggagtctgcggggctggcggtcatcgactgggaggactggcgacctgtgtgggtgcgcaactggcaggacaaagatgtgtatcgccggttatcacgccagctagtggccagtcgtcaccctgactggcctccagaccgcatagtcaaacaggcacaatatgagtttgagttcgcagcacagcagttcatgctggagacactgcgttatgtcaaggcagtgcggccccggcacctctggggcttctacctctttcctgactgctacaatcatgattatgtgcagaactgggagagctacacaggccgctgccctgatgttgaggtggcccgc

SEQ ID NO: 1443 - DNA, 1680 bp, Homo sapiens
ccggggcggtggttggcggctacggacgcgcaggactgggggacgggcgggtacggctatgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtgacctcttgtacccccaggtggaaggcagacagcaggcagcgccaagtgcgtgccgtgtgagtgtgacagggccagtggggcctgtggaatgagtgtgcatggaggccctcctgtgctgggggaatgagcccagagaacagcgaagtagcttgctccctgtgtccacctatgggtgtagccaggtatggctctgcacccctctgccctcattactgggccttagtgggccagggctgccctgagaagctgctccaggcctgcagcaggagtggtgcagacagaagtctcctcaatttttgtctcagaagtgaaaatcttggagaccctgcaaacagaacagggtcatgtttgcaggggtgacggccctcatctatgaggaaaggttttggatcttgaatgtggtctcaggatatccttatcagagctaagggtgggtgctcagaataaggcaggcattgaggaagagtcttggtttctctctacagtgccaactcctcacacaccctgaggtcagggagtgctggctcacagtacagcatgtgccttaatgcttcatatgaggaggatgtccctgggccagggtctgtgtgaatgtgggcactggcccaggttcataccttatttgctaatcaaagccagggtctctccctcaggtgttttttatgaagtgcgtgaatgtatgtaatgtgtggtggcctcagctgaatgcctcctgtggggaaaggggttggggtgacagtcatcatcaggcctggggctgagagaattggctcaataaagatttcaagatccaaaaaaaaaaaaaaaaaa

SEQ ID NO: 1444 - DNA, 813 bp, Homo sapiens
atgggcgaggcggaggcgccttctttcgaaatgacctggagcagcacgacgagcagtggctactgcagccaagaggactcggactcggagctcgagcagtacttcaccgcgcgaacctcgctagctcgcaggccgcgccgggaccaggacgagcctgtggagtgggagacacctgacctttctcaagctgagattgagcagaagatcaaggagtacaatgcccagatcaacagcaacctcttcatgagcttgaacaaggacggttcttacacaggcttcatcaaggttcagctgaagctggtgcgccctgtctctgtgccctccagcaagaagccaccctccttgcaggatgcccggcggggcccaggacggggcacaagtgtcaggcgccgcacttccttttacctgcccaaggatgctgtcaagcacctgcatgtgctgtcacgcacaagggcacgtgaagtcattgaggccctgctgcgaaagttcttggtggtggatgacccccgcaagtttgcactctttgagcgcgctgagcgtcacggccaagtgtacttgcggaagctgttggatgatgagcagcccctgcggctgcggctcctggcagggcccagtgacaaggccctgagctttgtcctgaaggaaaatgactctggggaggtgaactgggacgccttcagcatgcctgaactacataacttcctacgtatcctgcagcgggaggaggaggagcacctccgccagatcctgcagaagtactcctattgccgccagaagatccaagaggccctgcacgcctgcccccttgggtga

SEQ ID NO: 1445 - DNA, 92726 bp, Mus musculus
  misc_feature (122)..(148): "n" at positions 122 thru 148 can be any base
  misc_feature (3122)..(3263): "n" at positions 3122 thru 3263 can be any base
  misc_feature (7485)..(8927): "n" at positions 7485 thru 8927 can be any base
  misc_feature (24884)..(25439): "n" at positions 24884 thru 25439 can be any base
  misc_feature (36036)..(36055): "n" at positions 36036 thru 36055 can be any base
  misc_feature (46607)..(46729): "n" at positions 46607 thru 46729 can be any base
  misc_feature (77651)..(77670): "n" at positions 77651 thru 77670 can be any base
  misc_feature (81264)..(81462): "n" at positions 81264 thru 81462 can be any base
  misc_feature (89156)..(89175): "n" at positions 89156 thru 89175 can be any base
  misc_feature (90342)..(90361): "n" at positions 90342 thru 90361 can be any base
  misc_feature (91379)..(91398): "n" at positions 91379 thru 91398 can be any base
  misc_feature (92723)..(92726): "n" at positions 92723 thru 92726 can be any base
cttctgctgccgagccactcaaggggaagcgagcaggctgccagctcccagtcgccagcatctctcggccacttggaagccttctccggccagtgaccagcttgcttggtcgcagccacctnnnnnnnnnnnnnnnnnnnnnnnnnnnctccaggcccggagccccagccggggtctccggccaggctgggccatggtggtccccggagctcgcccccagcccccgccctccgaagtttgcctccctcctcttccggggtgggggaagtgctcctcggggcggtcggtggctggggctctagctcggcgtctggcgcccgccgggcttgggcaggttgctggaggcataatgagtgggatcctggcaccgcccggaaatccagcttttcctaacgcggggcgaccctggaaggacctgcccagcactaagctgccggccagggagaaccggcccgcgtgcaagccagagctaaaatatctgggggaattgtctgcaagctacttccttcccaaaggcagaaactgcccggcagatcacgagacaaagagaatagaaacgctctgaccaggcacgcatgtacagaaatgcattttagtaaccagctttcgcgcacaataacgcaagggtgtgagcggagtggctgtgacatgttgaatgctgtgtgccggcactgtattcaggggaattctgctcctggcgctagtaataccggaaaggtctcacttccaccgttaattcttgaagaagctgcaggctctattgctgtactggtgtgaatttatgctttatttaggggtttcatgattttaggacttaattttcccccttttcttttcctgtctttttcctctttgtcagacagtgtgaaataggaaaggatgaagcagttccgggttttaagtgtagcatgagattgtcatttcagtgagatcgagtttcaagttttaggtggtagggttactcacaaagctggttgacctaggctccttgtgcaagcctctcttaatatttcattagcttgtgttccatgttgggcatttgaaagatagtaaattatgagctaagaaagcttgtagtaggcagatgggtttatttctgcctcagagcagattgattgctaaagtagatatcattaggacttcagggccttctgcacaggtgagccgcccatgcatcgtttgtcactgagcagggaaccagcaccccaagagcccccccccttttttttcattttttttttgacagttgcactcaagcagaccattttctgaagcacacaagttgcttaaactttggaaaacatgtgctttttgcttattacaaagaaaatgatcctggtttttcttgtgcctcttgtggttcaaaggcaggtttaaatgggggaagctccttgcctggcaggagttctgtgccacgccactgctggctgccttcctctaagtgcctgttgcaggccacgccacttttccatagcagtctgtcagcttttacgatttgaagaaagttggatgcagctgataactggctctcagactgttgtgggagtttgcttttaactttcatcttgcaccaagacctgttcctagttgcataacagaactctgccatgtgcacattgttatctgtcattttatttgcatttttatgatagcattctgctttttcacatctgggatgcactgcagtcatgtaaaaagaaggatttcactgcccactgactccatttattgttttctttagctgtgtgtgtgtgtttggtacatttctaatgtatgaagttagtttgggaaaactgagcaattgaacacatagaaatatgcatttttggctgctgatggtgggtggtgtgcatgcatcttttggaactgttaattacacctaacctgatcagtgcaccccctgcccttttgttcttttattaagtatatattaattgtatacaacagtgaggtttttggggggacatttttctacatgcatgtaccatagtttgttcatattcattagccttttcttgtctctttccctctcaggctaatctctcaaaaggctttgaatcttaagttcaagtttactcaacctccacagacctagtacccttaaaaacagtggcttttcctttcaactgtttctgagcccaccatggaacttgaagtttgttgtgttgatggacatttcttctctgccactctgtctcctaagtagtgcagcgaaatgttgtaaaaggcatttactttgagaaaattatccacatacttgttacagtaggaggaattctggtccagcttttattgtgtttacattttttttgacttgcaaaatgtgttttattggataaagagatagcgaatgagtcacctggggaaatagtcccatgggcaagtcgtctgtacaagccaagctaaggtttgcatgtgcgcttttgactttgaatctctcatgaataaggtgtacacacgcagatggattgagctcctatcagtctattaggctcattacacagggcaagcaaagcacaaagccctttccatgacgtagggctttgctagctaaggcaggagatgaagcgtcctggggaagctaggaaaaccagaaagtcacctgtcagtccaaggggctattagttgtatgtgtgagaatgtatcagtttggaggcagtttctcatgcagtccaccctggccttgaactcttaatgtagcagaacttgactttgtactctggagtggttcacctctatctcccaagccctgggattacaaacttgtgccaccaaactcaactgtcaggtttttgggtttttttttttgtttttttttttttttaagacagtgtaaattgcatctttatttatttatttatttatttaaaaaagcatcggttgtgattaacttttaagcactcatattttattgcaatttttaaagtctcctttgactcctctctaatgaaattttttttgtgtgggggggtcatggttttgccaatactcttattgaaatcacttgcctaaagtactggcaattaaggccgtttcttgtacactaagccaaatgaactgaaagatagagggtgtaaaaacttatagcttgtctgtctggctcatgctatcctccccccccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccattttctggagaaacgtgcaccgagtacaagcttactaaagaaaaaaaaatcgtaaaaacagcactttgttctgccactattgtataccttaaagtaaatcaaatatatacccataagcacctgtagtcaaaacagttctcaggttaatgatcacctgggggagaattgaaatcataggcgcctggccaaagggtcaggaggctctgccagtgggtgttgtgaggagttacaggcggggtgtctggccagcagttcagcctttgcccctttccttcttcctggaatgcctctgtagtcctgacaaactgggcttatcccaggaggacccagctgccttcattctctgggggcattgcgtgactgtgttcagtttttcctctttgaggaagacgccatgaaactcaactagatagcagtgtcgggactcccaccttgtgctctgccaccaagtcacaattctgtccccctcccacatacgccccctgacctcccctgggccaccttccaccttgggtctggagagagaattacttgggctaagtccacaggcaggctctatctgactctatttacagcaggagttttattttaggtagcttcaggcttctttttagaactgcttgcagcactgaaaggcagcgcaagagaaaattcctggcacctgtctgtttcggttttaaatctgcattgtgcaaacagcagtgacattcaatgccgatattgctagcagtcctattgttaccaagagcggaacaagagtgctggaactgcagttgactgtcacttcaggcacgccttttagctttgcttgttttctcatctgcaaaatggggccgagaaggacactcgagcggttgtaagggttcacgtcaaattccccagaattgtgcttggcacaccccaagcacagagtcggggtaattgagaagcgtggtgctacatacttttgtgagtgtaattgcctttaaccttcataatgacctgggaaggtataggtctgtttccatcggcctcatatgatgacggagggaggagctatagttacatatctagtcatggaccagggcagccgctgttagctgtaactcataattcacccttccggccatgaatttaaagtactactgttgcttcctcaccagaagaagcactttcggggcctctccctcagttcacacctcccatggctccccttcagtccctctccactgtagtcatgcagggaaccaacacactgccctcttctgggtagtggggatctctttcttagtccataaataacatggctcttagtcctagctctctccatcgtgaccctcacagtctagaagggctgctgggggtgggctggggtaggtctctccactcctcttcttggtgtgctcagggacacccagtgttgtaactgctttgcagtccgtctcttaactgtgtcacctgggtgtgtactcactagccccttagggcttgcaggcaggaattacagcctccacaccctacttacccacactggctacccagcccgaagtgtgtgtggcagcaggcagcacatttggcttaacttgttggtttggaaatcaattgagatattagatgcctgtaacattgggcccatcttttctgtccttctttacctgaggttacttggtgtctccaccactctgtacacaaacataggctgtttgctaggattggggtcatagttcgtaacttccaggattttgaaaggtagacagattttcaactaatgattcttgttttataaaagactgtataagttgaggtgggacgtctgtgcaaggttctgagttatcccattaacggggggggggggggggggggagggaaggattacacatggtggtgtgggctgccccacccagagtcttctttgtcttaactatagatacttttgttgctgccccccactgtctgaccactaattttatcacaggatggcaatgcacaagtagataaatatcatcttgatttttttttaagtgcaatttgaagataaccattatttctgcttcccaatcaggttttccaaatcctgtcctttgtaaaaggtggacagagtaaggcagcagagctggagggcctttcagagagtctgtttgtctctttcccatcaggcctgcaggttagaaggttaaaaaaaaataaagaacctatttttaagccattgcccattaaatagtcagggatttctatttgtcaagcatcagaaacaattttatttgagtagatgagaatttctcagtatgtttgccagagaaagaaaatctactttcagtgagtgggcttgtagacaggttaaaaaactggagcaaaataagtcctctcaagggaatgatggacagttgcttacgattttgcatgaaaacaagttttgtaatttcttcacagaattccgttatgctttttttttttggtgggggaggggagtataccatattctattagcttagcgcttatatcataaaattgtctaggttatctgaaagtaatagtttgttgataatgacatacctgataatcttaactctgtgaatctgggtgggcaggtgtttcattcatctaaagagaatgggaggcatgatttaatgaaaggggaaacatctgtcaaaactccaaattgacttcagaagaggcacacgggcacttccacatgcttcaggctgccgggtgttctggagtcctggggacaatttgaggaagagcttgccagtcctctagatgtgacactcctcatgactctggatagaggctttacttatctccccagggaggagctaagttgttcggaattgtgtaatgggaggctcaggagagtgacacaggcaaagaggccaagagggatacaggtggcaggagctaagtttgtaggacacagaagcgcaggattccagaagcgatttgctcagggtccctttaattcactaatttattggcttcttaggtaaggtttcattttaatgaagtgctttggagaagcacatttgcatggtttaggtgcccggtcctgcacttggcaggcatgctgcccagttattattatggcttctttttgtgcaggtgtgtgggagccagacccactcacccctgtggctgctgtgaaggcagatccacaaaatactcatggggccagtgtaggcaggacactgcattgttgatattgcttctgtgggtaagctgcatcttacacctatgacaatctaaacccaaggagtccagaagtaagttatggtggtgttaaaaggggctggaactgagtttagattttacctcaggtgctgagtgtagtcatgttggagatacttagctctgacttcttgttgagtgagaatgtctgtagtaccctggttatcttgggttgatgtagacacagctcccagtagagtgtcatgtgatagctgtgataacagcctcatttaaatgggtttggcaggctagagaaagtgtgcagggtgtgcaggattgcaggcagagaggaaggcttgccccctcggcccagccaaggtctccctgagtcttgtcaccccaggatcaagtccccacccaaataaatgacttgtctgcgctctctcaatttttactgcacttcacctacactgcgtcattgctcaccttgactgctaaccttaactaaccgtctgcattgatcttcctggccatgtttggggcatctcagaaacagacatgctctccttgcaatccctgagtcataagagatctgggctttctttatgagactaagacccagagtcctgcagaggtctcaagattcttatgatagtggccgtggcagagcattttctgaagcctcaaggtcttctagggcgcgggggggggggggggctggttaaatggctacaatgaaaccactggggagaggggagactttccaggaacttacgttgaatacattggaaggaaaagaatttcaccccctactcccaagcctcggccccctcgaccgcttcctgttgctccgggttcttcaaaaactgaagctgacacggagcagcaaggtcagtatgatgagtggctggttacttaatgaccttttgattcattttcaatttttatttattttttaattgctaagaccttagtcatctttgagctaggatggctaggctttgggctgaagtcattttggcaaattgacctgaacaggtatatagtgtataaaagtttggtcagtcatttcatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcctttctcaggagcccttaccaccattctctccccgtgcctgtcccccctgggcattgaggtcagactggaaattccgctactgcagcttctcctcagcgcccatgctgtgttcacttacacgtggggacttccatttcctgttggtgtatatttcaggtggccctcttgtcttcccaccccaggttcactgcttcctctttgtcttctgatggatggagactgccctgcttctttctatcctatgacatttgcttggtctcatctgtacccaggatcatgccacacattccattctgtctgcagattcctgcaatttgatgtgctctctctctctctctctcatacacacacacacacacacacacacacacacacccgaaccccatggcaatctctgtcagcgtctattgtggcatttacctaatgttttggttccttgtgtactagccttatctccgggacattgccacatactagcacttctacccctgtcccgcccagtgttcttagaaggcagggactgtcttactaattgtggttttgtatactgtgtcaagaattagcacaccggcccgtgtgtgtcgtctgccagattgattaaggacttgttgaatggggggtagaaattcaaatccacacagatggccgagtgtgacgtccattcataaaccttgtttttgctttgctaggtgaagctgagagtggagcgtggcagtaaaatcagacgacagatggacagtgtgacaggaacgtcagagaggattgggcctcgctgcgagagtcagcctggagtcaaggtgttgacaagttgctgagaaggacacgtgggaggacggtggcgcgcggagggagagccctgtcttcagtcaccccgttgatggaggacagatggacagcagccggacggccagtcacctctcttaaacctttggatagtggtcctttgtgctctgctggacacctgttggggattttagcccattctctgaactcactttctcttaaaacgtaaactcggacggcagtgtgcgagccagctcctctgtggcagggcactagagctgcagacatgagtgcagagggctaccagtacagagcactgtacgactacaagaaggagcgagaggaagacattgacctacacctgggggacatactgactgtgaataaaggctccttagtggcacttggattcagtgatggccaggaagcccggcctgaagatattggctggttaaatggctacaatgaaaccactggggagaggggagactttccaggaacttacgttgaatacattggaaggaaaagaatttcaccccctactcccaagcctcggccccctcgaccgcttcctgttgctccgggttcttcaaaaactgaagctgacacggagcagcaaggtcagtatgatgagtggctggttacttaatgaccttttgattcattttcaatttttatttattttttaattgctaagaccttagtcatctttgagctaggatggctaggctttgggctgaagtcattttggcaaattgacctgaacaggtatatagtgtataaaagtttggtcagtcatttcatgcctggaagtttgcttaagtttgtataaattgggagatggtgtctgagagccggttttgtgagtaccactaagctttctaactgcagtggccattgaattaacccctacagacaatccttataattcttcttgctttgggaaagcaaagggtaggtctaatagaagcctatgtgatggcagtgtggtttgtatggaaaaatgtagtcttaaagtgaccacagaactcagcagagaagaaaccattgtttttctaacctagactcggcctctcggcttcctctctaggcttgtagttagcataaaaggaaaggggtttctgttcccacaagggcagtgcagtaccattgtggcagcgatgcctgtagtctgcctggccttcccgagaagaaactcgggttcactgggtacttctcttaaatggaaaccacctccattcaaagtcctcaggctggaggggaggtagcccacacttgggcttgggcttgggcttgggcacagctgtttcttggtacgtttcttctattcagtttcttactgcggagagctttatgttcagcttcggtgttgtctcttctgtcagacgctgttgcttactagtaaatcttgggctgcacagggcgattctggaagggattctgataacacagcatcaggctttcccagatgaaggagcgactacgaataaagaggcgaggatctcaagggtgagagcgtccttttaacactaggcaacggaactgagaacagacctaagctacccccaaagggatatttggagaactttattctatatttaatgataacaaataatgtagattttaaaactgaactaaggaaaaaaatttttttttttgcatgcaaatcaaaaagctttgaatgtgtgcatgtgttctgggcacatgcactaagtagagtgtttctcccatattatagtttagcagactgaagataaacaggtcactttttttctccttcagataacatgttttctgacctgacttctctctctttttttttttttgtcgttgctttgaaagatttacgtacttttattttatgtctatgtgtgtgcgcctggctgtgtatatatgcaccacaggcatgcaggtgcccatatgtcagtagggggcatcggatgcctggaactgaaattacatgaagttgtgagttaccgtgtgggtgctgggtactgcacacaggtcttctgaaagagcagcaagtgctgtaattgtggaactctctctgtctctggccctccagcagcctcagctattgctgcttctgctgctgctgctgctgctgctgctgctgctgctgctgctgctgctgcttcttcttcttcttcttcttcttcttcttcttcttcttcttcttctccttctccttctccttctgcttctgcttcttctccttctgcttctccttctccttctccttctcttctccttccccttctcctcctcctcctccttctccttcttttctgttaaacttagaaacagttaaataggttcatttaagaaaaagaaaaaaaaaatgacttcattgaacccaaaatataaagggttgcagaaccataaaaaaaaaaaatagctcagttaaattagagatgattcataaggtggggttgtgggtgccaggtcataattactgacaaaaaagactttgtgaaattgcttctaaacaaagttgcatgtgatagctgccatccggtgggagtttactcagctgtcatacccagtcaagggacaggtctaacaggcacaggactttcttttttgtaaggtgctgcgtgtttcttgtgttttctttctatcacttttcagcagtgagtttttttttttttttaacagccttttctttttttggtatgtggggaaaagggaaaaataaaaataaaaaaattcagtaggcttcaagaagagacccatgataatgtatgtgcaaatatggggggaaaagggcgcctgaatataagtgagagatttgaaatagctgaaagatcgggaaaccagtggaaggaggggtccccagggggggcactgtcctcgacattcattagatactccaggaacattagcctcatattctcactgaaatatgatgcttgtgacatacgtgtgagatcagcagctcccatgtaggtgcagatgcagctttcttttgcccgagtaagtatttgtttccaaaatgtttgtagtggaaacttgtgtggcagcaagaaaagggagttctttttcttgctttactcctcctaggtaacaatttcttccctccattgattgtgtattcttttgagttctttggttttctgcttctcatccataagactacttactcttcaagccccaagagctgtgtgcattctctctttggggtccctggacaccaggcaccctgttaatgggcagtggtgtaacattggaccagtatgcatggtaaacttgtttcttttatcctgttgattctccataccccgagcatcccttgttttcttcctcatgtttaacaggtgggtttaatcctgggctcacgtcatccctcctcttctgcctcttctgtacccgtgactacagttgggtaccacagctctggcccaaagtagactcttatgagcggttcctccttatgcaatagaatcaacctttttctttctttgtgctgcgtgcatttagaaggaagactatggagtatagttatggcgttggagaaactagcatttgaacagggacaaagcaggcactgttacacagctaagccagtgagtgccaagttcatggtaaatggcaggcaacaacaaaacagtgcagtgcaacctatgtgagcatccgattaagcaactcctctcgggaatcgctctaccaatacattttgcatgcagttgtctagagcaccctaccctgcacattgaataagtttatttcttggatgatcttggactggggggacatcacattcagtaaatacagatgggggggggatgtcctactttgtgctagaaagcaaaagcaggaggtgaaatgacatttttcgttttttcccctcttcctttacggctgtgttctgttctcttagctccagttattcctccctaggtccccagagttgctgatccctctcctcctctcactgaagctggctcatggtgcgctgtgctagaggaggagtctaggttccctgtgagccaactgtgcagcgcagtgctctagtgtgttgtcaagtgagtcaaggcctaggctcctccagttacagtgcatgtggctgaagtgagccacttgctctgtgtgtcacgtgcgggcgcacaggctgaatggctcagccaccatgccttatttgctctttgcttcactcacctgggaggcaccctgtggctttgcccttcagcattgcttgctgggcctccagactgcttgcttatcttcagcctcagcccttgggacaggtcgttctgctgctgggaaaatgggtgaagctgatagggagtagaaggtgtgtcctatcagcaggtgacctggggcacagattttattattggtagtggcctccttacctcctcacccccttttatgactttctctttgcaggagggccacggtgttcaaaaatgaggcttcctgttttatttcacattcttgtaacctaatatcccattcgagcatctttggagacagctttttctttgttttgttggactgtgcaagatgtatcttccacacggagacatacatccatgatctggaccctctgtcttagcagttggataagcacattctgtcgtacacacaaccttcctttgttggaggtctcccatttcctttcctatacaaggaattgaaccactgtacgcaaggaacgtctgtaggggtgagaaagataaatacactcttcttctgcaggagatgtccatggaacacattgtgatcctcccgttgaagttcagctgtagctggctatttaatcttgtgagctgctgaccaagagagtttgtgtaaagcattaaaatctgccaacccgaggggccacttgggcacccaagtttatataaaccttcggcatgccttatgcacccatgaccctgaggactcctgacagccggtcccagctggttttacaatataaaacaaaactcagacattggctcaaactgttctacattttgatccaaatcccttctaaacacaagaagaaaagagcctgtgccctgcgtctgttttcgtggtctccccaggcatgctatctttatatttttttcacaccctagcttttgagtgtccctgcaatgcttgttactcctcgactagaaagccaggctgcaataaatcagtgactgcgccacacagaggtcacagaagctagagagagacctgatcccaaattacactccttggtggggtgccatggtctcaatgcatgagtctctgcaggagacggtagaccaagatgtattcctgtttgtgggaattctgtttgcaaatatgccttttcttaccgttctccacctcctctcctcctttcaagggaagctttgccaggaagctggagggctgtctcaccatctgactttgggtggcattcacctgttctgcattctgtaatcatggctctctgtggagaaatcagaacaaggtgctggacccatgatgggagggttcttaaacctccactctctgcttctaggtagccagaaaaagcttgaatgtttgccttccatgttttcctaggaaacagcatgtatttccgaaagatgactagtgtaatcgactcatcacaattgttgttgtttttgtagttattttagtggccatggtgatagcactgtactgagaatcaaacccaggaccttgtgcatgtgaagcaagtactaggcacctagcccacatatgtagctctttttctgtttggtgtttgagatacaatttcaccatgtaacgaaagggctggcctggaactcactgaagagaccagtgtggtttttgaagtcacagggatctgtcttcctctgccattggagtgccaggattaaaaggagaaaggaattccagagaacaatctgcatatccatttgtaaaaggcaatccagaagaagcgaaagggctgtctctccttcactccctttcagccctcttctgaagcaacctttaggaactgacagagccctctggctactgagtcaaggatgccttgggctatgcggaaatgagacacaccaccttctcctgggcattattcacagggaaaggccagagctttacaggatcgatggccaaggcaggcagcttggtttccttggtttcctttcgttctggatttatttctatctttttattatagataatagttctgtgggtacgtgctagtgacctcgaagttccctgtaggtggagttacagatggctgtgagctgcctgccatgggtcctgggaactgaactctggtcctctgaaagagcagtacatgctcttaatcattgagtcatctctctagctccacattttatttttcccttaagtgaaatgcagtaacccctggctggcgcttggttacccgaggtcaacagagatctgaaaatattactgtacaactaggcatttgtgggagagagaggcagagaccatatttccatgatgtttttttttttttactacggtatattgtgattattgtatgtattaattgtttatacaccatgctcctatcacagatgtgtatgtataggaagaaaatggaatatatagagaaggatactatttgtgtatttaggtgcctactaagggtcttagaactactgtattccagtatattctatgttaaattttttgacatagcattttggggtgtgtgtgtgtgtgtgtgtgtgtgtttgcaaagtgtgtgaatgaccacaggccttacctgttcagtgtgaatgaagctacctcccttcaaacaagttatttaagccaaaatctcatgttttctaccactaatgattgaattaatgttatctccctaagttttctttgtcataaggataaagccctgtggactataactttagtttagagtctttggtaagcttggtgtctagtctggtttctaggtgaatgtatgtatttttgtccaaaagggattagtaaacatgtcttcagtacagccacacttgggaaaataaacattagaaaatttgaaagtcaacaacacatggtgccttgcatctgctaagttgtatcccaaaaggagaaaattttgtacctgtggcaaatttgcatgccaagtgtgcatgtcatttgcatattcgtattttagttagtaacgaacaaacagaaagtaaatgttagctgtgcagctggctgttgtttctaggtctatgtatatttttttgttgctgacagattgccataggaaaagatgtaaaatgggcagaagcccgagatgggggtaggggtggggtcacttggtatggtagctggacgtaggaacaccattgtttcatacgctgtactgaatgctttcatgtcttagtttaatttatactatttaatatcaagacaatcttcaggcttttaataaaacaaatctaaatagagaccaacaagattaagtaaaaattgcttttattccagtaactactatccaattgccctcaatttaacaaaatagtattagaatgctttataaaggttttttgtttgtttgtttgggtttttttggttttgtttatttgtttgtttttggttttgttttgttttggcttttgagacaaagattttctgtgtagcctagctgtcctggaactcactttgccaacttggaactcactttcttgactaggctgaccttgaactcagagatctgcttgcctctgccaccagagtgctgggattagaggagtgagctaccacttacaaagtatttctatttatcattatttatctctgaagtatccttacttatctttattctactactgtagcagtataaacagtgttaaggagcaatcttgtaactaaaagtcaaattcaacgtacattgttaaaatgcaactttgtattagaaagagaaacaagtgacagaacctcccactttctcctggtggcactatgccactgccaccacatcgcctgggcatcattttaaggaatactttctcttcactttgcttagagatagatgttggcaatcttcttgattcatccatcttacctgttctcagctactggcatgcattatgcaaggcctagatcattctgtcctgccacagtttgatgcatattgaagttattgtagaagacttcctgtaatttgttgatcaactctgatatccaggccagaaaggaatattggcatgcttgaaatatcagttctttctgatatgctatttaggcctgaaactgccttgcctctccaaatattccttaaccactttaataccaataaacactaattgtaaaatgaacagttcaatattggctctgtttttgtttcaacctctgaatttttactgctaagaactattagagaactaactcccctagcccccaaggataagttctttcccctctaatagtccagcagcactaccctgaatgcctggatgcggagaaaagagagtttatgtgaaggactgacttaggatctgctcaggagcttctggcaattataggaaccattactaataaagtgtccagttggtactttttttgccaatctataggatacactttcttaagacatagttcaccacggtgtaacaattgctgtccattcattggtgggcacttggcagttgctgactcttcagggttcatgagcaaatgaaatggtgtccgtggaatgccttctcaccctgtgctgcctctggagtcctccttgtcctgaggatttcatggatatctgaattatagtctccaggatcggtaaagaatgatagtcataatgtgttcctttggattctgaggttttgcttattcagacttcacatctgttgaagaggtaacattttcatattaggcaggactgtcctgaagctagttcctgtcttttatggacattatctgggttgaactttctgctcaacaggaaaacgactaatactggtctcagcaaaaaagaagctatcttatttgatttgataaaatgcaattttcaaaattatttaaaggtgcagagaaggtactattttttgatattaggtatatcatgagatgtgaacttttaagctattgtgactgcattcagtgctgctggctttaattctactacagttttaaaaaaatggagtctttcttttgttttctggtgctgggacttgaactgagagccttgtggatgctaagcagacaccccactccactgtgctccaccccaaccctttgatgtctattttaattaaatgcacgaagattgcttcttcactaaacaatccacttgaacttttgctatctcttgctcgtctctgtcctaactttataaccacataggtgggtatttgtgtcactgttaaacttgatatgtatgattatttttaaatataacacttaaactttatgtgctcgtatagtatgcacagatttaaagcaatttccatcaataacaagctttactaggtttttttttttttttggcgttcaaagttcattttctttttcttttaattaggtattttcttcatttacatttccaatgctaccccaaaagtcccccataccctcccctcccactcccctaccccccccccccccactcccacttcttggccctggcgttcccctgtactgaggcatataaagtttgcaagaccaaggggcctttcttcccaatgatggccaactaggccatcttctgctacatatgcagctagagacacgagctctgggggggggggggggggcactggttagttcatattgttgttccacctatagggttgcagacccctttagctccttgagtattttctctagctcccccactgggggccctgtgatctacccaatagctgactatgagcatccacttctgtgtttgctagaccccagcatagcctcacaagagacagctatatcagggtcctttcagcaaaatcttgctagtgtgtgcaatggtgtcagtgtttggaggctgattatgggatggattcccgggtattgcagtctctagatggtccatcctttcgtctcagctccaaactttatctctgtaactccttccatgggtgttttggtcccaattctaagaaggggcacagtgtccacactttggtctttgttcttgagtttcatgtgttttgcaagttgtatcttgtatcttgggtattctaaatttctgggctaatatcccatttatcagtgagtatatatcatgtgagttcttttgtgactgggttacctcactcaggatgatgccctccagatccatccatttgcctaggaatttcataaattcattctttttaatagctgagtagtactccattgtgtaaatgtaccacattttctgtatccattcctctgttgaggggcatctgggttctttccagcttctggctattacaaataaggctgctatgaacataggggagcatgtgtccttcttaccggttggaacatcttctggatatatgcccaggagaggtattgcgggatcctctggtagtactatgaccaattttctgaggaaccgccagactgatttccaaagtggttgtacaagcttgcaatcccaccaacaatggaggagtgttcctctttttccacatcctcaccagcatctgctatcacctgaatttttgatcttagccattctggctggtgtgaggtggaatctcatcctgatgattaaggatgctgaacattttttcaggtgtttctcagccattcggtattcctcaggtgagaattctttgtttagctctgagccccattttttaatggggttatttgattttctggagtcccaccttcttattttaaaggcggccccaaaatgaatatttttgaaagaaacgtatttaaagagcccagaacactgatgtttatctaattccaaggaatgaatatgaaacagatatgtttagaataaatgattactgtcccataccttctcataagtatatttactggaaacgtttttatttttaacttgaaccttacaattctgtagacacgagtgtccgccagcctcctgctgggcgttttatagccatttctcatcagctactcactcatcctttcacagggagcttcttagaacccctttgagatatagcgtaagccagactctgatgccatagcccaggagcctttgctgatttggagagccacgtggagcatggtggcagccacagcgtggatcttggcttactgtcccctctcacgtacgggcagctgacgtcttcatagatacctgttttatctgttaggcattagtcattctattcacccagctgcaaagaacttaccttcatagtatatatatgactcttttctgacttatacatcaaaggcggatggggcttcaaaaggaagaccatgttttgggtatatgcctatgtataccccacccccatactaggatatatgtaccccggtctgatagttcacaagttatagacttataaacataccccacacacccacctctgttatttttgacgatgctaggtgctgcttcacatgcctctgagtttcagcttttcatatttcaggctcatagccttcccattagaatgaaacacagtctgggcctgccctgcttcaaagccaaaatcccgaggatagccagtccaagagctgtgtgttttggcgtgggaagaccggttgcttaaagtctgtacctatgagagctctcacgttgactcaaatgaatccggagccttgttccctgaattatgtcaaggttagcagtcaatgctgctttagaggactgagtaaattgctgaattcctgtgaatgtcaaactctatttctcagcagagtcggccactgccaagtttgtaatgtacacactgtgttctgttccctgaactccaaggatggggtgggggtggggtgggggggggatagagggcttgcatagggcacaggtgaattttatttctagggacttaccatgacaatgtgacactactggtaaagtctctgaagtactgggcaccaggaagacttcttgaatactttgactctcactttttttttccttcttcaatagaaaaaaaaatattatgtaaaaagtttcctgagtttataaagccctaaccggtggctctggcatagcttgttaagagtctccaagaggacctctcttcccaccaccgtcataagaggcaagaacaaaaacgcattcttggtgattccaggaatcagatctaattggaaagcctgcctattgtgaacacagtggatccagttttaaatacacaacagagtgaggtttgacttcttcaaagtagtcaggtagccccacgacccccctgtctctgttttgtcactgggggtgtttctcccctcttctttatctctccaacccatatctttcttcagtgggaggtaatacttcagataataattaagtcatgggtgactgctcaaacctgcaattccagctctcaggagacaaggctcagggattccaagttcaaggccagcctaggttacctgatgagatcctgcccaagaagcgaagaagcaaacacataaatacattccctatattaagcagggaggggtggggcagtggggtcgaagaaaagtgctagaggttgctccgaaagatactagctgagtgaggtttcatgcattctgggctattggtcattcagggcctcagacagccaaactaacatcaggaaaggagtttttcctttcacattagcacaactacattgaaaggagaaccagtttgggcattgcctggcaactgttggtttcagtctgtatctgactttagacttgaacccaggacctaagctggtgtgcaggatgggcaatccgaatgtctgtgagagatcttactcactgataaacaggaaaaccctcccaggcatacaggaaactgttgttttgtacgtccaaggacttgaaaggcaagagaagcttcttgaagtgagtgtttcaagcttgcctgcccagagtggacagaaagcagctgggtgattccgagctgaagagatgaggacggggtaagatggacagggagttattaaagaaactaaatgtgtactagacgtagccagcaaaaaaaggagaatggtcagtgttaaaaataagatctgtactgagcaggatacaagaagaaagagtttgtcgaatccagagaaaaagtctgaatggaaaggagccgggggagagtcagagacgtggtgaaaacttcaggtgtctgtgaacagggactcatttcaagtgacacttggtgacatggctgaagcagcttcagaaagaactgtgtgtgtagacctgaacccgctctccgccgttcccacgtgatgtcaccgtaaagccacctctagatatgttttaggaaaaaaaatagattataagaataatattagagttctttgccaaaataagtaacaaggtgtttgttaccaagcaacaaagttgccttccatctttagcagtctgtgtgggaagctggtgagcttcaacccaggtttgagaagaaatgatggggactagggtgatgagctgactccttatactttctactggctgcatttactcaggacaacacagcaaacctttcatgtcactcgggggtggggctcaaaagttccattttcatccttaagttcacaactagagcatatgctaaaagaaatttgaatttaagaactaattgttacatacatacagagtgcatcttccaaaatcctagagctaccatgatataccaaaagtatatcaatgtggatggaaaatgcttacttggcataaaaaatttaaagatatatatctgtgtgtacacacataaacctaaagctagctttacacctgcctttgcatgttgcatatatttcaggttctctgctaacacctatttgtgtgttagctacttacttttcatgataactctatgatagtgactttatccatacacccgttgtaaagtcaaagtgtagttaaatccccaagttacacagccagtaggaaagctgagatttgaccttatagtgctctcaagcagatatagcatgctaacaagagctggtagataatcatgttatatcgtgtgactcactcactcctgttcggccagggtgtgtcccggagccaaagacagatgacacccccacccccatctcccacccctaccctcttgctttgcagtgacctatggtctgccaagacaaaaggagctcaacaaaatggatgtttcctgtttcaggaaatagacgcaagaaaaactaatgtatgaagcagacatgagtgtcatttttccttctatcaaaagatcgccaggtcagcaagctaggaaaaagtgattgattttaaagagagtttatcccctccgcatgttggagccttgcttttggtgtgtgtgtgtgtgtgtgtgtgtgcgcgtgtgtgtgtgtgtgtgcgagcgcgtgtgtgtgtgtgtgtgtgtgtgtgtgtgtgtgtgtgtgtgtgtgtgtgtgtgagagagagagagagagagagagagagagaggccagaggacaaggtcaggtgacattctaggaactccctctccactgagacaggctctctcagtggccaggaagtatgacgtttaggctaggctggttgatcagtgagtaccgaagctctgcctctctctgcctccctaggattgggattacaggtgtgagccaccgtgaccagcatttttatgtgggttctgaggatcaaacccatgtctttatccttaaatggacagcactgtagtgactgagccttccaccctcagcccaaacctgtgcattttatgagattgatgaaaatattaactgttaaattaacctctatttgacttacggttctcaatgttatatatcacacatataagccatataaacttgtttctatacaaattattatgtacttatatgtaatatatataaaattgtatttacataaaaagatctgatagtacagcatgcatataatgtcataggaaaagctttgctgggataattattcaaatatgcctttctaatggaactacttgatggttccagcaggctgtaacttgctactgtaacttgtaacagccttcaagttaggagttttatggacagttacattgtaactgtcacttgtggtctaatcttccccttaagggaagcttgagaaacactgtcagctttttcgagtagaggaagtttaaacatattggcgcagagtcttcaaaattgtttagcttaaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacccccttttcgcagttcccacctggctccttcctttcctctctttcttctcccatcctatgcttgcagagtccactctgagaggctggtgtctttcacatacctcacaaaggatgggttggtttcacaaccaactttcccgatgatgtagtaccagtgtcccgcctcacctctcaggcagccctgcttgtccatttgctctggtttctacttagatgatatcctgcccctggattcagtagttctttgagggtccatcttttatcaacatcggaaaccgtgcttagttcacatgtgcaagtgttgtgaattttacatcctatcacttacaattagtacctttttgagttcgctctcacatctcatgtgtaatttcctaagagaagaaaggagggctagttgatagtggttgtaaactcttttgacatgagggtaaaagtattttgtttatagaggacagaaaaggagttaatatttagcgactgtgctgaaggcgggacaggacctaaggaatgtggccacctgaccctggacctcccatctgtgcatgtgcacctggataattacacaggttttcgatttgctagaaaggttgtatttgtgactttaatttacattttcgtttttagttcataatcctagattccacatttctctaagaggaaaggccctgctcagacacggaaaaaaagtcagcttcaatgtggctgtttggaagtttgcagaaataggtggagtgtatgtggtgggctggacaccagctactgcgctcttgtgcacctactaatcctgattgcaggttgaggcttaggaaaagaaactagaccagggtcaagcacagctggtggtcattcagtcctcacagtggtctcacttctgagtgtgtgcgtctcagtaccaccctcaaccttcaaagagccaggctggaggaccaggacctcttgtcggtcatcctcgtgcattaagaaacagcagtgtctaaaccataggcttaataaacacagttttgaatttctctactttgcttaacacttcttttatctcaaagtaatttacaaataccacaggtcacgtgctagacagatggatgctgtttgtgtcagactcatgtacttggagcatgaattaaatcaaagacccacaggagatcactggtatactcatttcttttgaaattttatcttaattaactttttattatatagggtatgacaaggctagttccatacatgtattcaatgtgcatgggacaaatttcccagcatcccccactacagccccaggtatttgttttcatgagacccatccagttctttcaaggtttctttgtgagattttgcatgttagagcagtgaccctatttacttagcaaaggtactattagttcattattagttctgtaacttggatttgaagtccttcataaccaccgcagtcttgaagagcatttgtgctttatctgactggctagggaaaaagttcagtcttaccaaaaagaactgttctgagctcttgggtcagggtgtgaatgtttttcatgtgactttcagttgggtcttgctcagagaacgtagtggtcaaagttgggttcacatcttgggcataatttgcaaaagtgaagtttgtaggtgcagggtggttccgtgaagacatgaagatgaatggacgtaatgtttatctttgaagtcctgtttccagaggacactggggcaaggaacaaacgctcttctgttctgaagcatcccagtgttttcccacgttgggtccacgagactgagtagagggctttgagatgccatagctccaggatacattgttccctcctttttaggaatcgggtatccccagtactggggtcaggctcctcatcacgcctctgaggtaggaagtgcacggagcccaggcttacccacaaagccaagccacagctgagcatttcccactgtggaaagtccttcctgtgtttgtcacccatggactcagcccttagtgtctgggtcagttgaatgcctatccagggaaagccagtggtttggcagagaaaactggatctaagtgggaataaaatttgttgacctctgcctcagagggtcacatttttcatttatatttcacacgagtcatcataaattacagtgcttatagataaagaagacttcctccttcctccctctccagacaccacataatggaaattgcaagtttctacagaaaggccgatactgctgcctcctcctcttcttcctcctcttcctcttcctcctcctctttctccccctcctttttttttttttttttttttttttttgtaaactaaacaaaatgtcagtctctgatgagacttgcttcctgccagaattcccactggtctactgtcacagtttccacaaagggccaagatgaaggagggaaacccattttgaaccctgtgctcttctgtattatgggaaagctgctttctgcctcaggatggggagaactgttaagttctaaaccttagtgataggcacgtaagacctactggattctaactgctgaaggagaatgtcgattaaggcaagatttgttctgctgctgcgatcagacatataaaactttgcaaagttttgttgttcatttcctgtttaagaaaaaaaaaatcaccctgtcctatgaactcccagaagatgagaagattttcctcagagaaaattcagttctgggaagagccctccatagaggtcataacctacaaaattcttgaagggaagtttcagtgagaagagggcagggacggttgggaagctctgagtgctgcagtgggtgactggtgtgtgagcccctgctttcttgagctgcagccttcatgggacgtgtaacacacatctgcagaaattttgggggaaattaaaaaaaagaaaaagaaaaagaaagaacaacatgaagttgggagaagtgtagtggaggcgaggaaagagtggactttgatcaatgtatatgcaggtataactattaaataaaatattaaaaaatagatttctgtttccagcacagggcaggaatagcctagctaagtaggagtttgcaccagtagttgtatctttcccaaatgactgctggagaaaataagtgtaagccattgtcaacaggttgtggaagagactggttcagcatgctcgctaccaaaaactcgccttgctgcgaggctggccccagccccagccttccacataaagcaggtgctgttcggatcagaggctgatcatccttggcacccagagtggacagcctgccaattgttgcacaatcgagtggacccaagcgacaaaggactgcttaattgaaagtgtataaaatggttccttagttgaaccttagtgggtcacacccttaatcccagcactggggaggcagaggcaaatgactctctgagtttgaggccagcctgttctatagagtgagttccaggacagccagggtcacacagagaaaacttgtctcaacctccctctgccgtcaaataaaatggtttcttaggcttcatggacaattgagtaaccccataaccccagtttcctttctttatggtcactacctaatcctctgggatcaagcataaaatattctggtctcttacagtgaaaagattaaacagctgaagtttaaattaaatcattaatttggagttttctgtgactacattcattatattctctgttgggattacgttcctgtggatttgacagatacataaaagtgacaatatgtgcttatcaagggcaaataaaagttctgcacgctgaaatcctgagtggtgtttttagttttctgtttatattaaaaccttttaaaattgaaatgatttaacgaggttttctttttctggatacctagtagaagaaaaaatcagaagcatgaagcaattgagtatatttacgtggagacaggcctgagtgatggaaattttttttttttctttcagtaggatttagcagaaagcatgtgtcgaaagtcttacctaaatgggtcataattaaagacgttggggcttatttattttaattagaaatattaagctacactcagtgggcttcatggaaaaaatttttttctaattgcatattttattttacgtcaagtaataaattaaatttttgtgggtaccaaaaagacgttttagctttaaccacaatcataactcatgctaaatatattaatgttgtgttgattagctggctaactgtttctggagagttaactggtgagacctattgttgttgatgtttttcgttttccagtaatagtggcagagcaatcagtgtcctttctggagaaaggttctcgtttgagttgctctgatcaatacaggtgactagaagcagaggtaaagagcagcgcttacttctgctgtgttctctttaaaactctgtcagatgctgttgttgcgttgcccctcccgtgggtttgacagagtttctgggaaatccacagaggcaactctctcagcctcttacgaaaaggggcagaatggaagggggaactcactcacagttcctgtcgggattaaaccgggcatccaagtggcgcgcctcaggttgactctcagacctagctgctgtctctgggatggaagatcccatctcaacatcctccatgtatagcacagaacaatccttgttacccatctcgttttctcgccaaagagaatctgtagaacaaagcaatttagactactcaagtacattggccattcccagttgtctttgacagttcttaattagagtaaaaacggacacagtcagcagtaggaacagtttttcgggacatttgggaatttgtacaaatatactttagaggaaaaaaaaaaaaaaagaaagacaaactgtttggcttctgcatcatttattatgtgtgcgcccttgaatctggtgtaaagtgcctgggatgaagattggtttctgctattgtacagccaaaggggtagccattgcactatggtctcagttacatggtgaacttgtaaataagtcaggcattaaaaacttccagtggcatccttggctgagagtccgtcttagtcactgtgaagtatttgctgcatgacctaaagatggtaccataacatacatagccttggctttctcatctgtaaaatgggatcgatggccaggaatgagctgtgtgggagctctctcagacacacctccactcccagaagaccccaggacctaaggctcattgatgataattctcaaaacagaaaggacacattgaacacacacacacacacacacacacacacacacacacactcagtgtttcttagacttaagtgatatgtttgaacctgacgaaaatgaaaggaattgagattgcccggccacaggaaatagaggccaagggccaagttaaacagctgaaaccacgcacaaagcaggagatcatgggagatagcaaacgcttcgacgctctctttgtcggtgtttgagggagaaatgacagcagaattgtcatgtttagaccagctgcctcttctacctcacctgagagttctcctcctcgtccgtggaaggcagacaggaccagctgtgttctgtggcaaaatgcgtttttctccacagctcggtgctttcccaggcgcaggcaccctggaacctggaatggtttcgtttcttagcacagagttttcatttaacatggaacattgttgcttgaatgatgctcattaggagtctctactcatgttttcctttgcctgcttcaatagtatctagttctgttttctgtttgtttcttgttttgttttccaagactgttcttctttagtcctaggagactaatactttacacacacacacacacacacacacccaagctgacctctaaactcatgataatcctcctgcctcagcttctctagagctagaattataagtataggcaatcaggcccaactgtttgtgccacttaggtataaaccattccagggtcatggatctgttaggcagagtttagttgactccatactgtatcttcagagggcatagtactggcaaaaccatacccagagctgcagttcacttctgctttgtccatttagtgtgtccatttcctctttgaggaaaacctttggtttttcagaactccattttcctttacaaagtcagagttgcaatagcaaaataacttaaaaatattttgttttcttgctcactaattcattatgaaatagctcaatgcttaaaaggaaaaaaagaaaaaatgtgctgggtcttggtgggagggaggacatgcctgcctgcctgctctgaatctgattctcctgcccaatagaggttgccatctattggccaaagagagaaataaaatgaaaagttcggcccacgctccaggtggtgcgatggtcacggagaggttcttttggtaaagttcttggctaaaatatatgaaaatgcatgattctttaggaaccttaagcccaggatcattggccgtagccggtctctgtaagtcatgataggtatttaagaagtggctacatagctcttttaaatgcatatttcttgagaccaccagaattccattttaatgaaatattaaatggagttttaattagacaaattgatggctgattttgtaactctgtggttggtttgggctttctttcattccagcctttggaatctggtatttcctgcccagctgacatgagacaggctctgtagaacgggcaactggtggctcttggtgctgggatctggttaatttgaccatgtgcactatttagaggtttaagtagtggcatctctccagagttgtataatgtcataaggtgcatttgacaaaaaaagggaggtggttcgtggaaaattctcaagcaactgcaaacaggggaaagagttcctttggtcttgggtggacacacacacatactcacccactccacactccacacacacacacacacacacacacacacacacacacaaacacataggacagcttgaacttagaaagcaccagtataacaatttttattattaataacacatcattttaaattgacttctcatccctaatatctgaaaataatcttataaatcctgaaagctaaattgtatatacattagtgctttacttaatatgcctcaccatggtgtgtgtatgtgtgtgtgtggtgtatgtgtgtgtgcgtgtgtgtgtgtgtgtgtgtgtgtgtgtgtgtggtgtatgtgtgtgtgtatgtgtgtatgtatgtgtgtgtgttgggtagtatcctaaccaactatgaataaggctcacagtctaaccttgtggttttatttcttccttacctgcctgttcatatttggagtgtgaagcttttttaaatgctgtgtactacccaagtaatcatttgataccctggattcaggcatttgacgttcagttaattaattcctgtgccttccactgtgaactaagaacgatgacagctaaagaaggaggcggtacaagagaaaccaggaaacccatatgttatttgcttccattttcacatagtacacctatatatgtgtgaaacaaatatataaactgttacaaagcagcatattgatgaattgaaatgagtggagcatgatacgagcaagaagccggcaggagaacggttggagtggggcctagagaaagcagagtttttgaaggaagcgagacatgtttatgtgttctgatacaggtcagtattaggctcaccctgaatggcttaatgtcatgtgagcagtggggagaagagaaagggcagcatcatggaaatggttgaggcatgggcatctcctgtgggcaagccgagatgtattgttgaggtcaggctgtgtaacttccttctgaaaaggccctgcccatttaccagtcatgatacctttctttcacttctatttttgtcccttcctttaggaaaaggactagatgcttactcgttagttaaaactcaaagtcattttcctgttctggttgcttttgttcctcgagtttgagaagaatcgaattaggtccgcgtgaaacatttggtccctctgtcaagtttccattttcctattacctgatatgtctttctttttaaaatgctgtcccctctcatccaccagatctgtatcgtggtgcccctccttggtctttcccttttggataaaggcagatatactgagctttaaaattctgcctggatagattatctgctctggcacaaagtggccctgtcataaaacccagaattgaaacatccagtattgacgtctttaaattcagccttacttttaaataatactggactgggttgttggacatcatcataactaaactgtttctctagacgatgtaggttaatccagcaagcccttctaggaattctgttgcaactggtaccctgtactaccggactccattataaatgatttaacctcctataaagctgcattttaataggtgtttataggcatcacttaccaagtatttcaagggctctttaaatgaaaactgccagggagggaagggtaacactagcgttttttctcacagttataaacattcccacataaaacagggttggtggactatgggtgagggaacaaatacttaaggctccatctcctaccgctgactttcactcgttcccacgataactggagagaattccttgggaactcctcttcacagacttgtgtgttatgtgttcattctgtgccaggacctggtcctggcctggatgccttgatcaaagctcataacttaatggagggaaacagaatgctggccgttcggccagacaagtagtgtcctttaggattggagctaagctggaggcacctgtgtttgaggtgccatgccctccttagtctcctacgtattcctgccagtggctgacttttctttctggggggtagacagctggtgtttgaagtggtaaggtatcccgtgggatctacacctcagccataggctccatgggatatggtagtggagacccatgcttgctgtcttgcctttgctgcctgccctctccttccgcctgcttgtgtttggcgagctttgtcagttgcatgcctgtgatgaagatggcagggcagaagacttgactatttctgttggtaacataccagtgtgtaaattgggaagttccctaagtgcgttcgatttctatattcatttgctaaaatttatgtgacccataatgtcattggtatgcccatttgcagtgatgtactatcattaaaagtgactttggtgaagtggctttggtgtccttgtctggaaccgtaaccttcagctatagaacacgccgaggggaaacacatgttttagatcttacaatgagcttgggaaatagtacccacatgtaggctggagacttcctgtggcgggcgacaggcagcctgtgaggagagcctgctttgggaccaggactgttcctgtcatcgagtcccgttcctaagagcggcgcccagaagggtgaatgagctgccctgaaatctttaagattccttatgagatttcaaaattgcgttcatgaacatcactcacttggaagaaaatggcttggtgtcctcctaagactgtgcacacactacattaatcctgtgctttgttcatgactcccgagggagaaggaagatcagtatttaaggctccccctcaaaaccgtctgcctctgctgggtcacggctcctactgttgtaggagttctttcctttgtgtttgtttgtattttaagattataattacacagcttttctcttccccctctcccccttcaaactctcctgtgtacccccttgttctctttcaaattcatatctttttttctttaattgctgttttctgtgtgtgtctctgtgtgtgtgtgtgcctgtgtgtgtaataccagatacataaatacaacctgctcagactgtataatgttacttttagggctgatcatttggtatttggataaccgattcctgtgcttttccttggggaagcctgtttcgtgcgcactcagcattccttggctgcctgcagtttgggtttttcctttataattgagtccttgtgagctttcccccttctatatgagacggtgtctcctaaatatgtcacaagctacagccgtgaagtctcatcaacatggctgcctaagcgtgatccgaacaaggatgacaccaatagacattgttggtttttgttttgacaggaatttgctgtgtatgtagcgtaggctggcctcggatttgagatcttccagcttgtgcctcctgagtgctgggactgcaggctctggcaccaagcccacatgttatctctgcccccaactgtagtctgtaagatagataatacagtgattgtgccgaaaggtttgcctttgttagtgtagaagtaaaaattctagtgtggaactcccagcacttggaagacagaagcaagaggattttgaggccaacctgctctacatgatgagtttagggctaacctggactatgagatcgtttctaaagtttggtatgatgatgcaaatttgtaggcttaccactcatgaagccaaagcaaggaagataatcaagactgcaaggatctcctgggatacatatggagaccttgtnnnnnnnnnnnnnnnnnnnngaggtaggtaggtaaggggaaaaaggaaaaaggaaaaggaaagggagagaagaaaagaaaaagaaactagatttttgaaatagcaatgttatagtagatgagtgacattgtactttggataaaaatttacaaagcgcttctgacaatcgcctgctgtgtgcccaaggccactcaggttctcagctcaaatggtagaagcaccattttgaaaatccattggttttccagggtatctggttatatttagatagtcattttttctgctgagtatgtcctgacaatcccttatggcccatggttctttaagttatcacttgctaggctgtactgaggactctgagccagatttagtggtaccctgtaaaccccattgtttggggggattgaggcaggagaatcacaagtttaagacctgcctgggctacactaagcgagtttgagacccagtttgaaaataaatagataaggaagtaaagggatggtaactgacatcagtttagtggttatcttagggtttctgttgctatgctaaaaccctatgaccaatagcaacttggtgatgaaagaatttattccagggaccagggatttattagggcaagaactcaaggccggaacctggaggcaggagctgatgtgtaggcagtagaggggtgctgcttactggcttgcttttcatggccttctcaacctgctttcttatagcacccaggaccaccagcccaagggaggaaccacccacagtgagctaggtcctctcttagcaatcaccaaacaaaaaagatgtaccacaggcttgcccacaggctaatctggtggggacattttcttaactgaggtcccttctttcaaaactggctaattgcaataaaactagccagcatggtggtggagtgcttgcctgatatgcaggaagctctgggcttaatcctagtaccacagaaaacaagaaaaaaaaatggaggctctgggtacgtataagccattcttgggtcaagttgcctgtgggtgggggcagctttgagttcctgtggatgaatcagccactgacgcctgacactggacccagccgcagagggtaggaaacagcgttgcgcaccattacagcttctgttctttctttcagaaatttccagactcttcattctttctcatttttagattttgcgtggtttaaaagtctttctagatgaacggagaaacgcacacagttgactatgtcctgaaatggggggaaaagagaaacttggagttccaggttaggagtctcaggagctgtgaccctggtttggggtttatggggtcttggctgtgattgagagtgacccacctgcatgtgttctgctggtgtctggtggtccagggtgggtagcagagcctcagttttatcagcagcagagatggaagatttcaacacttagtatattaaggtgtctgccaagaattagagcagttggcttcctgtgtctcctctgaaggagtagtgctggtcagaagccctgcaagatgagaacgtttgcccctgggacccttctctgctgttaagtcaagggttgtcttctagaccctctgggtcacacctctcctaacatgaggatcagccgaattacaggctcaatttcaggcagagctgagcttgcatctgatgacagcaaagacctccatgtgtctttcattatcctgttgccctgggagatgctgtttaagttggcaaatgtccttactgaaagcaaagcttgtcactggtgagattactaatcccccttcccctagcccccccccccccacactcccaccccaaagggatcaaatgccaagggaaaggagggaactgtatagctttgaaaagtgtggcgaagccatcaagttcaccaggaatagtaggggtaagatgtggtttcagtttgtttactaggttcaagatgacaatatctcaataacaaacttcagaggggtgtgtatacatgtgtgtgtgtgtgtgggggggtgtggtgttgtgtggtgtgtgtgtgcgtgtgtgtatgtgtgtgctttcctgctggcattcaggtgtgtgtgtgtatgtgtgtgtgtggtgtgctgtggtgtgtgtgtgcgtgtgtgtatgtgtgtgtgctttcctgcttgcattcaggtgtgtgtgtgtgatgtgtgtgcctgtgtgtatgtgtgtgctttcctgcttgtattcagatgtgtgtgtatgtgtgtgtgctgcctgcttgcatacagatttttgcatgtgtgtggcatgtgctgcctgaatttcaaactcctagaaatcatttagaagctctagcttgttttggtcttcagttccagacttattgatagtaaatttcaagaaacttaacaaaaaaatcagactgagctttgtgatttctaggtcagaggtacccagtctttctttgcagagaagaaccattttattttactttattttttattttatttttactttttaaccttcctctgtggccttggggccaggccggttggagaaaagactaactccttcgttcacagagcagcttcagtagatacaacctcactgccatccagtggcggttggctccacaacacaggagctgacgactagacccactctttctcccaagccttttttttttttgtttgcctctgctgctcagttttctatttttttcctcctcccaatatggtacctgcactatttcctgcctccccagtggtaggaatcgaacccagaacctgcccgtgcttgatgatccccgccacctagaacttctcagcccctgcaagcagtatttgataagaaaatttgactcgggcttaaggaactgagagcaattgaatctatttaccttgccccatattcctaacagtagttcttgctatctggctccctaccctactcccccaactaggcataaagtctgtattttctccttgactgtttctgttgctttggccgaaggattaatgctcagcgggtgcatctgctcgccacacttactttaaagctagctccccatctccctttgaatttgtactttgagctgtggttgaccaatatcctagcatggttcatgacactttgcctgcatttcagttaagggttatgtgtcccataggatctgagctggcctcagagaaggagccaactagcaaatggaattattttgccttgtgaaaaattccagccttttaaaactgggctctgagaaattaaaaaaaaaaaaaaaaaaagcaaatattcttgggaagaaatggggtttgtgagtacttggctaaaaagtttaggaaaggaaagaccatttcctctggcctcaggaacacattcaatgtgaaatatgactgtttttaaaagagcccagtttaaatttattttggggttatttatttgccttgaaaaataaatggatccagtgcttataaaaaaatgttcagaatcctatttaaaataaagtgagattttgctaagttaggcaaggtgctcccagcatgtgctattaattaaaagcagctggggcttttagacgtgtttgcaagtccgcaccatgagcagagctgttggaatctggtgcacacgtttggctcactttactggagttcttcatggtagctggaacacatgcatcttgcctacctcagtggattcatagtctctcaacacttgaccaaacaggtgggacgtttcctccacaggaagagtgactgaaacagaaacatctaagccactcttgaaaagtggcgttctgtgacccccatggattgcagcattaggcctcacgcttttataaacttcattttgattttatattatgtgtggtgtatctgtgcatatgtgttttgtgtgtatgtatgtattcatgcgggtctggatgtgttgaggccagaagtcagtgccaagtgtcttttcttagtcactttctacacagacacacagacacacacactaatatttataacatgtaatataatatttatacatacctacatgtaaaatagataataatatataatatattaatatataacattaatatagatagtgtttaagtgcttgccaaacatgtatttgcacataccatatgcattcctggtgcccatggtggacagaagagggtgtctagtccccaagaactggagttacaggttgttagttgccaggtgtgctgggaattgtacctgcattctctgaaagagcagccagtgctatcagccactggccactctccagtcccactaccctatgtgcttttgacagagactctctctagctggcgctcactgatgtacctaagctagctggcgaattaactccaaggattcatctgcctctgccttacaggtaccaggattacagacaggttcttccaggcttttaaatgtgggcattggggatgccatcttggatcctggtgcttgtgtagcaaatatttcactgatgatgcaatcttctcagtcatctttctggaatctcaagagatgccaaaatgtcggccatctggtcaacagtatggtcagtaaataggaatgtgtacatttgaaagagagataaactagtattactcagtgtcagagtaaacttctgggaactcctgtgaggtccctagtcacctggtgcaaatgagctcagccaagagaagtccccaagaaagcagcaattctccccctatgtaaactcagtaggtgtttcatcgctatgtgtggtcgcttcctcttctgctgtcccctcctataggttagaaaagaaacttggaagtttactgaacagaatttcaagtcgtggatctcagattggaaaaggactgtatgggttatctttccccacctacacttcctttccttctaaaataaaaataaaataaaatcccaagaggaggaggaggaggtgtaatgttgagatgttcggttctttcccaagaggttggggcatcaccaaggtgttttcagcccaaaggctatttaacgtttaatgaaaatttcaattaagaagtgaccctgtcaagatcctaaggctaggcctatagaaatagcagttcttggattgtccagaccgagaagtgtcttagtttccagttgtaacttaagttttactgaaattcaagaaatgacacctttggaaacatttaagtattttttttaagacctataattgtgtgtggttttgctttttaagtcttaaatcttatggaatatagaggtgcagcttaactcagttgcctctagctttttttcttcttcttccacgaggcaaacaaaaacagtatcttaaattaaatcagagtttcctgaggttctggaatcttattcctaaattttccactgggtaacctccaaggccccctcttgcctgtgtccccagttgacacgagtcaggccctgactccaggaatgggttcgatgtggctctgaggcagcgtttctggggagagaacctttgaagagaataaatctagaagggcctggaacacttttagccattgggttgttagagagcacaattgttttggagcttctgagatttctaagtagatgatgaaatttaacactgtccgattttctaaaattaccagggaagcatcaatccctggttttcgtgggttctttcagtccgcatgaataggttagcaaacatctttcagcgccacacacgtggaaaactcatttgtaaagaaaaaggggcagttaatgtgctcaggaataaatacagaagtcagggccttcccaaagactggtatccattggtatccgttcttgactgccagtattggaataatttgatgatcagggtcggcctccagcgcagctccactgtctgcttcagcaacagagcagagaataccacttgttagctactgctttgtgactcttgtggaccaagagttaatggaactctgccctgcaaaataattctggagggaaatgaggccgtgacaaccgatggggctgaggaactcgtgaacacacgaaagtatggtggaagacgtgatgtgttcatgtcagccttgctgtctgtacagcattgagcctcccaggtttgctcaggccccactgtgcttcatctaaagggaggaagtcaggatgtcagggaacagccaggatctaccactccctgcaacacccaatcctgtggctgttcacggatattggaggggagagactcaaagaagtctttaaaaacaaatatctgttgattcaaaatagcacagttcaaagtaactaatggtcctagtctttttaaagatttatttatttattatatgtgagtacactgtagctgtcttcagacaccccagaagagggagtcagatctcattacggatggttgtgagccaccatgtggttgctgggaattgaactcaggactttcggaagagcagtcagtgctcttaacctctgagccatctctccagccccaaccctagtctttaagggaaacagtttgtacttgcttattagaattggttttttatttttagagtctataaactatatgtaaaaatactttgtaatgttttatatgctacaccaatttatggcttgcttattaatatttgatttgggtcaagtgagtatggttgtttatcttgatctctatgaatccattgttaggtggagcatgttgataatcttaattagactttcccaagattcctatcagtgagcagttattttcaggaaagaccgtccttcacatctttgcaatgagaagaatttggcttgatgctccatgaaaattgaccatgtcctggtgtcctgggccatttgcataccatgtttcctgcatcagtataatggatttttcttttagtgagttgaagagggtggcttttgtgtgggcaaagacagagtacctgaagcctgggactggggaggatgtgcagtgtgtgtatgtgtgtgtgtgtgtgtgtgtgtgtgtgtgtgtgtatgtgtgtgtatgtgtgtgtgtgtatgtgtgtgtgtgtgtgtgtgtgtgtgtgtgtgtgtgtgtgtgtgtgtgtttgtgtgtgtgtatgtcggggggaagcatcggcaagttaagaaagggttaggaaaggaagggcagctgctcggcaagcatacgcctcgtgctcttctgtcccctagtatcttcttactgaatcgcagtgcattcactgggacttttgtaccttcgtgacttcagatttcaggggaggtggtatgttgggacctatcttgcattatagagcatcatcaggtatggccactgtagggagaggtcagaagtacatcatagaggcttcttgcacatcgctatgctaggtgccgtagaaagctggcatgatgggtggtctggaccgaggtgggagcaagtccagattactgcgacatctgggcttttcctaacctctctctagcatcttgagttaaaggagcaagtaacagatttgggaacttagagaaataacagacaggcagacctaagaaagttcccttaaactttacccttcccttaaactttaccctttctgtctaatggaaagatagctgacatgacggagtaaccatgaacttgacccctttccctggcttaatgcagtcatggcagccagttggcacatttcctgttctgggtgtaaaacactctgaatgtgttatctgtttgctgatgcttttatatgtatgttgcctgcaaagttatagtcttcctttgtcagataatttttccagagtacattaacatttccaaccaatcatttattgtatagcttaaaaaaaaccaaactagaactgtcatttctgagggagactccgtatctaatatctggtccctgctctgtgttaactgcttgttcacgcatgcattgtgtgcagcatctgttacccaggaagtgacatttccgagggagattcccctgtggaaaacataactttcccattctcttgctgcttttccagaataattttttttccttttttaatttggtgggttttggtaatttgtaatacgtggtctaagatggaaactgtctgcaactctagtctctgttacccgctccccaccaccaacaccttgcaatgaaaaagaacaaaagctactcacgtgtttaaagaaaactctcttctgggcccaaacgattaaaggctatttgcattatgaaactcgttgtgctttttataagtgttaggtgctgggttgaaggtccacaggccacttctaagttgggttttaggagtcacttcatgcaggaagacagctttgcagcttaaggaatggctgcatggctcagccattctctgtcatcattcttatccgaagtgtgcagctcagacttaagactgtaaccaccacccttgaaaaatagttccatgtcttcataagaatgaggtcattaacccgaatgctctataaagactgaattggtgacaactgtactactaaaatgtataccattggaccatcttatcaagaagaaactcagttctataaggagcctgcttctgtctctaatattggtagatatttctacctcgaccccttttatattataacttctgtccatttgtctttcagccaatatgggacatgttaataacccctaatttaataaatgaaattattcctgctcatattgtccagatgtgaacctaagcagaccgtgtgggctttctgacttaatggctaagcgatgccagtctttccctggtaattgaaccttctgtcatctgcagttagcagatgatggtctcgaagcaggaggcacacagtcaaacttcctgttcgtttaaagggaagccagggacagatggagaagcgtcagatgcaagaaccttactaatcacaccgtttcagtagagccctgctcatgtcctgctctcacgctggacactatgacaaactccgagatagctggaaacccaacaggtttttggcttgtgtcaaatgctgtgggtgttcccagctccactcagctcagcccaaatgcctttccaggagggcagagccatcttgaataaccccagtaaaagtgtgcctgcttactcgatcctcttggaacactatggtatagttcatttgtttgtcttaatagtttttattttgaaatgaatacatcccccagatgaccaaagccacacagaagaagatcggaagactgtttgaaagagcactgctgtctacccagttctgagtctaccagtcttgtgtcacagcctgctggcaggtccttgctctgtgctgacattgttccaagtgtgactagggcgggcaagaatgaccgtaaaagttttggttaattcattttctgttttacatttataagagtaagtgcaggatgcatgtcaggaaacttgattccacgcctccttctgttcagagcccctgttgcagggccctgtgacttgtttctgtcccagtctgaagtccacatggtggctgtgtcatgtattctgcgtgatttcatctaagatctggcattttccccttccaaagtgaatggtcagttgggaaaggagagaactgtgcccaagctgctctcacaagcactcttgtggtttttaagagtgaggagggatgtgtgtcgagtcgctatgatggggcttgcttccattggacagccagcaatcagatatgctatgcatttaatggtggactctcttaggaaagaagactatgttctgtaaaggccagaccaggcaaggagcagttctcacttcctgagtccgttctctggccacagaaccactaataatgttgccatctggctctggacagtccattgatgaagtacttacttagtacatggggagtcccttgaattgaatgctggttctggctggtttggttgtgtgagactgaacaaattctttatctgggtctccggtctgcccacctcctcataaagatgggatgatggcagagccctcctcacggtgttgtggacaattgtatttggaaatttcagtacacccactcaagtccagaatgtagcacatattaaatcatcatcatgttggccacgacgatgacgacgatgacgacgacagtctttgtacccacagttcagatgctctggccttagtgcattgtctctgatcttgtgtggaacgggattattttcccataaccacattttaaaaaacatagttttctgaagaatgaaatgactgaatggtaacacacacacacacatacacacacacacacacacacacacacaccccagtaataacctgtggtgggagcagagtgggctcctcagactaagccacctgtccctgtcctgtcattgactgactgtagtagttcacaggcagatttgttcccccacccttttctcagagtcctatagtgctgtgcatgcattgctcagaattccaaaaccatcaaaggaggttactttgacagatgactcagaagtagggaagagtgaggactggaaagagaagccctcctagagccttaacctctttgcgggggggggggggggggggcaaggggaacttgacagggcaaactttacaaggtaagacaatgaaaacaacaacaattctaggatgtcctactccttggtagaaggtctctcactcggcacgcttcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacatggcccgttgtcttctgcgaggtccatgttcagaggtcaccggaagctcttcagtcttttttattctagcagagtgaaaatgaatacttaatttgcaaagcctgctttaagccccacaccttaggttcagaaggataggtcattgtaaccagacgatgtgtcagtgactcctaccaccctctcactttctaatgttttgcacacacatttgaaggaacctgtgcttgctgatgccagccatccctaacacgtgattgacagggtttcggtagcatggcagcagagaacactttttggatattttctttagttacatttcaaatgttttcccctttccaggtctcccctttggaaacccccctatcccattcccccttctcctgtctctatgagggtgcgccccccccaactctcgacctcccgccctggcttcccttacactggggcattgaacaccctcaggcccaagggctgctcctcccactgatgtccaacaaggccatcctctgccacatatgcagccagagctatgggtccctccatgtgtattctttggtagttggtccagtcaccaggagctccggggtgactggcctgttgacactgttgctccctatacggggcggcaaaccccctcagctccttcagtcccttctccaactcctccatcagggaggggaccccccacgctcagtccaatcaaccattggctgctaaatccacctgaaaggtgtaaatttaatactttcctatttagctatgtttccaactcccccctagagtttaagaactagaagcagtttaatatggctggtcttattaatcctattaatctttgacaatttctctcagctgcaccgcgaggatcccgagatactggatatttagttcaaagttccctgactctcactgcccatagagaaaccaggaacagctcaagcatgttcctcctcttttggatccccctcccccccttttcttttctagatatagtgacagttgtgcctagaagaggatctagtcatacaaaacataaaactcacagagaggccacggctggcttttaacccctctctggttttcctaagtggcttcaatgagcatgtctttacaaggctgttgcaaaagcgaccagcaggcggagccctaacgcagtcttacaatgatttcttttcacttctccccttgaacgaagttgcccaagcgctattggagccaattgaaaacatctgttgttttatttatagctacaatttctaagaagcatattctatagcggttgaaaaaggagttgacagctcataattcataaagttactggggctaatctgatagaacaaaatgtacaaaactccttcccatggtgcaggcgctatcacttcctgttcaaccctacaaagaagtagtggctaagcggggcggaaggggaacacagaaagggtcctctgtgagatgctaatggcagaagagagcaccccacagcgagggcagtgccttcccctctgccaggctgagtcactggttctttttcattaacaacatcccaggtatttccatttatagaaaatcagcattttcccaccaatcccactttgcagccaggaagtttcagctgcgtcctgtctgcaggagtaggagctaaggtgttgattaaaaagcctgactggttgccacccagatgggcggcaggcttattttacaacttttcattcagcaggttgctcctttatattgagttgcctacttcacgctcccccccccgccccccagacctttaagcaattattacgacacaagcactcctcaaatgtcatctccctgtttgttagcttattctgagaatctttggcggaacaaggtcagatgcaatcaatatatacttaatattttgcgacagttctatctacagtgcttcctggtattgcagttaagggaaaaaaaaagttagcctgacataaatgagttgccatagcttagtactagttccaactggcggtgcttgtaagagactgtactgagacagtccatcttgcttcagtgggcccatttaacgttcttaaagccaaggtcacttctttagtgaagaggtgggtaagtttgtgttcatttatttgatgaatgtggtgtcttttgatagaggaaaatgtgttcgcccaccagaattaattgcccgcgcggaacagtagtagtaaagacatattgcttgacttctttcaaaccatgacccttcacaccattaaggctgtgtttacctttatctcaagatcatttgcctttattctgtggaataaagctttctgcctgtgtcttttttttttttaattaaggggttttgttaatgaataactctgactgttacaacctcagtttctcatgtatttctcgaattttattgtgaattttccattcagtatttttgagtcattcatctttcttgcccatcccatatgcaatccatctttctcttcttcttcttcttcctctgatattctagtctccatatattttgttgtggttatttatttttacacgtatgggtgttttgtgtgggtgccgtgtgcatgtcctgccttcagaagccacaagtcgtcactggatctcctgggactggagttagccattgtgaactgctgtgcgggcactgacaatcgatcctgagtcctttggaagggcagctaatgctcatacccaccagtgcccaggtctttactggacctttcttccacctgatgactcacagtgagcccttcatagtttgccaaatatgataagttggccagttatttttagctgaataaacccagtgacattcctgaggaagaatgtgcttagtttagccttatgagaaaaatatttaataaatgctgtcccaaaaatatttagcctggcaggggctcaggcctgataaaggagaagtgatggtaagatgctgacccaccaatcccagcccgacttgaacaaacatgcttcttgtcaccaaggcccgtacgtgttgccaggatcgtttatatccatcttattcaaagctttttgcagcctctgttcttggctgggtaacctccagcgcgcaccaagtgggcctcccaagaaagcaaactggatccattcagattagtttgccacttaactgctgtactaactttgggcaaatcacgtcgttattttaaatcttccttttcctcatctgtaaaatggggataattatacggcctcccaagctcttaggggtttgagagtgaaagacaaggggcttctcacctctagtcatggtaactgggctccactgcatctccaatgccccatttccacagtctctccaaaccacacatccaaaccaaggagtcttgcccttagccagaacttcgggacctcagtcaagttgtgactctcgagatgcaccaaacaacaagggtctctgcccccaatatctgttgatatgacattaggtaggatatccaacttaatcactgagacagggagaccttctacttagttccatctgctgcgtaacacaaggtgttttgcggagtttcactgtaaaaccagcctttgaaaccaagcacagctagggaacagctatcagtattctggctcctggcgtccttttctctttatagctggaggaacactcatcctcaattcttgctccttgaaagttgtggtctgagatctcgaagcatgggtatcaatcacttgctcagctggaattattgataagtacctgaaaccttatacagcaaccctctttcttcatcactgtcagaaacattcttacccatagaggtgttttctaaatacttaaaagagtttgctactgactttctagacaaaggaagttttttgttttgttttgttttgctttgttttcactttaggtgtggatcttgatacatgagctcaggttaccataaaaccttagtaaactctggtaatttggtaaagacctggtaaggaagccttatgcctccttccacagatcctcctctggaaagtgtgagaccactgctctcattatgaaggaccccccccccccatacacacacacacacacacacacacacacacacacacaaacctcatttaaactcaataatcttccagaggctgtctcttgagtatcctcactttaggggcagagggtggtacctcaaaggacttcaacatatgatttatgggaaacacaatatagtccaaggcaactgaatcacatcccttaccttgaaatgtaccataaaaataattacagataacatttatgacaaaatattaattgttgggtctaggtggagtatagccaggcattcaagttttcagtatatttttaaatgtcagagaaaagtaatggctgactaggatggggtctggtgattctctgttgcctctgatgtccatccagcctttcttaaaactctcagcattgttcatctgaaccagtttactgctttggcagctcctcctcctcaaattctgtcctccgttggccagcatttgcttctgcctgatcagtgggtttgccagctgagatcagacatcttcctggcctctggggtcaccatgttaactttccagtcccttccatctcctctaattgcatctggggcttctcaaactcctcctatgatctggcttcattggagcatttgtaacacgtttttatacatttgatggtgaggtttagtatcaaatgtatataggagagatgtgagcattgcgtccagccctcgctcaccttgttctgcaaggtgttcctacttccatctgctatgaacaggggtgcccactgctccactgtgtgtacccctgattacctgtatatcaaaacagtgtgagaatggaagagaatacatctgctgtctaacttgggggcaggagatacataagcggatgctgctgttgaggtggcttttcttgaacccaccagtacttggccattgcctgatgggaatgaggatcacatgtcttctgtattacatgacattcttactgcagttaccactgaaatttgggaaccttgaaattttgggaaacatcatagcaaacatgtccaaaccagggactgatgaagagaaaactggcccatgctaagcacatacacactacttaggagcttatgacatggaccaagtggcttaatttctcaacttctgtttccttgtctttacatcaaaaaaacaataaagactatacatctttgagctggtatgaaaaaagaaaaaagagcatacatgttaaaaggtgtggggacatttagctggtgccattaacactccttccttcatgcattcaacaaagagccaagtgccaccacgagaacatatgtgaaatgtgatttttttttctcttactccccacttccacctccccattctttcttttaggggttatctaagtcatgcttcaaatgaaatctttctaagccaacagaccaaaggaccaacttccttataaatcactggcctttgaaattccttggactcaactataaattattttcttgctaggaaatgggggtggggggctcactctcttccctatttacctcctgctcagcattttaattcgctgtgcacagtaagttgtcatctttacatcacattccaatttaggtgataaagatcacaattaattagcttgcctgtcaaagattaagtgtaaccttgcccttctgtatcctgaagtcactttatggctttagtagaggccgtcaggcaaagctgtgcacctgcatatacttcctaagacctctgcctgctgtttgtttctgaggctgacctagaagccagtctagaaataagattaagtggacatagactcctattctcttctgacttgtggagcaaaaaaaagatgaggcaggggatgaacttggagatgttgagaagtaaggagtgtaggatacctgcaaggactctcaggcgtcagttcaaatctgttagccgcctgaaaatgtcagtgttactagtaaccctagttacctcagaaaacagtggttacacctgaaaatttactttcacatcaactcccatatttcactgcccatccttgcgtcttcattctccaaagcaaaacctagttcacttgtggaagcttaatagaatttatcacacaatcattccaacttagtttatccttcagattcagagacttgaagtcaaataacttacagactagtgttatggtccttattaggagacaatatgataagttcaaaatagtataatatttgagttaacttctgaaaagatactgagtattatttatagagtgagaagcaaaacgttaataactactctgtcagatacgcttcaagctcctctccttaagaagtactaggaaaactgacctaatattatatagagagtctacttttaaattttgtcatcgtgaatgaatatcgaaaaaaatcttttaatggagcagggaagattgcccagtagttaagagtactggctactctttcagaggacccacactcagttcccagcacccacgtggcagctacaactatcaataactacagttctaggggattcagtgccctcttctggcctccttgggcacctggggaacatgtggttcatgtagagacatgcagacagacattactagatgtaaaaatgaaaccttttaaatctattaatcattctgggattaatgattgtctttctacaccctgggtactttgtccactaactcatataattactcccattttacagaaaacaaaaaaaaaaaaacaaaaaaaaaaacctcaggtctaaagtcaattaacttgtccaagattactgttcttaagtggtaccccaaggatggaaacacacgtctctttgtgcttttaatcatgtcagcactactgatgaaaccagtgtgtaccaaaatgaacaaacccatggtttatttttctactttgtttttgattcttagtcttactgtcttgcccaaagagcgcaccagcttttgatgtggcttgcagcccacagagcttaagaagtttgaagtccagggtattagctgttataggtagacagtatgaacgtgcttacagcgtttgtttaagaaaagaattggggttgctttgatttgtgtccactattttttttcccctcttttgaagtcactagagaagattggtacagacagaaagaaagcttggattcagcaagtcagtagacacgttaacatcttgacttaatatcgatcccccatttgcatatatcctttctttcctgtgtagtccatgttagattttgagtggaaacgaggaacttttcacacacttccaagccgcttccattaggaatgaaatacttggcttgggcagtctctgcgttttgatgtttccgcttaaactttccactcgctcctgccaggcactaactttaaaatgtctttttcttttcttttaattttttttttttaatggagaacgcctccaggagctgcagctgtgtgttggtttcatcttgcacttggtagcgctggcaccacttagagcacagaatgctcctatctcccacacacctctggtgcccaggagtgttgaggcttgcccacttcagtagtctgggaagggcttcaggttggagagaggttctcttctgttctgtgattggctgtccccagggtccgcagaaagagcaaacagaacatgctgcctccaacgtcgcatgagtaatttcttctatgacctggggctcctggttcaccggagttcttgtaagtgtggaaggctagcctacctgccttccttagcaattagacatactagtttagactcactcttctcagacctttcgactcttcttcctttgttttctttttcctttttccttgcacaacattaactttttctgatgaaaaatgatttggctaagtgagagactgggcttgggtgtgtcaggaaatctacagatacttccagatgcggaagaaggattgtagctctgcagcccttagacaacgcagtagggcaagcttccaaccccaagtgcattctgattcagaagcagactgtctggagaattgcatcgaatggaatgtatatgtaaaatggaaatgttcagcctgctaatttgggttttgcttggcagccccaacctgtatattctgtagggttttttgtttgtttgtttgtttgtttgtttgtttttattgaaatttttggtaccattttgttttatcagagtttgatttgatgcttcatcatggacagggaacagttagcctgttagtcatccctagctacttacttcctgctggaatcacttacgatgaaatctacggacagaaatataggtcttacatgtgtatttaatggggttagagaatagttaggcttagaattgttgtaagaaagtaacacttgttttagagtgctgtttagaattccagggatggtccccattgtctaaagcaggcaatcggaacggccgtagcatccaagcctgaatatttctgagaggaagcgtgccgagtgagagaccttctaccaaggagtaggacatcctagaattgttgttgttttcattgtcttaccttgtaaagtttgccctgtcaagttccccttgcgcaatctccatcagctgttgtgagtcatacctttgcccaatctagcttcttcggtattaaaaaattcagctgggtatctcctcgatacggcacaaaaaaggagaactcttcctccccctctatgtgcacagtgctttgaaaaggccagtgttctcactacagtggctttcagagacctcatctagcagtagtctagttgtgagatggagacactctgtagctcaggatattgatttttgttttttgttttttttttcagctgaagtagaggaagatagaaacctcctgtgtgtgcaagcacttgcccagccagcaactgttgggtgcatatttcaataatagttacatgaaatttttaattatcatttaatttagtttttatatttgcccatggaaatgatcgagttgataagattttggaaagagataaactttattaagcaattccgatctctgtgccagtgggttttttttttttttttccgatgaaaaatgcttgtgttacatgtgaaggggagaggacttgaggattagttatgtgagtgcggtaggggtgtgtgtctctactacttacccttgggtttgggatttgggctgtgctgaggcttgttagcaggaagaccctgtactgaatcctgatgggtagctcttctctttgtcttcagtttcttctgtacatatgtatgtggacaggatgaccttcattttgttccatgtagaagggaaggtatttgtgggagaggatactgctgtgagctgaaactctgaagtcaagggaagtggtttaaagtttatcaaaggaaatgaaatggtttgccctttgcagctgttgctgctggtgtgtgtgtgtgcgtgcgtgtatgtgtctatgtgtgtgtggtatgtgtgtatgtgtcttttgcatgtttgccttcttctagccaaggtcttttgttaggagatagcccaggctgtctcttaccttgtaaccttccagctgtagcctcccaagtgctggattacagtcctgcactgccattatcagtgctgatccttagtacttacaatgggtttagttaggaattttcttaacatcatatacaacttataatatttgcagcgctgaaacctaattatgaccatttagtgtttctaggagtatatgaactgtctgttctagctaattataaacacctgaacttatgcattaatgacagacaagttactcctgaagatgtcgtcattaagattcacaacctgtattttggagtttgagaaatttaaggtgaaatgtttagctccctcttctggcatagttttgaaaactacttttacttcagccacccccaccccctttctgaataagaacatggtcatcactgtaatgttgtcagagggaggcatttgagattgtcatcctatttgatcgtttgtattgttgccattggtaaaatattcacataacatatgaagacacagcatatcacaatacttggttaagagcatttgttgctcttacagaggatccaggtttagttccctgcacccacatctgtaactccagttccagggaatctaatgcattgtctttcctcaaaagtaccaggcacacaagtggtgcatatacatcatatacataaatgccagcagaacactcatacacataatatgaaataaatcttaaaaccatttgaagtctctcttttcctacccatatatatatatatatatatatatatatatgtatacacacacacaaatatatatatatgtatatatataaatatatacacacacatacacacatatgtgtgtgcgcgcacgtgtgtgtgtgtgtgtgtgtgtgtgtgtgtgtgtatgtgtgtgtatgcatgcatatgcaagcaaagatttttgacaacatttacacaggggctaaatttgctgttgggtggccagtggtcatttgtgttggcttgcagtgataccttggcattgatagaactcagtgcaagggcacaaaagaacaccaagctactaggaagtcagatatatcagttatggaccatgtaccatggtaacagcctatctcaagattttatctagtctcgcctacctgagcaacagttctttcataataatgtagaagccagacttgctttcagagtctctggacttcccctggttgtgttcaggacatggggctgaagcatcatctctttattctccctgaacatgcaagctctaggctagcctggagctcctccacctaggcccagcctgtactccgaggtgccctaacatagggcagtctgtccttggaaagatgccccagaggggagaacatcagaagcccgttgctaggggattctgggattcttggtgagcattcagagagttctctctggaaggaaacaacacatatgtctctggggccccagcactgtgcagcctggcataggaatccctttaggagactccagtttcctatggttgggaataattaaattacttgtatttaactattcttcattgtgtttgaatgcgcttgactgccttgcatgaaacctaatgttggaaatctttctctttcagcgttgccccttcctgacctggccgagcagtttgcccctcctgatgttgccccgcctctccttataaagctcctggaagccattgagaagaaaggtaaccagacttcttacaagttttatttcatgactgttataatttataagtatctctgggccactcgttatatgactgtcttactaactgctgtggatagaggctatgttatccacgcactagttgtatggggaatctgtactgggaagaaatcctggctaataatttctaactctaggtcagtgagtagttctcaactttcttaatgctgagaccctttaataccgttgtagtgatatccaaccataaaattattttcattgcctcttcatgactgtagttttgcttgtgctatgaatcatattgtaaatatctatgtcttcctatggtcttaggcaacacccaccaaagtggtcgtgttctacaggtagagaaccactgttcaaaaactaatatgtgcttactatgtgagagctattcaattctttataatttaataaagatgattattaagatcctgctctttaatagtccactggatttgccaaaattattgacataccagataaaattaattgttgaggttggcttccgagaatatttagtacacatctagaatagatagcggatggaaattggaatgtccctctggcagcaggctcacaggttctcctgagagctgtgttttgcatacatggtctgttttgtgtcctaggactggaatgttcgactctatacagaacacaaagctccagcaaccctgcagaattacgacagcttcttgattgtggtgagtgtcacgggactattataaatgaggataaagtttctgtttctgatgatgtacctcacccccattcatacagcactgtaaatctcaaagggatttccaactcacatgcaggagttccttctgccccattacattagcatccacaccttagccatagggcttctgagttgggactggaatataagctctcaaccctttccacatacacaagcccctgggttgagcaggaattgcagaaacagccttttttggcatttacctgactctgtgtctctgtcattgtccctgagccttgcttgtcagccacatctcattcatttgggtcagccaaaaagattctaaaagtctgtgtcatttaacgaatgtctcctggtgtcctcttaccctttcctgtctctctttccctcccacctggcttgctggctgtcttgctcacctgctcactttttcccaccctgtacacattgaggagcatggcatcgggtgctttcttcagtaatgtaccgataaccctgcactctgcagagagaaagtaccaggttagtgttgagttatccctactgtgctggctttcaggatgactaacatgccattgaacgtggaattaggagaaattgagaacatttggcctcctgaaccagcaccaggcaagccagctccgacacaccattacttaggagacaccaattcattctgccaaatggtggcttcgtatggcttcctcttttccttttccatataggataaagtagtacaacttaccctggctgccttccttctcatgccagcttctctctctcaagcccttcgtcccttcacagtattctgtccctttctgtttctttcttggagctttctaccatgcatcctttacccacgtttgtagatttaaatgaaagagttgcatttgctgctgttcttattctgggcaaggttctgtcaaaaccctgctcgaatggggctgcccacgtgaccctcacaaggtaaccctttgaagagagaagccacttcgggattaggcaactcagggaatttctacaaaaggtgtttcttagaggaaagatcgagactagatgcttatcagtgcttgctttcacttgaagcaaacccaaccaagtgtctgaactcgggtccctcgtgtgccttgaactcagctgagcatgcacagggagggctgcattgcttttttgtgtgccccgtgctcttaccaactgggccactggaagctgacgggcaggagccttactggagtggtaaggaaacgctgaattttgctctctgccaattaaaatagaattacatgttttggttacaaaaaaggggggggggtgttgtgaaattgaacacatgctaaaagtcacaggaaacgtaaagacaccagaaactaatgaaactatgaaaagttgtggttaaggttttaatgttaccaatacaaaaaacgatccgggttagctttggaaaaagtttttgctttttttcacaccactcatgagatggcgtaaaccaccaagattcgctcacgtcagtcatgcattttgacaactttccttccccattgacatcaaaagccacatgcagaaaactggtacacgttcctagcgaagaaagagcaaaccttatccaaacttgggagcttgcacatctgccagagtgtctccgggtggtggccttttcagtccatgaagctattagagtatccatggaagcctcagtttcacctgacagatgctggctttcaaatacccatataaatttgcagtgccagccagccagaggtgggcagccacctgcttttcctcgcccttttacagcatctcatgttaacttgatgctgctgctgctagtgactcttaagtctccagcaacaaaagccccgattaagcaaattcttttaacaggatttagtggtaaattagcaaagttgtgatttatatccagattagattagtctggttgtcccagccttcctctcaccttcctcattttaccctaaaacatttttttgttgttgttgttgttgttattttacttgagttttaatggtctgaattttctcctgacaccttttggtttctcttaacttgagtacggcttcttcaacctggcgctctgactgtgttctgccgatcaagagtggaagaatatcatgctcactgcagggtatttagccacatccctagcctctacccaccgggtgccagtagcatccacccccagtcatgacagtcaagaacagtctccaaatagtgccagactcttcctactctacccccacgccctgggaaccactaaaccagatagagatcaacctgtggctggctgggggttgggggggtgggacttccccggggaactagagtagtgaagcattaaaggaactggttacccatcagtagtttggtgaggagtgaagtgagggaccaatacctcttagctgtgggtagcgaagagctgcccggtggtattaattcagaaagggaaccatgtattgcacatgtcagaaaacccagggcatgggagaagtcacaaaaaaataataaataaaaccaagtgtactctattgtcaactcccgtggatttatacacatggggaatttatcccaagacttgtgaagcataatttcattcaaacactgtgaagactccaaggaccgggcttcctagattcttcataaggtctcggaagtgagcacctcccaagggctccagacctcatctatttaccacagctcttgcgttggctgctgagcaaggccggaagagcaggggagaggcacactctgtccttgaggccccctaagtgtgatgtgagattcataaaacatacaaactgcttgccaggtgtcctagtgaaggcattgctcatcagcccctgcaggaaggagcactaaggggatgatgcctgagagaggaacatgggactgcaacacctttaagtctacacacgtctcctaatgggtgccacatatatttttcaggatgagcaagtttcgagataccccttttcaaggcagagagacgagacatgaggcatacaagggccacgtctagaggagccagaaacctcagatgctcatataatcttaattggcattacatcatttcacaaataattgctcagtttcaggctagatcctttatgcaaaggcccagcagggcctgtgcacctttgttagcatgtgctctgtggtcttgttagctctctagggtattgaagttatcttcttaggtcttacctcttacagtttttccttgacctggcctatgtacatttatactaggctgtggtgtcacagtctcagacatctggctacttagtgggacaaggtttgcttaatgggatgatgtgcccaaagactttctgtaccgcagtctcaccccagattcccatagcttctcagtttggaggtcacttcccataaagggatgggtaacctcatgtagtggtcataaagaagttgacaacactaaaggtttctgagctaagatttaagtcagacatgtaacactctaagatgttttttggccagattgacacacgcatcgcacttcactttcgctagccttagttctgaacatacaacattcatgcttctcactgtgtatgggggtccatgttgtcaggccacttgcacctaagctcagattcaacactattgtatgttatggattatctacacagagattcctgccccatagaaacagtgtgaccgaactatagaagactttgacgtgaatctttcatcctcaacatgtctatcttaggatgtttgtatacagacacacacatacacatatatgcacatacacaaatattaatatgtctttggattgaattatataaagatgtttgatcgtaaaaattgttctttgggtttcttttttttaaaaaaaaaaaaagttaaataaattttgggctggaatcattaggaaagaatttccagaagtatttggaatggcccttgacgtataattccgtcatttagtatcatggatttatacaaagcgacgtcccagcattgacaatttttaagtcaacattgattacctccaaaagcactgaagatgctctgtatctcgaagcatcaaatactcagctaagatttactaccgcataagaataaacaaagaaatctctaattaatatgcaaattagctttcacctttaatcaatgataaaagttatatgtgttcctagcaattctggtaaaataaactgctttataatttcattaagtatttgctttgtatgcctgttttatgtacctaactatttgggatcatatacaaatttcctgggtacaaagagatcatgaatgggcaaaggtttttttgtttgtttgtttgtttgcttgcttgtttttaattgaatggggcaagtttaaggagcctgctttgcactatcatctttagttcgaggataacctaaatactgtcctcgccttacgtagaagcatcttaaagtgactctggcatttctcatctcccagacactgcctgaatcagctacacactaggttatatctttatattatcttgctccgtatatctccttggcagcagaacccccagtgccttagtgaaggcaggagaatgagtaatgtcaggtcctccttctgagcacactgttccccagataaggtcccatcaccaaatgcctctcttctatggatatcctggatccttcttgctctcggtacacctgcttcctattggccctcatttcctgtcccatcccaaggactgaactatgcacacctcccgtgtacaggaaagtactttaggttacccttggctgaatggcgtggcctccttactagccgatgggaaagctgctccttttctctttcttcccagctagtttgatgctcacagattagaaaggagcagcattaggggaggcattctgagcctgttcagattgctcagtaggtaatctggaaatggtttgctcttctgagactattcaaattgttctgtaggtaatctggaacttgtttgctaaaagcctgtagtatctagatgttcggttgatcactctgttagggttatatttcacgcagccttcatcagttaagatttgggaaaaccagggctggagagatggctcagtggtcaagagcaccaactgctcttccagaggtcctgagttcaaatcccagcaaccacctggtgactaacaaccatctgtaatgggatctgatgccctcttctggtgtgtctgaagacagctacagtgtactcatataaataaaataaataaatcttaaaaaaaaaaaaaaagatttgggaaaacctggggcttctcttcttcctgtagtggttcgaggagacgctgattgtatggtgagctatttccaggacagagcctcctcagccacagcagaaccactccagaaaactgaataaaatgtatttctcgcacagcctcacaggctggaaatccaagatgatgaaggtttaggccttgttcgcttcctttgagattccctttctaggctccccaacagccgcctctcagtgtgtctttctgaggcctttcctctgttcccgtagtccctgtgtctgtgtctgtgtctgtgtctgtgtctgtgtctgtgtctgtgtctgtgtctgtgtctttgtcttttttttataatgatgccagttagcggtcttagggtccactctaataaccttgtttaatcaaatcaccccttacaggatctctctctaaaccgtgttctttctggaaaactgggcctttgacttttaatacaggcatggagaggatgccaccttagcagtgcagagtattaactgatcagtaacagtggcatatttttgttgttgttgttgttgttgccccaagacatatgggattaacgtgatagttaaaggcggattgtgagacagaactccatgaggaaaagctgttctgtcccaacttcaggaatgaaacagtggtcagtgtgccatgcttctgttctgcatcgctcccttccctgtgtctcgtttaagtcccacacttggaaaactggcccaacagaaagtctgagtgcctcttacatggtttcttacattgtttctcttccagatgccgcgtcagtggacttggagatgatcgacgtacacgtcttagcagatgctttcaaacgctatctcgccgacttaccaaatcctgtcattcctgtagctgtttacaatgagatgatgtctttagcccaaggttggttctctcttttcagacctctcggaatggatactgggatgtaggtatacttggcactctaggaggcgccaacggccctgtataagtaggaggtgttgagaaaacactaaactgccaccccagatctcctttaccacacagcatctgatagaagacaccctattgtgtttgctcagaagcctgcccaagtgagaaactggctaactgttaactttttgatcactctctgcaaagaccactgcagctaggcaggccacagccatctagcaccggattcggagatccagtactagagtgcacgatggggcatatttttgccctcttccctgaacacccagaacaaaatgtgtcgagggtggaagactcagcatcgggagccgaggctctgctcagtgctttggggacaggaaattgtggtccgtgaccttcaaagtataacctgtgctacttatctgatgatccgaggaagtagccaatcacgcttggtgctgcctgatggaggccaggcttctgagagcacacccagaacagtctgtgggtttttttttttttttttttttttttttttttacaaaaagagttgtcttgtatttcatttgacctgagaactttactttctcacaatgcatttcttactaagaaggacaaatgtcctaggtacctttcctgaagatgtctgtgtgcacctcctcgtgtagctaagggagagagaagaaatggtcaaagcgttggctcaccggcacctacacctagccttactctgtttcctgttttgttttgttttgaacctgcagaactacagagccctgaagactgcatccagctgttgaagaagctcattagattgcctaatatacctcatcagtgttggcttacgcttcagtatttgctcaagcattttttcaagctctctcaagcctccagcaaaaaccttttgaatgcaagagtcctctctgagattttcagccccgtgcttttcagatttccagccgccaggtaagtgaaggatgaaaagaaggttcggacggtatgggtgagagctgatgagtggccctaaattgatgcctcacagatgcacgttttctggggacttacttcacacacatcaataggatgtagatgaatgaaaagagaattacttttagaaatgatggttctcacaaaatgctctttgttgcagctctgataatactgaacacctcataaaagcgatagagattttaatctcaacggaatggaatgagagacagccagcaccaggtaaggctctgcaacatttgacattcacttccggctcagcttttttggaccttgaaatcggtggtttctagctccttggaattaacacagatctctgcaatccatagtaatatgctaatttatggttcatggaaaaataacagtggtggtatttgtgaaatgtcatatgtcgggttttgcaggttttaagctaccttggttttacttttttattttttatttttatttaatttactagcttgatacaaggtctcaccatgtagtccaggctggccttgagctcactttgtagcagaggttagccttgacctcaagattccttcatgtctccatctttttgtctcagatgagaatagagagagctccctgggccttccaccacttaggcttcgggctgctgaataaatttatggagtttgttgcagctgttgacattttgttgttgttgttgttgtttttccaaatcttacaaagtagggggatttataattactatataatttaaagtattttggagtgtgtgctttggaagtgactataccaagaaatgtctgtcaaaataaacattttcagtaacgcaggcggtatgaaagcagtgttctgctggggctgtttagaccaagccagatgccattctaaaagcaggtgggccttcagctagccatttaagtccaggaagttcaggaagcaggaagagcctggaccaaagagttcaaacaacctgtgatccagtagcagttagcttactgggctggccttttagattgattgtcagcccttagcaggagagcatagttgcagggccaagagataagttctgcttgtactcctcctcggtgccaggcttttcaatggagtaccctgcttcttctatctgtgatgggtaactcacgaagattagcaccgctgtgtgagcagccagggggtcagagcatcctaccgtgcgtttctgtctgtcattgcaaggtcagctgtggctctttgcatctggatgagacagcttgagagaggtcaggtcttgggctcaaaacatggatgagcacccaggatgcaggacctggaaagaggttctgtggactggctcaaaatatggtacctagagatgatggatgaatggtatattccaaaagttccaaaccacagcagacagcatttaaccagggtgcccagagctatagacagtgcatcaaggaacctcagcctagcttgggatttgaggccaagggcatcaccccatatgatcctgagtttactagagaatggattcaggagtgttgggttatccttgggagctgcttttgaccttaacggggaagaaagagtgtggaggcatggatgtggctgtgagctatagagattgcctaccctgagactcaccacacaggctaggaaggaagaggggcaccaagaatattcaggccctgagccaaaggcctgagctgcaaatgttcacttcctcctgcttgcctttggctgtttgtcggagaggaggcacagctgagctttgtgtgccctgaagggcttgggatggtgccgagtcgggtgtggggaatctgacgagctggtcatcatggtcttcttaatggcactctctggcctcattggggaatatacatggaagcccaaagccagacaggactttcacaaatgaattgattactaagggcttatttgtctggggaggggggagttcaccactgtagtttaatacaaatggattaaatgtcttttgtaaggttgacttataagagtaagcacgtatcatcagtatccattttcatactgcggctgatacacagaagagggctacagtgccctgcatagacgcttgtatactaatttcaaaggaggattagttccgtcagctcggccgaggaatgacggatttgaacggactggattgtcccagtccttgtgcggcttcttcaaaagagagagagaagagaaaaagaattaaatccaagtaattcttaagccctatgcgagccattttcacttcatgcggtatttctcagccacgatgagcactgtataggccccgtgggaccaaatggatgcttcagtgtctctcacctgtgcaaacatttcactctccacctacaagagggtaaaagaaggtgcctccgtcctgagtcacctttgggctctaggatagctccagtgctgtgattggtagggcacccccaggcaagggtttgggtgtgtgtgaccccagtgggaatgcagtgcattcccagaggccctcgtcgctagcccagcacgaaagagtccctgagggctttggaagctcacctccagcacatctcaaatgaatgctcataaaccagtcgtttaatagaaactgctgctctgaacagaaaggagtcgttgaaggatccttaagtggggactacaaggaagtatttgttgcagggcagattgtctctgggctgttaccaggtagtacttggaatgataatgctgatgtctgaggcacaacttaaataaggcctgttaagacacagtgtctaaatactagctgggagtgtacttctcccaagagaaagagctttagaggtgctgttggtgacattttagggtgatcagatgagtggagaagttcatgaaagagcacaccccgaaaggggccttgaaaagcagatccagttttaactggaggaaaggaaaatagccttttgatttgcaggcagatagcgaatcaggttgtggcaggctgtgctctctagggtgtgtacactctctaggacatatgtacgtcgccatttcttaatgtgtttctccaagctgatccaccaggcattgacacaaggccactttttaagtgacggtgttaataaggcatcactgggacgatgaggagacaaagctgagaggttcgctttatgctgcccgaccagtgtatgccacacctggacctgcccagaagctacctttgagttcagcctgtcccatctgcaggtcattactggattaatctgcctacattactggatccattacgaatcatgggcctgttttcagtgtctaatgaaaaggccttctgaagttctcagaaagtattgagctaacaaggagagagggaagatcttagggccatatgcagcaaaggatcccagtcctatgtgggtagtttgggggacaaatctccacgaggtgtttgtagtggaaggagagttgaacctctctccctcggtggttaggatttaacaagctgtgtgtcttggtgggtggagtggcctaggtgtcaacgccactccctctgtcaccttgccagtgtgcccttgcacagtgtacagaaagtacaaccgtacacagtgttcccagtgccatccactctatctgtgtcccaaccagtcccggtgtgctttctctgcaggttgttaacatggcccattccctgtgtgtgttcttcagcccctgttcccttatcttaaactgccctgtggttgttggttgtttgcttttttactgtaaatttaattggttcagctacatttctaagaagcaaagacaaaggctattcctcattttgattcattccaattagtgtctggaattagcagcctcctaattctccatatatacacatacactgataagctgttcagattgcagtgaaatctcagaagccaactgatttcctgcacccagcagccctctgaggtaaagattccttgatttatggaaggagacacagatggggacaggtgatggggacagtatgctttcagagctctattgtcagcttgccctccatcccctctggttgagaagtcttcattatatctgaagctgaacagcaggttttctggaattccttaggctcctcagacggggcgggggcagggaggggcacggggaggggggagctaagctgatcccacagggcaaccacagtagagatcactgtgaacacagggtacctctgaatactacccgtgtttcggatttcatggatatattcagaaatattaatgtagcataattggaggctaatattgcacccgcaagccaggcggaggaaagaagtgacccccccaccccccaccttcccacccccgctgccctcctacacatgtcaaggttgatttttaactgttggtgctttgcaaaacatcgcagaatccatgcatcttgcttgaaacaccccgggctgcattctcagctgtagatgtaagcaaacacgaagacgagggaaataactttcagagtttcacttttctctcatttgtttttcctcccattgggtttaaaatatggcctgacatgagagagttgtctctaaggtaagatctgagacgttgaaaaagatgcaggccccaagaggggtagaggaacaggggagagctgattccatctcatgaaaactagaaaagttttactcgagttccccgagtgccacgtgatcgctgccctgggcacgtgctaggccatgtttttacttttgttttcagggtacagctttctctgactctgaagggacagacatcacaggatggggggtggggtgggagggggagttccctctgtctgctagacagtgggcgtgggtgtgcctttgcagaaagcctgtagcctgtgtctggattattattattatatatttttggtatgtaaacctgggtttgtttattaactggaaagggaaagggtgttttttcttaatgtgggttcattgagctcgcatggatatggagtcatgaattagccccgtgctggagggccctactttctaagatgtcttacattggaattgtgaagaaacatattctttttaccctgggtaactttggataattcatttttccctcctgctgcctgttttccctggcttttgttcattgacagtggtgcacatgagtctctgagaagcaagctttccaggtctcgggtgatgccccaagaggtcttgttcagagcagaaagcatgtcacagaacttggaaacacatgttaataatcatgagagtttcttggctagctgaaatctactggcaagtcgaaccctggcctgcctttgcctctgaagtgagttgtacaaaaccctgagaaaaggggttctcactggcctgaagcatccagaaggtgaagtgagccttccgttatgcatgtgcaatgggtcttagcagccccaaatagataggatgccaagaaagcacaagtttctttttaaaggggcttattagccaagtggaaataaattcctaggtaattgtgacacctgtgactttggtttagtagtgaattacgtatatttataagctatttataattatgtgttattaatttgtggggctatttggatacggaggaggtgaaactggaagttgatggttgtctcttaagcaggcatgatttactccgttctgccagcagagggcgccctccttaaactaataaagagcagaaagcttctgctcacacttggagttaatgtccttaatagagcctccgtggtaggggattgtacatatagtgaggagtttgtttgaaacaacctgtccatggctattcgggaccttttctggtatatactgtttaacggtagatacttttgttctgagacaaaatagactgtcagatttacagtttaatcgtcgcacagacaggtatttgtaagaagccaatgtctgatgtttcttccagagaaactcttttgagatcagggcaatgcatgaaaataagaaggacctttgtttttcttaagctaaaagaagaaaacaagaaagccagagttttgttataggtgtgagggtttgtttttgctttttggtttttagtttttcttcagagtggcctaaaagaaagtaaattcagcttgttagtttcgactttccatgaccaaggaaagccaagactaggggcagtgggctgagaatggaatttaggaccaaaagtttttgggggctttgtgattttttttccgttaatggttcaaaagaagtgggggcttctgggcagatgccatggggacgtttcctaggaaaagacttgatttctgtccacccagcaaccctaaacccagttagctgcaactttctcaaattacagactagaatcccagagaagggaaagcgcgtccttctctgtccctttgtcacacccagccagcacttaacccagtgcagacacaccagttaacccagtgcagacacacctcttagatactccagattagaaagtcctagggctatttgaaggtgagctgaagttgactccttaaagatctgggcttgcttgaaggatgccctccccggggctgctagcctgcgtgtgatgcgctatgtgaagggctttcctgttaacacctgcggggctgactgtgccagtgcgtgggaggaggaggacacgagagagaggcaccctgtcctgagctgttccgagaggttcaggccttcacaaacgcggctttgattctattttttgatgaactaggtggattacttcctgtgctgcttcactgcggcccacttgagtccccggagcgggggctgccagcgcgttacaggcaccatggccaccagggaggactattttcagcacccccttacaatgcccttctcatttcccggacgaaaatgagcaagttagtcttgcctcggccacttgtcagcctgatgacaactttgactttgacttgggtgcccctccccctcccaaaatccctagctcagcaaatatttgaacctgcccgagttaatcatgaagcctcgatctttatctgagcgagacgtgcgagcgcccgccggggctcctttcttccccggtgcagtagctcgacccagggggctcttctcgcggagccggggacttgctgccggggcggggcgtggggcggagggacccgctgcagcctagccccggggagccggcagccgggctgagagtcgcgcgcccccgccttgcgcgctctcctccagctaggttctttactgccggtaccgggcgggcgggagaacctcaggggctgggaccacttggtagaagaacagcttctttgaattttttttttttttttctctgtgggatactggcagttcaaagcgaaaccgttgaaatgcataacctgcaaagtaagtcttttttttttttctttcatttatgcacttctctgcaccgggctctttatctgcaaggcgtcctctctagtttggctgggcgggcgggggtgtgtgtgtgtgtgtgtgtgtgtgagcgctggaagtgtgtgcgcctgggtgagtgctgcctggggagagcagatgggcgattagggagacactcccttctgtcctccagggggggacactgcggagaagagatggggtttagtttggagtttagaaagtactgggcaggaagttggggccaagccagggcttgcagggaccgtggaaaatcacctgtctcccagacctgctctttgggttcccttgccacatgggcagcagcagtctacagctaggctgattttactgagtgccgtacataagtcccctgtgggctaacccttgggccttactgcccagacaacctgtctctttacttttgggagaagactcaacgttttaaattaaactacttttttaaaaatttatcttatctaaggacacacttctctaccatttttatttgacgttgagtttagacttatttaaactttgggtttctaatctaccggcaaatagagaagtatgaggtggaaggggacaggttgagtctccaataatacagaaatgcggtagagaagggacgccagtggacagcatccagagaacggaatgccctgctccacttttaatgctgtgcgattccaattgggatagaaatgtaaagtgctcccccacccccgtgttgtgtaaatccttccctaggtgcacaacattcacagccacaaagcccactctttaaaaggaagccacatttacattgcagcattaccccaaccatccatgtaaatgtcaagaggttctggctcccaggggcaacgtatatcaagctccagtcttggtgacagaattgcatgcagaatgatttaaagagccaaaatgaatcattacatttgtagggaaattgatttctttatattgaacactactaagaaggaatatttgtccgaccgcccccccccatccctcagtagggctctgagctaaagagagaagtggggggggggcacagagagagagagagagattacatcaccttccttaaagcagctagcaatgagatgggttcctgagtgagacacttggcagagagcacctgtactctgcgttctgatatactgcctttttttttttttcagaagcatcctcttgcccagtgtcttaggcagtaacattgaaactcaccactattgagcatatgcttagcatttctacaaataatagacagcttcattcctgtgctgaattttcatgattattctataaagtcttgttttgaccttgggatatctgatagaggcattttgcctaagtactgtctttaagcctctctctctctctctctctctctctctctctctctctctctctctaatgtggtgcgtctatggcagtgtttaaaatccaagctctcagtgaattgtggaagactggatttaaatatccagagtgctcggatcttttctgcttctaatatatgcgtgatatctaagggctgtaatagagaccttagggatattttggtgcctttgtaagattttttttttttttttataccaaggaatagccaggctatctctaaacccagatgcacgaaggggacggagctggaagctgcagtttatcagctctcgtcaatctgcccacggtggaatgtaccatgctgcagagtaataaagagagacttagagagcacagggctgggagagagcaggcaaattaaacaccttaaatggtgagcacggagatgccggagcggagcagagcagagccggcgtgacatgtaggctctcagagagaggctggggccgtgtgaagctggcatccaggagaactgacgaagcaggagtggtctggtgacatttttctgacttgattggctggggtgtgtgatgtaataggttacagtgcgggccgtataggttttaaaatgaattccaagacaccattacaaagaaagccggactcttttcttataaccgagcaaagccaaggaaactgtcgcacacatgtacaccacggtttggactatggaagacctggacttagagtgtgccaagacagatataaactgtggcacagacttggtgttttatatagaaatggatccaccaggtaaaactgcagtattaacggagagagctagataattctgtgactttaattttttttttttttctttttgaaagctgctgtaacagatcctcttgaggttgctatttttactgatgtgtttcacggtttaaaattagtttgattagaactttaaaattaaatagactctttgcctgcctgtagcagcaagcagcccaggctgtgtctgataaatgctggttcttgctgaatgcatgggaactggtttctactttttctgtccgctgctgtcttttgttaattgtgatccttggcaagttgggctatattgttgtattttgttcctttcattaagaggacgtgtcctttgtgaggcttttctctgctggctctgggctctgtggtactttgatgacaccgggtgcttcagaaagcatgtgagatgtagcagtgactcaaactggtttctgatgatccgagactctctcataaatcagatgtggggactttctcgctctctctctctctctctcatgctgagatactacaatgggaaaagaagttgtctttcctcgcctttgtaaaatagtcttactagacacctggaatcttcccggggcataaattcaagcagttacagtgctttcaaagttaatggttttggatttagctaaaaatcttaggctcattggttgttccctctggggtcagcccttcctaccacgagggaactcagagacgccgaggggcttcttgccaccctgtgggtgctgatttgacactgaagaaggggatagggtttttaaccggatctggcatctaaagcccagcgtcccccagcagaagagtaacatggagactaaggagatttaggtcacagatgaggttcttaaagtggctttggcagagctgtgcctgaagtatcaacatagaaaaacccagttcttaaagcatgcttgctgcaaatgagggctgctttaaatgtgactgctgtgttcaggcagggcacagcaaccaaatttgcctttcgtaattaagggagaggaatgaaagcccagctcctgttatttctgcttctcagatgttcctggtttcttactttagacggagctgctagggtgcacaactttagtgcagataaaatctagaagtagagaatgtcgactctggatttgctatgaaattttctcccacagccagccccatgtatttcctaatctctaggttggtctgtctgtctgtgtcatctctgcacccctacccctgtcatgcactactactttttcctttccagttttagttttaagtcatattctgagatttccttcaaagactagtgtcttccatggcacatgaaattatgaattcctggtatccgttcccacccctcccctttccccctccattgtaaatgtttttagtaaattcaattgccttttaactgaaaattgaattgaatttttatatattttaactaaaataggattataccactcaccccctaccccttactttttgtttgtttgtttgtttttataatgaaaagatgcaagtctaattttaaatgtacacttgggagttcggattacaactttttttggtctcctcttttgcctgcagcactgccccccaaaccacccaagcccactactgtagccaacaacagcatgaacaacaatatgtccttgcaggatgctgaatggtactggggagacatctcaaggtaaggccacagagcctctccttctcaccggctgcagggaggtttcgagtaagagcagagagcactggcttgctcagtgccgtttttaggatgtcatccaacataagcatgaagcatacttgggtctcttccaaagatgacaagaaaagtcaccgagcactggagcactgtgggtgctgggtgacataggacattgaatacccaggaagcttccctgttgccagaggtgccagagaaggtcggggtaacagggcactgtctgctttctctctaatgggcagggcttcgggaataaaggggtttgctcctttagctcttagagtggttagtgagggagctgctagaacccccccctttttttttgtggatcctggttttctgtgctgatttgaaagtaactggtgtgtatgtgtgtgtgtgtgtgtgtgtatatatatccaacaatttttgtattatagtcaccaatagtgtaaatgtgtgtgtgtgtgtgtgtgtatgtgtgtgtatgtatatatatatatatatatatatatannnnnnnnnnnnnnnnnnnnatatatatatatatatatgtgtgtgtgtgtgtgtgtgtgtgtatgtatatatatatatatatatatatatatatatatatatatatatatacatacacacacataagtgtatgtaatgtatagtgcacttattttctgtgggatgaatttgtagcacttttgtataagcaaagaaggaactattagtgttctttgaaaatgtacaataccaacatgtaaaatctaaaggaccgcagaatgtaaagacaaggaacctttggattttctgctcagtgtcctaaagaatagtgtctcttaagactaaggatctatcccagtggtaaatcaatccccagtgcagaagaagggaagctctgtgtgtgtgtgtgtgtgtgtgtgtgtgtgtgtgtgtgtgtgtgtgtctttgtaagtgtgtggttactcaaagttgaaaagtaagtatggtcttatactgtgttcattttagggaagaagtgaatgaaaaactccgagacactgctgatgggacctttttggtacgagacgcatctactaaaatgcacggcgattacactcttacactaaggtgagccaggaagtcagctgtaattgcgatgtctcagttgtcatgaaaacatttcttcattagattgcctatttttcctccttaaattagcatataaagtaatgggtttcactataggattttttttcaaacatcttcgattcgtccctttctcctactgccttctcctccccatcctgagagccctccttctgcatcagaaaatgttaataatcattatttttgtattgtatttacaggaaaggaggaaataacaaattaatcaaaatctttcaccgtgatggaaaatatggcttctctgatccattaaccttcaactctgtggttgagttaataaaccactaccggaatgagtctttagctcagtacaaccccaagctggatgtgaagttgctctacccagtgtccaaataccagcaggtaattcacacagagctcctcccgctgcagtaacaagggggccagagactcttcagcataggaaatgatctgaaattgggttttgacaaactttacaccctgaccagaattttataatagctaaatcagataccatattgactatgccattagggattgttatttgagtaaatagcttatcaactgaattctttttttccctgcttgtatattcttccaggatcaagttgtcaaagaagataatattgaagctgtagggaaaaaattacatgaatataatactcaatttcaagaaaaaagtcgggaatatgatagattatatgaggagtacacccgtacttcccaggtgagtttaagatattttggactaacacatactatactcagattcaaaggaagaatcaagtgtctctaacccttttcagcttaacccatgcttataaagtcctacattaagcttgcttctaactcgcagtgttactattatgagcttccagttgatggaacgttaatttccgactggttacttctgcctaggctagacattgataataactgctaatgtcagtttgtccaagctctagaatggaaagttcagacccatccctcctgctgtgaggagaaatggccgtgttgattatcagagaaagcagcatgggtgtcataaaataaaatggctttttcaaagactgaccggcttgtacttacatacttaggaacacacacacacacatgcatgcatgcactcgttcattcacacaacatgaatttgaaggaacaaggagtggtatgtgagatggttgaaagggaaggaggaaataatgtaattatgttataatctcaaaaaaaaaaagaaaacataattttaaaaagtgaaagacagataattctctgtcaggaacatctgtttcttgatcatttgacgagagttggtgaattcatgaccagccctgctaacatacacagcccttgcctatctcctgctcctgaatcctgaagatgcacagtgtaggcatctccccgcccccttgctcctgttgtctaagccataccgtacagctatttacgtagcactgatgttgtctcatgctcaagccatttagaggtgatttggagtcgatgagaaaattgctcaggctctgtgtggccattacatcacttcaataagagacttaagcatctggcttgttagtggccaagagggctgctggtacccatggatgactgtgctgactggcagctcatttgcgttgcatcgctagctagcttgtctcttatagtaaagaagtcgttctctgaaagcgatgacattgcctgatgaaacttgtgttgcaggaaatccaaatgaaaagaacggctatcgaagcatttaatgaaaccataaaaatatttgaagaacaatgccaaacccaggagcggtacagcaaagaatacatagagaagtttaaacgcgaaggcaacgagaaagaaattcaaaggtagatgaacctcaagaggctcccgttatccttgtgacagaaagtggcaaaaatcgtttaagattggtcgcagtgaagatctcccttcctgtaatttgagcaactttcgaatgaaattaacaaaaccccctttactctggggaccttgtatggtgtacgtaggtgcttactggtctgtttttcctgcctgcaggattatgcataaccatgataagctgaagtcgcgtatcagtgagatcattgacagtaggaggaggttggaagaagacttgaagaagcaggcagctgagtaccgagagatcgacaaacgcatgaacagtattaagccggacctcatccagttgagaaagacaagagaccaatacttgatgtaagtgtcggaggtagaacccgaagacttggcagtggctaaattcaaggagggagtctcaatgtccttcgtttgtaaaactctttcaggtggctgacgcagaaaggtgtgcggcagaagaagctgaacgagtggctggggaatgaaaataccgaagagtaagtacctactgaggaggcttttttggggggtggcggggactgggcagtgggagttttgtcaacagatttttcagtgactttggtacaaatcccaagccaaaaaaaaaatgtataaaggtagtggcagggtccagagcttcacccagggagagttgagcccaggagggttgggttttttgggtttttgtttgtattttaacccacagttgtgtaaattgaccctgtgtgtccgtaatgatgtccccgaacatcaggaaaaaaatccccacatatttttggaacaatgagagaaaaccaacaattacgtttagtgtattttgagggttaagtatatgtttagtttgaattattttcaaactggcagtcttcttaataccgtccctgccctcggcccaggttactgaactccaggtggagatagtaataactttctgccagccattcaccctgggggttggtgagaaggccaaacaaaaagagaactcggagagaaaggctgagtcaccttatccgacttgctgggaaggagacccgggggcaggctgggttcccacactcttgagtcacaagccttcccttctgcccatgcagtcaatactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaaaaaaaaaaaaaacgttctaaccttgaagaagtatggttagtccaggcagatgaatctgttaagaacatctaacagagagacagacacctgctgccatttagtaggacagctgggacaagtgaaatggctgtccctgcccctctacaagtcagtatagctagaatgcatagtctgttttgtgagagcaccacctgaaatagataaagcaagcactccttcagggacgaccaaaacaagagcgaagactccatttcggtcatcagacatacaccccaaagtgggcacatgtctatcttgtggtctagtttctttttacatcttaatactttggaggagtactttgaaaagtaaactgggaagccaagcatggtgtctgtaatcctagcactcagaggcgtaggcaagaggatggtgagtggttgaggccagcataggcttcaacatggagaccccgagtcaactgaaaggacaatgcaaggaaggtttggagtcatgagcatattaggggcaagaaaataactgtcctcttgtatgcatggacaccaaaagaaccttctacaacccaccaccgattcatttatgaactatctctttaagaaagacagagggagagcttttgagttaggatgagaggatagcagaatgcagaatacacaccaagatggagagcctaagagacctcttgattagaactgaccacttgattagaacagcaccagagaggttggaaactcatttgtcacatgcttattacatggcacatccagccccacatataacaaacatgtctcataggaaccctactccatacatacatgttatacctctccttgtgttaaaccatttaaagtccagtgaagcaggctcaaatggttagtcctggtgtatgttgcaaagggcactcatagtttactctggctttggggctttggttccccaggagggaaacagacccatccactgtgcccctccacgaggtcggctttgtttaaaaataccctgcagcattccagatcatctgagaaccactgaaaaagacttttttgttcccttcccctttccagggtagacggcgaagtcaagcattgcgtcattaacaagactgccaccggctatggctttgccgagccctacaacctgtacagctccctgaaggagctggtgctacattatcaacacacctccctcgtgcagcacaatgactccctcaatgtcacactagcatacccagtatatgcacaacagaggcgatgaagcgctgccctcggatccagttcctcaccttcaagccacccaaggcctctgagaagcaaagggctcctctccagcccgacctgtgaactgagctgcagaaatgaagccggctgtctgcacatgggactagagctttcttggacaaaaagaagtcggggaagacacgcagcctcggactgttggatgaccagacgtttctaaccttatcctctttctttctttctttctttctttctttctttctttctttctttctttctttctttctttctttctttctaatttaaagccacaacacacaaccaacacacagagagaaagaaatgcaaaaatctctccgtgcagggacaaagaggcctttaaccatggtgcttgttaacgctttctgaagctttaccagctacaagttgggactttggagaccagaaggtagacagggccgaagagcctgcgcctggggccgcttggtccagcctggtgtagcctgggtgtcgctgggtgtggtgaacccagacacatcacactgtggattatttcctttttaaaagagcgaatgatatgtatcagagagccgcgtctgctcacgcaggacactttgagagaacattgatgcagtctgttcggaggaaaaatgaaacaccagaaaacgtttttgtttaaacttatcaagtcagcaaccaacaacccaccaacagaaaaaagagtgtggagaaggagacttacagtgacattcagtatataaaatatgtacataatattgggtgactaactatcaaatagatggatttgtatcaataccaaatagcttctgttttgttttgctgaaggctataaacgtgcagcgctatgcaattcttaatttttattatgttgttacccgtttcaaatacacctttggaataagcttcccttaccccagtttttgttgcttgaaaatattgtccctgatttttgttaatatttgtttttgtcatttttactttttttttttaaagaagtgtacaggatgccagaaaggagaatggcttaagaattaaaactatgaaatattttacagtttttcttgtacagaatacttggctgttagcccaaggttaaaaagttcataacagatttttttttttttggactaaatgttgggcagggccctgataagcttcaaagctgctttattcaataaaaagagaaaaagaaaatgatatatgatatgacaaagtattgctgagtccaacagtgttaagactcttgaaatacggtacctggcaatgtttgtttcctaatgaattgtgaacttcttgaatctggagggagggggaggcagtcatgggttgtaacaggcggggtaaggggagggggggaagtaaggtggtgtgcactttctagggatcccagagaagggaggagccaggctgtttgtctcctgtctttccccatctgagtttggtagtcattagcaattaacagcaactccagacctaatgttgtaactccatcccagcacagttggccagcatctccgttgtcatgaagtgctgagtttgttctggggttcctggaatgtgccctctttcgttgttgtaacacactggtctcaaggttgaatccctgcatttagaaaatgtgttcttttctctttgtagcattggactagtcacagcagtcagccagtcaccattcattttggctaaatcatggtctgaaaaaacagcatctagttggatgcttgatatttttccagctctctgttcagagttcagtttagaatggaaggcaagtagacccaagtgggtggtcactgtgctttgtggagattgttaagtgcaaacatttaacagttcggacaggtcttctcattagcgtgattgtgcatgttgcatacatcacggtgtgcaaagggagcagttggtgacatctttaattcaggacaaaagttcgagtttcccaccctagtgtatatgtgtcaaagctggtgagttcatggggaattgccatgtgctgtgatgggtagaggttgatggtagtccctgtcgcagcccaggtagattcatgagccatcatcagtttctctttctcaatatcagacacacctgcagctttatagctcttcccttatttgggggggggaaggggtcttgtaatgttgctcttgttttgatcttggaatttgcagtccagtgtctgggttaatggtctgtagaatgtgtttttcttcctatgaagccactgctcattttcaagagcaaaagtcagtcaaccagactgtcagcccacaaacttgacccgaccacctcctgactgccaggaaattgattccccgggttgactctgggctttgcaacctccagcggtagcattccgccacaccacatacaactgaagagttaatacttatttgtaagctaggtttgtggttggcttctgctctcttcttcctttctctctttcctttttctttttgtagcacatcatgtatgctatcagatacaaataactttaatttttaaaaaggatctgagattgcttcgtgacaagttctgttaagtggtttttttttgttttgttttgttttgttttgttttgttttgtttttttccttcaacactctctgcaagataacttgcaacttaggcagttgcctgaatttctcatctcactgacgtgagtacaatagagctttcatgtgtcagaaggcaggagtcattgagttatagcacacctgtcctactgaatgcccttttggtgacaggttagcatgctcaccaactctgtccttggagaggtttgaccattaaggttctgtggattccatccaagccatcttctagtaacaccgagtggctcatgaatgcagatagatacagcatagctgggatgtgagcatgcccactcaggttttctcaccaactgtcccattctagagacagccagacactaagctagactatagaagtgggagggttgggaccttgtgttccacaccagagtgatcatagccatgggataaggcagcaagcatattttgcaacatttgacaacttcacagccctggatatatgtatatatgtataatgtgcatggactgtttccaatacacctttcagccacgcagatccacagtcaagttcaagtacataacaagcagatgtccagtacaggtcttgtatatgtgtgtgtgtgtgtgtgtgtatgtgtgtgtgtgttcctgtatttctttgctattgctttgttttgtcttataaagtacaatttgtccacaagtgaagtgagaagtccgtcatttgatactttcctctttttagaagctcttccctttcagggagcagcctggatgatttgcttacctgatggatccctgttctcagtgttgtcaagtcagagtgtgtttctgtgagctgtcattgtggggaaccaatcgctttgtcgtatatctgattatgaactataacttgtttgggaagtcctactgatgttctttattgggagaaagttcttgcaggttttctcaactgtgctttcgcaatgcatggtatccaagtcagttggaaagtgggttttgttgtctgttcgaatttagggtcatttaagaaaggggcagttaagaagcacaatgcctcccatgggacaacattccaaaatgccaaattcttctctttcttacaacaatctataattatataaaataactagtactgggggtagggagagggtagaattggctccattggaaagactctcctgcttcataccgagcttgtcgccatgagatagcattggctgcccaggatgctgctatttaagaagaaaaaaaaatcaaaacaaacaaaaaagccctcatttatatgtgtgtattttttaaagctacactctgttcaatgtttttacaaatctgtttatatgacattgataaactaaagttggtcttttgacgagagggaggatgtcatggtcggttgtaattttgcctttacaaggtaactggggtgggaggggagggagtgtgcctccttgacattttgttcaagatatagattcagtgaagctatgtattgttttaagttgcttaatgcattgtattaggtcctcaaacagaataaaggttgttttgaaacttaaaagtttccatttgaaattttagtgttcaccgggagatgtttctaaactcccaccaacccgtttgttttcactatttcgactgtgtcttataaactgaaggtacgaatcagtcacttgaatgtgctcagtgctatttataagaaatagcatcttaatgcgttggtggtagaaaataaatacctctaggtggtatcatttcaaggcatgttcttgctattcaaaatgtctcatttccctccatctttcctgtcctccacccaaccttgacaatcatctactagttcctttgggtttttgatggcttctggttttgtctcttgtacactggcttatttaaactcatggtaaaatgaggtgacctcagactataaacagggccacttagtccccacataccagtgtgccttgcatcacctagtcaagaaacagctcttcctgtgaaatgacttccccagcgacatttcctgctggttgaatctgccaccaccatactactgtgtatgtatgatgtatgtaggccacacataatatatgtaagcacaatgaggttgctagaaaagaagacactgccaggtggtggtggctcagacctttaatcccagccctctcaaggctgagggggccagatctctgagctcaaagccaacttggtctatagaaggagttccagtatacccagggctacaaaagaaaccctttctcaacaaaacaaaacaaaaacaccaaaaaacaaatgattacccaacccaaagaaacagaaaagaagacatgagctagggttatgagtgagaggacccacacgtctatgccaacagtatctggtgtgtggtaagcaaggcaatagctcttgggtatcacaactcattccctagcttttataccctctggtctccctgagtgagtccccacactgtgattgctatgtagattttctccttcagatgcgagtgaaatcctgtgcacttagctcccagacaaggctctggtcccactgcaatcttctgaatgtctacagtctcatgcagcttctaaccctctgttttctgaatacatcttcttttgggtttctaaccctttcattggctgctgagtaattctgattacttaactttgcctgtaagcagcactatgcagtatctagcagcagggataattttgtcattatgtgaacatcatagggtgcatttccatacacctactggcatagcctgttatactacacctgggctgtgtggcatgtacctatgggctcccagggcccaaatgaattagtgaatatgagagtagatcaagcacaagagcaaatggtagaatccagacttataaactagctatctggggctgctgctggtgtagcattgcaaacttttacagagaacattttataattaggagtgtactccaagatacatcaactacattggccaatgagaactgttgattgtcaggtctcaggtactgcccattgctactttttacacatgcttgcactgtaggtttgtctgaatcagcctttgcacatttatatgataagttgtggcagtgtcataaccgtgtgtgacccacactattcttaggggagctgaaatatcactatgtgacatatggctataatctcgtcaggactggcctctgacataccaagtgactgttatctactaaactcttcctatgctttatccataccaatcccccaacaattatatgagttagaagatatcacctccattctatagatagaaaaacactatctatgcctagaaatgcctataaaaactataaatgcctaggtataatatatattcaaggtcttacaacatgttagaacagagtaagaagagcatctcactgaaagccaaggcacacccttcaacccctcccaagatagaatctaaagacattccatgaaaaaaaaaatgcacagagcagttcaaagaggggtcaccagtagttcctcctgctaagggctgaacaatgtgacgtggctgatagacagaacatggtgcccaatgacgaagggcctgagaaagcttgctcttactcagaagaacacatcagcatcagttgggaccttgctgacattccaactcccagacctcacgcctcatttgacagagtagagctgtacctctgctcccacaaattctgcagcctcccttcatggatacaaagggttgaaaatggctgctttatgtcacctcttcagagtacttctagtgttttagcaaagcatatttccattaatgagtgctcaaaacgttacttcatggcacagactccagataggtaaatttaattagcagtgggagggactatnnnnnnnnnnnnnnnnnnnntcattagttctgagtctgtcagttccgggggtccttccctagtagcatgctagttagcactgtcatcatcacataattggaggggcacgattttccttgcaggggcagccaaacaacgaatggcccaaaccaactgttgtttctaccacaactctttcagggaccacaggggcaatgagtttaatgtttctatagtatatacattgcccaaatcattcatgacagcgaaagaagctacaggcaaaccacactgtggtgcctggctagaaaccaagccaaagttgtataataaatcaataccttagatacattttcaggagaaaactacctctaaggccaccccataaaagtggtagagaaacccaatatttcaaatgtgcaaatctcaatgtgaaacaaaagattatgaaaaaataggttatataattctaataaatgatcacagtggctctctagtgatggatctcaaagaggttaatagggggagtacatatgatagacaatacaaaggaatgactatggaaaagctcaacaagacctgagagtatacatgtaaacagttcaatgaaattaagataattcagagtaaaaataaaccacctagagttttttaaataacctaacagaaaatagacgtttaagaaccactcagtgaatcaactaaaaacaaacaaaaccaaccaaacaaaaaaagacagtcagaatctttaacagtggactatattaaacagaaacaaagtctgaactcaaatcttggcattttgtaatgtgccaaacaaagtaaacaacaaataaacaaacaattaaatgaaattaagaaagaagggaaatgagaggagagaaaagatgagaacattcaaggctttcgaggttccattaaaaaaacaggcagctccatctgaatactcaaagataaccataagaaagttaataatatggaaaacttagaactagttgaaaacttcttcagtcttaggaaaaatataaatatataatatataatgtataggaggtatatagaactacaaatagaaatgatcagaaaagatcttcacttcagcatgtcatagtcaagcagttaaggtaaaaagaaatattttagaatcttaaatgtaccaagacacattttaaggctatccccattatattaatagcaggtttcttagnnnnnnnnnnnnnnnnnnnncactgtcagcaaggtggctgaaggacagtattgcagaaactggagtctagtagtcttgcagacatcttaaaaagctatccttctagggaacccaaactggcaactgagttctctacggtgtgcatggaaatatattttcaaaatgaccttttgccatctcctaacaataggagggataggaaggaggtggcctacaaaatcctattggccagtgtttctcaggcttcctaatgccgtgaccctttaatacagttcttcatgttatagtcacccctaatcataacattgtttttgttgctactatataactgtaactttgctatggttattaattgtaaatatctgtatgcaggaagatctttggtgaccattttgaaagggtcattaaacccacaaaggggttacaacccacaggttgaaagtgactgctcttgggcagcacaggcaaggagaagtatcatcttttacgacatgattactgagcccatttttttcaaacaagaagtggtttccttgacctgtttctgaccatctctagaaatgataatcttgtgaaacatttagaatatatgtaatagattgtttcctatccaaagttcagatcttctcaaaaaaaaaatcccactttgtatcttctagttgggtatcactgtcataaatcagctcaacagaaaaccactgagatgctttcaaaggggcagaggggaggataaatgagaagccaccaacacaggcttgcttatctgcatttggctctccagaaggaaatgaagaaattcctttctctctatagcattcaatcatggcagtctgagcatgacctcaggcttaacttgtgaaagaaagaaagaaagaaagaaagaaagaaagaaagaaagaaagaaagaaagaaggaaggaaggaaggaaggaaggaaggaaggaaggaaggaaggaaggaaggaaagaaagaaagaaagaaagaaagaaagaaagaaagaaagaaagaaagaaagaaagaaagaaagaaaggaaggaannnnnnnnnnnnnnnnnnnnaacattcaaggctttcgaggttccattaaaaaaacaggcagctccatctgaatactcaaagataaccataagaaagttaataatatggaaaacttagaactagttgaaaacttcttcagtcttaggaaaaatataaatatataatatataatgtataggaggtatatagaactacaaatagaaatgatcagaaaagatcttcacttcagcatgtcatagtcaagcagttaaggtaaaaagaaatattttagaatcttaaatgtaccaagacacattttaaggctatccccattatattaatagcaggtttcttagtagaaaacctaaagacccagaggaaatggaattattattccaagtaactgccaactaagaacactatatccagcaagaaaggctgtccttcaggatgaaggtgaagaaaatccttctgagagaagcaaacagaaaagatgcttaagaaagtcccacatccaaagacaaaataaggacctcagtcaccaggaaaagcataaattgccactggcaagcaggtacccaaggagtaagaaagtcaaactatggaacttagaagataatcaagagagagaataaaactcacctgaaacagccaagtgagaataggcaaaatgacacttttactcattggcaatgaacttgaacatgaatgaattgaaagaacccatgctacttctctgagcctggtcacctcacttaatatattttccagtttcattgattttcctgcaaatttcacaatctctctctttctctctctctctctctctctctctcgctacttatgagccttggggaggtggaacgaatggatccttgaggctccctggccaaccagaccaggctaatcagtgacttcaggacatgtaagaaaccttatctcaaaaacaagagagatgactcttgaagcatgtgcacatacattcacacacatgcattcacacacatgcattcacacacatgcattcacacacatgcattcacacacatgcattcacacacatacattcacacatatgcattcacacatgcattcacacacatgcataccttatttatctgtccatattcaaaaagctaatcagatcatgaatacataattatgattctatgtacacacaagtaaacaggatatggatgaagagctctttgtaaattgtattatcattttggaattatgtgtatatacatatttccacttatgggtctgtatgtacaaatgaggagctgcctgtagagtgcagaagagggcataggatctcctggaactagagtccttggcatttgtaagccacctgacatgcatnnnn

SEQ ID NO: 1446 - DNA, 3454 bp, Mus musculus
ggcacgagccgagttggaggaagcagcggcagcggcagcggcagcggtagcggtgaggacggctgtgcagccaaggaaccgggacagcgaagcgacggcaggtcgcagctggatcgcaggagcctgggagctgggagcttcagaggccgctgaagcccaggctgggcagaggaaggaagcgagccgacccggaggtgaagctgagagtggagcgtggcagtaaaatcagacgacagatggacagtgtgacaggaacgtcagagaggattgggcctcgctgcgagagtcagcctggagtcaaggtgttgacaagttgctgagaaggacacgtgggaggacggtggcgcgcggagggagagccctgtcttcagtcaccccgttgatggaggacagatggacagcagccggacggccagtcacctctcttaaacctttggatagtggtcctttgtgctctgctggacacctgttggggattttagcccattctctgaactcactttctcttaaaacgtaaactcggacggcagtgtgcgagccagctcctctgtggcagggcactagagctgcagacatgagtgcagagggctaccagtacagagcactgtacgactacaagaaggagcgagaggaagacattgacctacacctgggggacatactgactgtgaataaaggctccttagtggcacttggattcagtgatggccaggaagcccggcctgaagatattggctggttaaatggctacaatgaaaccactggggagaggggagactttccaggaacttacgttgaatacattggaaggaaaagaatttcaccccctactcccaagcctcggccccctcgaccgcttcctgttgctccgggttcttcaaaaactgaagctgacacggagcagcaagcgttgccccttcctgacctggccgagcagtttgcccctcctgatgttgccccgcctctccttataaagctcctggaagccattgagaagaaaggactggaatgttcgactctatacagaacacaaagctccagcaaccctgcagaattacgacagcttcttgattgtgatgccgcgtcagtggacttggagatgatcgacgtacacgtcttagcagatgctttcaaacgctatctcgccgacttaccaaatcctgtcattcctgtagctgtttacaatgagatgatgtctttagcccaagaactacagagccctgaagactgcatccagctgttgaagaagctcattagattgcctaatatacctcatcagtgttggcttacgcttcagtatttgctcaagcattttttcaagctctctcaagcctccagcaaaaaccttttgaatgcaagagtcctctctgagattttcagccccgtgcttttcagatttccagccgccagctctgataatactgaacacctcataaaagcgatagagattttaatctcaacggaatggaatgagagacagccagcaccagcactgccccccaaaccacccaagcccactactgtagccaacaacagcatgaacaacaatatgtccttgcaggatgctgaatggtactggggagacatctcaagggaagaagtgaatgaaaaactccgagacactgctgatgggacctttttggtacgagacgcatctactaaaatgcacggcgattacactcttacacctaggaaaggaggaaataacaaattaatcaaaatctttcaccgtgatggaaaatatggcttctctgatccattaaccttcaactctgtggttgagttaataaaccactaccggaatgagtctttagctcagtacaaccccaagctggatgtgaagttgctctacccagtgtccaaataccagcaggatcaagttgtcaaagaagataatattgaagctgtagggaaaaaattacatgaatataatactcaatttcaagaaaaaagtcgggaatatgatagattatatgaggagtacacccgtacttcccaggaaatccaaatgaaaagaacggctatcgaagcatttaatgaaaccataaaaatatttgaagaacaatgccaaacccaggagcggtacagcaaagaatacatagagaagtttaaacgcgaaggcaacgagaaagaaattcaaaggattatgcataaccatgataagctgaagtcgcgtatcagtgagatcattgacagtaggaggaggttggaagaagacttgaagaagcaggcagctgagtaccgagagatcgacaaacgcatgaacagtattaagccggacctcatccagttgagaaagacaagagaccaatacttgatgtggctgacgcagaaaggtgtgcggcagaagaagctgaacgagtggctggggaatgaaaataccgaagatcaatactccctggtagaagatgatgaggatttgccccaccatgacgagaagacgtggaatgtcgggagcagcaaccgaaacaaagcggagaacctattgcgagggaagcgagacggcactttccttgtccgggagagcagtaagcagggctgctatgcctgctccgtagtggtagacggcgaagtcaagcattgcgtcattaacaagactgccaccggctatggctttgccgagccctacaacctgtacagctccctgaaggagctggtgctacattatcaacacacctccctcgtgcagcacaatgactccctcaatgtcacactagcatacccagtatatgcacaacagaggcgatgaagcgctgccctcggatccagttcctcaccttcaagccacccaaggcctctgagaagcaaagggctcctctccagcccgacctgtgaactgagctgcagaaatgaagccggctgtctgcacatgggactagagctttcttggacaaaaagaagtcggggaagacacgcagcctcggactgttggatgaccagacgtttctaaccttatcctctttctttctttctttctttctttctttctttctttctttctttctttctttctttctttctttctaatttaaagccacaacacacaaccaacacacagagagaaagaaatgcaaaaatctctccgtgcagggacaaagaggcctttaaccatggtgcttgttaacgctttctgaagctttaccagctacaagttgggactttggagaccagaaggtagacagggccgaagagcctgcgcctggggccgcttggtccagcctggtgtagcctgggtgtcgctgggtgtggtgaacccagacacatcacactgtggattatttcctttttaaaagagcgaatgatatgtatcagagagccgcgtctgctcacgcaggacactttgagagaacattgatgcagtctgttcggaggaaaaatgaaacaccagaaaacgtttttgtttaaacttatcaagtcagcaaccaacaacccaccaacagaaaaaaaaaaaaaa

SEQ ID NO: 1447 - DNA, 2175 bp, Mus musculus
atgagtgcagagggctaccagtacagagcactgtacgactacaagaaggagcgagaggaagacattgacctacacctgggggacatactgactgtgaataaaggctccttagtggcacttggattcagtgatggccaggaagcccggcctgaagatattggctggttaaatggctacaatgaaaccactggggagaggggagactttccaggaacttacgttgaatacattggaaggaaaagaatttcaccccctactcccaagcctcggccccctcgaccgcttcctgttgctccgggttcttcaaaaactgaagctgacacggagcagcaagcgttgccccttcctgacctggccgagcagtttgcccctcctgatgttgccccgcctctccttataaagctcctggaagccattgagaagaaaggactggaatgttcgactctatacagaacacaaagctccagcaaccctgcagaattacgacagcttcttgattgtgatgccgcgtcagtggacttggagatgatcgacgtacacgtcttagcagatgctttcaaacgctatctcgccgacttaccaaatcctgtcattcctgtagctgtttacaatgagatgatgtctttagcccaagaactacagagccctgaagactgcatccagctgttgaagaagctcattagattgcctaatatacctcatcagtgttggcttacgcttcagtatttgctcaagcattttttcaagctctctcaagcctccagcaaaaaccttttgaatgcaagagtcctctctgagattttcagccccgtgcttttcagatttccagccgccagctctgataatactgaacacctcataaaagcgatagagattttaatctcaacggaatggaatgagagacagccagcaccagcactgccccccaaaccacccaagcccactactgtagccaacaacagcatgaacaacaatatgtccttgcaggatgctgaatggtactggggagacatctcaagggaagaagtgaatgaaaaactccgagacactgctgatgggacctttttggtacgagacgcatctactaaaatgcacggcgattacactcttacacctaggaaaggaggaaataacaaattaatcaaaatctttcaccgtgatggaaaatatggcttctctgatccattaaccttcaactctgtggttgagttaataaaccactaccggaatgagtctttagctcagtacaaccccaagctggatgtgaagttgctctacccagtgtccaaataccagcaggatcaagttgtcaaagaagataatattgaagctgtagggaaaaaattacatgaatataatactcaatttcaagaaaaaagtcgggaatatgatagattatatgaggagtacacccgtacttcccaggaaatccaaatgaaaagaacggctatcgaagcatttaatgaaaccataaaaatatttgaagaacaatgccaaacccaggagcggtacagcaaagaatacatagagaagtttaaacgcgaaggcaacgagaaagaaattcaaaggattatgcataaccatgataagctgaagtcgcgtatcagtgagatcattgacagtaggaggaggttggaagaagacttgaagaagcaggcagctgagtaccgagagatcgacaaacgcatgaacagtattaagccggacctcatccagttgagaaagacaagagaccaatacttgatgtggctgacgcagaaaggtgtgcggcagaagaagctgaacgagtggctggggaatgaaaataccgaagatcaatactccctggtagaagatgatgaggatttgccccaccatgacgagaagacgtggaatgtcgggagcagcaaccgaaacaaagcggagaacctattgcgagggaagcgagacggcactttccttgtccgggagagcagtaagcagggctgctatgcctgctccgtagtggtagacggcgaagtcaagcattgcgtcattaacaagactgccaccggctatggctttgccgagccctacaacctgtacagctccctgaaggagctggtgctacattatcaacacacctccctcgtgcagcacaatgactccctcaatgtcacactagcatacccagtatatgcacaacagaggcgatga

SEQ ID NO: 1448 - DNA, 96596 bp, Homo sapiens
cagcctatccttcctgcagctgccccagagcccatgagaaaagccactgcgcaggggagcacagggaacaggagacccacctgaggctcagccctatccctaagcccacataggggagtttactctctggggcaccccccttgcccatgcctccagcaacaaaacaattcaattgcttttttttttttttttttttgtccaaaataaaacctctgctagctctggaaaaaaaaaaaacaaaaagaagtttggtgttttgtttgtttgttttttttttttgtttgttttttttgttttttttttttgccaagtagtattccactgtatgggaataccataatttgtttattctttcacctgttaatggacatttcggttatttacagtttggggctactaaaaataaaactcccatgaatatatatccacaaaattttgtatggacacatgtttttatttttcttgggcaaatacacagaagtggaatcactggatcttacagtggatgtatgctcaacttttaaataaatggccaaactgttttcttcattacatcattttacattaccatcaccagagttacagagttgcacctgttccatatccttggcaacacttggtattatcaacctttataattttagccattctaatggatatgtggtcatatctcactgtgttttcttttttaattcagaaagtatttattgggtacctagagaatacaaaataatgtccctaatatggtttggctctgtatcccccacccaaatctcatctcaaattgtaatccccgaatgttgagaaagggacctgatgggaggggatgggttcatggaggcagtttttctcatgctgttctcatgatagtgagagagttctcactagatctgatggtttaaaagtgtggcactttcccttcatttatgttctctctctctctctctcgctgccttttgaagttgtgccttgcttctccttcaccttccaccatgattgtaagtttcctgaggtgaggcctccctagccatgtagaactgtgagtcaattaaacctctttcctttgtaaattacccagtctctggtattatctttatagcagtgtgaaaacaggataatacattccctttatatatatatttggcccttaattattttttaaatttttattgagttaaaatatataagataaaatttgccattttaaccattttaagtgtacaatgtagtggtattaattacattcacaatgctgttaaacatcaccactatctattccaaaattgctcatctcaaacagaaactgtacccattaagcaataaattcccattcccactcaccaaatcccataatctctattttcagtctctatgaattcatctattctagatatttcacataagaagactcatacaatatctgtccttttatgactggtttatttcatttagcataatatgttcaaagtgtatccatgttgtagcatgtgtaacaactttcttcctttttatggttggataatattcctttgtatagatacaccacactttgtttatccattcatgttaataaatacttggattgtttccaacttttgtgtgttgttgagtactgctgctgtgaacattggcttacaagtatctatttgagtcccctctcattatgattttaatttgcatttccctaatgactaaagatgttgagcttctatacatgaacttggttgccatccatatatcttttttcttttttcagagacagggtctcagtctatgggctacattggagcgtagtggctgaatcctagctcactgcagtcttgaactcctgggctgaagcaatcctcctgcctcagcctcccaagtagctaggactacaggtgcataccaccatactcagctaattctttctttcttttctttttctttttctttttttgagttggagtcttgccctgtcgcccaggctgaagtgcagtggcatgatctcggctcactgcaagctctgcctcccaggttcatgccattctcctgcctcagcctctggagtagctaggactacaggtgcccgtcaccacacctggctaattttttgtatttttactagagatggggtttcaccatgttagccaggatggtctcaatctcctgacctcatgatctgccctcctcggcctcccaaagtgctgggattacaggcatgagccaccatgcccggcagctaattcttaaatttattttattttttggagatacaggatcttgctatgttgcctaggctggtgttgaactcctggcctcaagcaatcctccagactctgcctcccaaagctctaggattataggcttgagacactgtttttgtttgattatttgctttgttttgttcccctggccctggagtgcagtggcaagatctcagctcactgtagcctctgcctccctcaagcaatgctctcacctcaggctcctaagtagtggggaccacagccacatgccaccactctcagctaattattgtattttgtgtagagacagggttttgccgtgttggccaggttggtcctaaactcccaggctcaagcagtctgcccaccttgtgttcccaaagtgctgggattacaggcatgaaccaccatacccagccctatataccttctttcataaagtgttgtgcaagtcttttgcccatttaaaaaaaactgcagtttttttttttaaattaagttgtaagagttcctaatgtattttaaatacaagttctttgttgcatatgtattttgaaaatattttctcccaccgggcgtggtagctcatgcctgtaatcccagcactttgggaggctgaagtagacagatcatgaagtcaagagtttgagaccagcctggccaacatggtgaaaccttgtctctactaaaaataaaaaaattagccaggcatggtagcacgtgcctgtagtcccagttacttgggaggctgaggcaggaagactgcttgaacctgggaggcagaggttgcagtgagccaagattgtgccactgcattccagcctgggtgacagagtgagactctgtttcaaaaaaagaaaacattttctcccaagatagggcttttcattgtcatgacagtgtcttttgaagatcaaaattctcaattttaatgaaaggccaattcactgattttgtttttttcttaagctcaagcttttttggtcctgatatttaagaaatcttttccaaacctttttttttttttaattttttgaagtattgtgttagctcttaaatttaggtctatgatccattttaagttaattttttatatggtaggctataagggtcaagatttattttgcctcgcatatggctttccagttgtttcatgctcacagatgttttggcaccacttgcagattggcttaatgggtggtcctgttgatctgtttccagatctggctctgacttaccagaccctcagaaggatgatctagacagcatttgcattctattgtttcaactgccacaaatgtaagaaactggtgtcaagtttcctttcacccttcagacctttctcccttactgagtgcccatgatgtaccaggaagtctgatagctgctgtattttatacaaaaataaaaattcgctcttgctttcaagcaaatagcacagaaatcttctacatttcatattttatcaactcaactgggataattgtattttaatttttttcaggtgagttttttttttgcaggtgattttgggatcagatattgagtaaaattgatctgaaactataactcatgaggctcatttacttccattctatactggttgacttattttcagagtcttattcctgaagtatgaggactgaagagctaaaagagaaaaaaatccctagagcatacattatgataagagacctttgagtacaggtgattgtaatctgacttgctctctgggatacattaaagtttcctctccttctaatgcttcaacatgaataacagcttgaaaaagctcagaaacaacagaatgggaattacagtactgttggtcttctgaattcttactatggtagtatatttgcccattttcatgctgctaataaggatgtacccaagactggataatttataaaggaaaagaggcttaatggtctcagagttccacatggttggggaggtctcgcaatcatggcagaaggtgaaaggcacatcttacatggtggcaggtaaaggtagaatgagagccaagcgaaaggggaaaccccttataaaaccatcaaatcttgtgagacttattcactaccacgagaacagtatgggggaaaccacccccgtgatgtaattatctcccactgcgtccctcccacaacatgtgggaattatgggagctataattcaaaatgagatttgggtggggacacagccaaaccatatcattcaacccctggcccttcccaaatcttatgtcctcacatttcaaaaccaacagtgccttcccaacagtcccccaaagtctcaattcatttcagtattaactcaaaagtccacagtccaaagactcacctgaaagaaggccagtcccttctgcctataagcctgtaaaatcaaaagtaagttagttacttcctagattacaatggaagtacaggcattggataaatacacccataccaaatgggagaaattggtcaaagcaaaggagctaaaggccccacgcaagtctgaaatccaccagggcagtcaaatcttaaagctccaaaatgatctcctttgactccgtgtctcacatacaggtcatgccgatataagaggtgggctcccatggtcttgggtagctccacccttgtggctttgcagggtacagtctcactctcggctgatttcatgggctggcattcagtgtctgtggcttttccaggtgcacggtgcaagctgtcggtggatctaccattctggggtctggaggacagtggccctcttctcacagctccactaggtggtgccccagtaggaactctgtgtgaggactccaaccccacatttcccttctgtactgccttagcagaggtccttcatgagggccccacccctgcagcaaacttctgccttgacatccaggcctttccatacatcctctgaaatccgggcagaggtttccaaacctcaattcttgacttctctgcacccacaggcccaaccatgtggaagttgccatggcttagggcttgcaccctctgaagccacagcccaagctgtaccttggccccatttagccacggttggagcagctgtggaaaaggtctctggcaagccctagagacattttccccattatcttggtgattaacatttagtgccttgttacttatgcaaatttctgcagccagcttgaatgtctcctctgaaaatgggtttttcctttctatcacatcaggttgcaaaatttctgaacttttatgatgtgtttcccttttaaaactgaatgcttttaacagcacccaagtcacctcttgaatggtttgctgcttaaacatttcttctgccaggtaccctaaatcttccccctcaaatttgaagttccacaaatctctagggtgggccaaaatgccaccaatctctttgctaaaacatagcaagagtcatctttactctagttctcaagttccttatctatatctgagaccacctcaacctggacctcattgttaatatcactatcagtatttttgtcaaagccattcaacaagtctctagaaagttccaaactttcccacattttcctgttttcctctgagccctccaagctgttccaacctctgcctgttacccagtttcaaagtcacttccacattttcaggtatctttacagcagcaccccactgctgctgtaataatttactgtatgagtctgttttcatgctgctgataaagacatacctgagactgggtaatttataaaggaaaagatgtgtaatggacttagagttccatgtggctggggaggcctcacaatcatggcagaaggagaaaggcacgtcttacacggtggcaggcaaagagagaatgagcgccaagtgaaaggggaaaccctttataaaaccatcagatcttgtgacacttactcactaccatgagaacagtatgggggaaactgccctcatgattcactgatctcccaccaggcttctctcacaacatgaaggcattataggagctacaactcaagatgagatttgggtggggacacagccaaaccatatcaggtagtaagtattccagtcaataattttttcatgtttctcttaatatgtaattaacctgcataactcacaataggtgcagattttaatctaagtaatgcaaagattcattctactttcccacccccaacacatcagttagcaggcaggagaaagagaaaataaaaatattgcatagaagaccatagtgttttgccccagggttgcaagcattgatatctcacccattaccaattcccagtcattgaatgcctacagtgtttggttctgttagagaacagaacatttaaaacacttgactctttagatcatgaggcttacattccaagaagccagtactcttcttgggtgatttttttttcccactttattttatgatgtgcagcatcataacatcacactaacctaacccacatttcaaaaaaatcacacgaatgtggcctaacctatatttctaaaaaaggttgaattcattgccagcattcaataattggaaaatagtccataaaaatctgtattttcagcttctctaggaaaattggaaaatttgggctcacattcctgtgcggcaacaattagctaaactctagttcagctgcccgctttaagaccagccatttgtactctactgtacccagagggctttcctaatggcgcctttcttaagtggctcctccaaagcagtggttcctaaaatctggcttcccactggaataatgtgaggagcttgaaaagttactaatgcctgcatttcaccccagagattttgatgtaatccatctggggtgcagaccaggtattgagatttttataagctcctcaggtatttgcaatgtgtagagaaaactgagaacccctgtctaagatagggcttctcaaagtttaacttgcataggaatcacctgataatcttgttaaaatgcagattttgattaagtatgcctgggatagggcctgggattctgcctttctaacaagctcttacatagtgccaaagctgctggtctatgggcctcacttgagaagtaaaggtctaagccatttgtatttcacattggctttgaaccctaagatacattcttaggtttcaagtctaatgaaagctaattctagcactcacaatattgatgtagctggaatgatgatgccaaatgagagtatcctaccatactttggggagaattctttctcagcctatagctactcagcctttcttgacattggggggtccttgacttcttatgccttgtatgtgacacccctgtatcacccctttcgttgcaaattgtacatcttctgctatttcgagctccttgctggtgtcactacctgctggccaacagtttggccattactgattgaaccatggtgtttgggtacttaatgtgagtattttattgcagaggttttcaatcagtgtttccagaagccttagagtaatagttctgaaaccatagggcatgcatcagatcacttggagagcttattaaaatacagattgctaggctccaccctcagcattcctgattcagtgaggacaatttgaatttccaacaaattctcaggagatccagatgtttctagtccaaggatccagaggttctagacagaaggaagggaggtggtgcaatgggcctcttggtcttgttacatgacttcttatcttatagttgtatttggggattctagactagattttattaaataaaaagattatttttaaaaaagcttgaatactgctgttttgttgcctttgcttttgtttcatagaaatcaattgaaggtgaaaataaataaaaatgctaatactagtgatatggggagatatcatcagtttaaaacaaatgaaatactgaatttatttagtatatgaaaagagagccttattttcttcccttgggacactctttatgatgaaaaaacgtaaaggaaatacaatgtacgctggaaataaattactaaagactgtgtctaaatgaggaggtgcatttgggaattttattgtttttaggtttgcgggtgaacagaatcccactgcaatagtgcataagactctttccagctatctccagaagaaggagataactagcaaggttttcactgttagagtttgttcagagcggaacctaaaggaaatactgggaaggtcacagcagtttcatctcagcttattggattggatcaaagtaattctactgcaaggcaaggtatatcattccatttacagacagagaatgcatgaagtccttcatttcacacagtaggtgtgaagaaggtaccttggtaaatttcctatttgctttcagataaagtgtattcttaaacatgatgtgggtagctgcctgtttttgtgtcgcctctgcaagagacatcttggaataatagaaacaccagtgtctgaatagcctaaagtggagcttacttttctgttaggtgagtcacctttaaaaatgatattttttaaggataagcgatgaattttaggacgttcttccctctacttccaacgtccacaagaataaaccaccaaattcaacgttttacagaggccaagtgcttaggttttgtgtgtttgtttttaagagttttcttgcaaggaaactgggagggaactataaaagggctttaggcaaacagggtgggcgggtgcagggctttaagctgcagaaaggagaatctggaaagagcttttaggaagcagattctcacatgttttaatatgaaagagtggcacacgtggtgctggcattccatcttaccatcagtggaaggtttgaaccaacatcaaatttttctggagcaacttaggtaattattacttgaagaatatgcatttcaaaactaacacctttaagagacaatgtaattcacctgcgcttccccgccccccccgcccgcgccaaccccaccccccgccaaccccgcccccgactccgcgaacgccgaggggcccgtggtctgcctgagtgacctccatttgctctgtcatctcaggactagaagccatcagccagcgtacgccctcagaaaactctcttcccttctcgcgggtccgcctggctcccggaggcggcggtgccaggctgccggagttagccagcggcaggctgcgggcgcccgtccctccggttcaccctttcacccctccttcacccccggagcgccaggcgggtgccgcgggttttccgcccactcggaaggcagtgctggcgagaccaggaattgcagggcctctccgctttggcgagctctggaatccgagtcctccccaccccagccactctgctggggcgctaggggctcgaaaaagcctggggttggctgaaagacactcggattagagacgcagccagcctccagggaggtctgaacttgtcttcgacctccccgaacccctccgcctctgcgctgggagacgcccagcagccgggcgggcccgggacgtgtagagccagagcactccgcagcggaggcagcgcgcggcacggccgcccggggcatccccgcggctggggggcggaaggcgagggcggtggcaggaagggtccgccaggcctgagctcgctcccccactgccagccgccggctcggaggcccgaggcgtgcggacggaaaggggcggagccgcgggctctggttggtgtgggctcgggggcggggcgcgcggggccgggccggaggcggggctagcgccgggcgctggagctgcgggcgcacggagaggagtcgccagcagctggagcggagttggaggaagcagcggcagcggcgagggcggcaggctagctgtcggagacggcaagcacggatcgggcacggccggcgggtcgcagccgggctggaggccggtcggaaccgagcgggcaggaggccaccgctgcagcgcgggccccgcagaggaaggaagccggcgggcggggtaggtaggcagcagcagccccgggtgtgtgtgctcgggcgggggaggcggtgcatgtgtgcacggctgccgcgactctcttcctgtcactggcagcggcttctccttctgcagagccccgccggggggaagcgggctggccaccggccctccccgcctccggcatctcctggccgccgggcagcactacccccgcgcgcggccggcgtcctgtgagatcccggccatcctgactcccgtttcccccgtcctcctgcgagctggtcctgcacgccgccggtcgcatttgcccccggagttgccaacgagctcgggcttcctcccaccctccgtcaccgcacacttccgagggtccccgctgtcgccttgctgcagttttccggggcccctcaccggaggagagcgccctggccgctgccttcgtgttgcgggaaggagcgctcccttcccccgtggccctccagctgcagccagggtcgctgcccgggcccttcccggggcgggcgaggcggcggtggtccccggagctcgtcccctaacccccgccttccgaagtttgccgccctcctcttccggggtgggggaagtgcgcctcggggcggttggtcgctggggccctaactcagcgtttattgccagccaagcttgggcaggttgttggaggcatatttagtggggtcttggaaccgcccggaaatccagcttttggaacgtggggcgaggcgggagggacctgcccagcaatatggagccggctggggagagccagggagcctgcaacccggagctaaaatatcgtgggcaattctctggaaaccacagctctaacactagtgagctctaaccacagctctaacctaagctcagaaactgcccctcagatcacaagacaaagagaacagaaaacctctggccaggcactcctgtacagaaatacactttgataaccagaattggagcctgaaatgcaaggatatatgcagaatggctgttacgtgttgaatgcagaatgtgtgtcaactgggtttgggggaattcttctgtttcccggggcgctattaatatcggaaaggtctcacttccaccgttaatcccttgagctgcagcgctgttggtgtccgagtgtgagtctgctctttatttgggggcttcatgattttaggttttttttcttttttctcttcttttcctctttgtcagccagtgcgaagtaccaatggataaagcagttccgggttttgaatgcaacataagattgtcattttggtgtgatgaggctcaagttttagtaatcaggagggatattcacagagcttattggtcaaggcttgatgtggagttatattttaatgcttcattagttctgttacgttttggcaaccttaaagatggttagatattagctaggaagggttggagtgggcagacaggttcatttcttaagcaggttattagaatattagattgtcacagtttgaattactaggaatttggtgacttctgcacagaaggccacaagtatcttttaacattgaaaaaggaagaaaaagcaactcactagctatacaactttttgacagattacactgttcttgaaaaaccgtttagaagaaagcagataagagttttcttaggtgcaaaagttgattaaactttaggaagcaagtgtttttgaccagtataaagaaaataagagtaatgtgtgggggtgtgtgtgtgtgtgtgtgtgtgtgtgtgcgcgcgcgcgcgtgcctgcggctaaagtttgggaagaaatgttggttcagagttaaggtttaagttggaaaggccagtggaggaggctccctgccttgcagaactgctgggtattgtcactgcttgcctcttcagcttttatatgcaggtaggtactagataatcatattactttttccagagaagtggatagatttttatgattgggagaaagtttaatgtatctgatactggcttgcaaagtgtaatgtgcatttacttttaactttcatcttgacttgggacctgttcttagttgcataacagaactctgcagtgtacacactgctatttgatgttttatctgctttttaaaaataatgatatcagtgagtctcttcctatccatgatgctgtatagtcagtgtaaaaagcattttgtttcccatttattgaatgttttttctttagcgatttcttgagtttaaatatactaagcgcaggaaatcctcacagaataaagttggttctgggaaacagaagtggaacaataagttataggaatacatattttgattatagacagtgatgatggtggtatgcgtttatcttttggtaatgtcagtttcacctaacgtgatttttgaaggactttgaattgtaaatgcaaacctactcaaactaacccaaattttgtactgttaaaagttttggccatttctttacatttttccatgactgtcatataatttttaggttgatatgttgattgaacatatcaacctaaattgatatgttcaatcaacatattggtcgttcaggggagtattgtaaaaaggcatctactctgaaagattgttcacatgatcattaaaataggaacaattctagttcagcttttattgtgtttgcattttgtgatttgcaaaatacatgttttattgaataaagagatggtgaatgagcaggctgaaaaaaaattgatttttatgctcaagtagaatatagccagttgagataatgtttgtgttgggttttggaattctctcacgtcaaggcatacacaatgcaaaagatattgtatgtttcatatgagctcctccagctctccctcttgcagggcacagggtttgcaagtgaaggcaagagaatgaagcattttaatgaagccctggaagactagaaagttagttatcaatggaaggaattatcaagttagtttttactttagaaagcagaatataaattatatcacagctttttatcaaaacctaggttttaattaattttcaaagtattcatatcatttactgcattttcccatgcctcctttacgtacaccctaatgccctaatgtgattacttgccatgattctgccaatacttgtatggagttacttgcttaaaagagtggcaattaacgaccatttcatgtacattaagccacatgagctgaaaaaatagactatatagttacttataaacttgtctgtatggcctttatttatcccctaggtgttaggtgtttatttatttgaaaggctagagtgattgtagtatagtgttattggaaaaaatgtctactgtagaaacatctttggagattttattctgctagcattgttttccttaaagtaaatcaaatacatatccacaggcacctgtagtcaaaatagttgtcaggttaatgatcatccaagagagtattgaagtcacaggagtctggccacagtgtgaggaggctccaccagtgagtgtagtgagttaataaagccaaggcatctggaccagccattccttgcctgttgtcttcctccccggatgtcccagtgtcccagcctggggttctgccccaggatcaagggctgtaccatgaggacacagctactcatctctaaatcctggggatgcacacacacatgtacacatcccttggcctctcccaggcctcctttgtcctgacctctgtagagccgtcctctacctcaggtaaggagagaactacatgggcaaagtccacactcagcctttatctatttactccaaaaggggtttaagacagcgggagttttattttagctagattcaggattcacttagaactgtttgcagagttaagaggcaatgcagaagaaaatccctcacaaatgtttgttcctctgttaaatctgaattgtataaatggcagtaggtgacattcaatactaatagaaataatagtaatataatagttgcaatttactagctatgtaactttaggcaaaatatttaacttttatctgcttgttttctcatctgtaaaatagagataattgttgtacttagagtgattgtaatggttaaatgagttgatatatgtacaactctgagaactatgtgcctggcacatagtaagtactatgttggcattaattatcctaagctcctattatcaagtatggagcgaagtgctttatgtatgtcattttgttaatcctcataatgactctgtgggctgtaggtttgcttatagctgtctcacagatgataaaactgtgccacagagaggtttaagtaactttcctgaggttacatatttaggcacaatctgactggggcagctgcctgaatctgaagctcagtgttcatactaaccttgccaagaagtttacagaatagcatctttttttcaaaagaagagagacttgaagtcatccccttcagtcctctcattcctgccccctcaggtcctcttcattgtgatgatgcagagaaccggaatggtcagcctcatggccttttctgggtgataggatctgtctgtccctcaggtcccagaagctacgtcaccctttctcccagcctccgcataatggctactgcgtgcctaagcgttgctgtcacctgggccagggtcattcctctgtgtttcctgcagtaccttcccctcatgttggctgctttctgaagagccctagctccttgttgtgttacctgggcttgtgctacctgttctcctctccctcgccccacaaacacaacaccaaaagggcttgtaggcgagaattacagcctatacagcctgtttacccacaccacacacccagccctgagcatggcagcatgcaacacattctatttagttggttggtttggaaatgaatttgatgtctattatttggggttaatctcagcccattattttcattttattttaattgatataaagtccacataccataaaattcaccctaaattcatcatttcaaattgaaggcaatttattatgtttactaggtgctctgggttgaatgtgtcccccagagtttacatgtcagaaatgtaatccctaatgcaactgtgttgggaggtagggcctaataggaggctgtgctctcttgaatggattaatgtcattatggcaagagtagattagttatcttgggaatgggcttgttataaactcgagtttggccctgtcttgctgtcttgcccttgcaagaggacataagatgaaggccttcaccagatgctagtgccatgctcttggactttccagcctccagaaccaaatatacttctgttgtttataaattacccagtctcaggaattccattataacaacacaaaatggactaagacactaggatattttaattttgttcgtcttgattttcatgatttctgggacaccatgatttggaaggtaaaccatttttaaataatgatttttttaaagactgtatgaatttaggtgaggagcttgacctagactctgaactagcacactgaagttaaaaagatggactgtagagagatatgggctgtgggcccaggaacccttccataccctcctgccttggttgaagacccatttcgtgctgccatccaatgcctaactgctaatttcattgggagatagaatcacatgacttggatatattcttgattaatttaatgtgatttaaaaatatcctgtattcctgcctgtccatcaagttctccaaattcttgtcatttctaaatggagaatggagtaactcaacaaagtcagagagggcttttttgtttggctctttgccaaaatgcctataggttagagggttacacagaaaatctactttacagcagttgtacgttaagtagctgtggattgctatttgtcaaacatcagaaacaattttattttggggaatagaaagagaattgctctgtatgttagcagggacagaaaatatgcttctgattaatgggattgcaggcagtcattagaaggattgaaagactggagaaaaattccttaaaattttgaactgttgcatatgatattatataagagtaagttagtttacttgttcgtaggattcctttataccctttgttacaataacttatgcatgcactagcttggagcctatatcacaaaactgccttggttatttgaaaatattacattgtagataatgttatctacatataaaaagcctttgctatgtgaataatcatgtcagaactgggtaaaaatagtttagtgggcaggtatatgtagcaaaagagaatagaggcatgatagagtgaatctgaggaaaaatcctgttgatttggatagtttaggctccaggtcgatctcggtaggggtggtggttacacaggtattaccaaatacctcaggctgctgggtcttctgcagtactgtgaagaatttgaggatgagagaaaagagaacttcccagtcctctagatgtgacagtccttgtggcagtgccatatccccctaaggaggagctgggttattggaaattgttcagtggaggggcctgggatagtggcaggaggcagaggtgctaaggatacaggtggcagaagcgaagctcatagagcagaaataggcaggattccagaagtgggcagccttccagaagtggtgtgcccagtattcttttattcactagtttatggacttctttcgcagggacacattttaatgaagtctctttggaagaaaatttgcatggctgagatgctgggttttggagttgatggaactgccgagttaaaatagcttttttgtgtgtgcaggtagtgtgaaagagccacatacactatcagtaaagccgctgtctgagagagttaaagaggcagacagacagttaaggttaattggagtgatcagcttgtgcaggccacgaacctgcatcatccacaccaaagcaagttgagttcaggcagtagatgctggaggtgttaaaaatgggacttacagagctagactgcctggatctgaattctagttcctcttcgcaattgctaagtattatcgtgacagagatattttctgtcctatgttaagtgagactactgatagtacctgtttttatatagttatctacacacacacacacatacatatatgactatatatatgactatatatatatgactgtatataactatatatagtcagcatcatcatatcatctaatactaattgggagctatatgtgtacaaactcaatcatcatcatcatcatcatcatcatcatcatcatcatcatcatcacccaatacttaaccggagttttatgtggattaacccattcagtcctcaagaatgacagacgtcaaaatggacatggcagtcaggagaaagtgtacaatgtgcaaaagagtaggggtggctgccttctctgtctagctaagggctctctacatcttatcaccatgctgtccagtccccaccccaatgacttgactgctctccttttttttttttttccacaacattgccctcagaccacttaattgacactgactaatggctggccttgaattaacgtctgcatcaatggatggatgccctgtttgtatccatcttcctggccttactttggggtctcagaagacagaaatggtgtgttctatttaccatcctagagtcatagaagatttgtggttctttttatcagatgaggacccagagttctgcacagggttcttcttacccacaaagtaaggttcttcttacaggtggcaagggagagagaatttgtagagacctttagttctctgtcacttcagacagggattgcctctctggtgtctagcctctaaaagtcatcatgttccttaggtttctatttccctttgcacaaatttagcctcaggcagactcaagcacagcttttaggtttgtaaaaccttgacaagtcctggagccttttcttaatacagagccccctggcaaggaacagcttcagaggtaagctgtgagcaggggcttgcttgatggttcctggaggattgaagatggggaagagtttgttcattatacttcccattctattaagaatcccaccaaactggcccactgggtggctggaataaaggaagtgttaggaagcagctggcataaagatctacccagcctactggttgaggatttttttttcccccctaaaagacatacattgccaggaaaagctaacaaaaatttcaaggcagatttggaggaattaaattattcttaggcacattgcctggtttctaagcatttagggatatgtaaatgttcatgttctttagaggtctctgtctcttttgtacagagtacattagtactaaaaatgagatttgctagttctacattttcatgtgaatttatgcagtgaatattcaatttgattctggatctttcaaaaggaaaggctttctttaaacaaataatatagcttatttttctgatatgctctattggttgctttgatttttttctccgacaactgaaatgcgaagtagagtactatccccaattaatattcttgctccacaaagacttccagtgtttgtttttgcttcttttaatatgtaactctcctaagtgtgttattgtattacagctaagaggctttacccatgtaaagttgaatactttacacttctgaatgccaacataacaattaatctatgattagattttgcttcttaagatgcctccactgacgagtgcctgtaatattaaacttctaaagtgttccactctttaaaacttataaaagctctctttgatatagcccactgaaattgtgtggctattgtttttattgctttattgtgcagccagcttaactgaaacctttgggtggcttttactctttataataaagataacattgagaaatgcctggagtacaaagtgtatatgtgtacatgccgttctcagccatctactctgacttagtaactctctaattcccttgcctccactatgtttaagaacaaaaaagaaaaacacttacatttcacatttcctccatcaagctgtctttatagagtggtctgtagcaaccattgctacttcctctctaatattttttaactccttaagatgttgttgctgtcctcactgctggactggaatctgcgtgatgattccatcatgggcgaagccccaaattatttagccttgactcagtctctcctgtctggatgcctttgcaggatttagtcttagggatcacattttcctacttgaactcttcttccttgtttttgggatgttgtctctaaaccttgactttccttcctcagttacatacattgaacttcactatttggcccttggatcatttttttttttttttaacttttgatttgtccttgtgagctcttccattccattgaattcagccttgcctaattgtggccgattgccaaatccctagcatgtttcctcttctgaatcacagaccagggtttcatcagccactagcacacttgcacaggggtgcccagaatcaccgtcagcccatcaggtcacctggcttctctttgcctgatagtgctccaaactctcattaatgcaggatcaggcaccctttgctcctctcgttctcgccgcacatttaagcatttgccacatcccacatgttctttctctgcagtgtttatttcactcctcccctttccacacctgctgctgccaccctggtttgtgtcctcactacctcttggccagacctctgcaacacacctttctcgcacactgtggttagattgatattcctggagtgcagctctgatcccgttgctcacttttcaccaagccctttccgtgttccacactgtgggctgaattactcacaaactcagcatgggcatgcgtgatgtcctacagcccctacctaaatctctaaccccaatcccactgctccctctttggctccagacggattggactgcctgttctagctcttctcagaatatgacattttcttggtcacttctgtaactagcgtccgaccacacatgccattctgtcttcagattcctgcagttagtgtgctttctccctcgtttgaaccctgcagtgtttagtttctgcctctcttatgacatgtactagtgttgtggctctgtgtactctgagccacattatcagcgataatgtcacattatcgctaagacattgcctcatgccgacactcctcccctctgcccccgcccggtgttcttagaaggcagggactgccttactaatctctgttgtgtcaagcaatagcacactggcctgtgtctgtctgccaaatcgattaagtacttgttgaatggaagtagaaattccaattaacacagatggcaaagtgtgctgttcattcttaagtctcgtttttttcattcctaggtgaagctcgtgtgtggagtgccacggtacaatcagacgacagatggacagtgtgacaaaagtgtcagaaaggattgggcctcgctgtgagagtcagcctggattcaaagtgttgacaagttgctgaaaaggaagccagtgagaggactgtggcacgcagaggaagtggagccctgtcttcggtcacaccattgatggaggacagatggacagccgtatggccagtcacctctcctcttaaacctttggagagtggtcctttgtcctctgctggacacataataggaattctaacacattctctgaattcacttttcataaaaacgtaaaatcagactgctctgtacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttatgtagaatatattggaaggaaaaaaatctcgcctcccacaccaaagccccggccacctcggcctcttcctgttgcaccaggttcttcgaaaactgaagcagatgttgaacaacaaggtcagtattgatacgtggttgcttaatgactccctttctttttctttttaaggaaaagtcttaagtttgggttgagtcgttatgttctgggcagaagttaccttggcaactgcacctgaattgatgtgtggtgcataaaagcttggtcaatcattacacaactagaaatttgtgtttgtggggttggaagttgttataaaaatagggacacagtatccgagaacctgtttagtgagtgtcgttgaacactattattatagttgtcattgaattaaacatctactatatttcttatttttgtaattggcattataggcggagtattcctagtctgaaaatatgaaatctaaaatgctgaaaaacccaaaattttttgacacccaaaggaaattctcattagagcattccagaattcagattcagtggtcaaggggtataatgcaaatattccaaaatccagaacaacatgaaatctacaacacttctggttccaagcatttcagataaggaatactcaacctgtgtatatctaataataattttgggaaagtggagggtaagtctaatataagtatatttaacatgatttgtatggaaaaatgtagagagtaataaaatgaccacagaactcggctgagaagaaaccattgtttttataacctggtatctacctcttggtttcctctccaggatcgctgtggccaaagctgaaacccaatcctatagttagtataaaagtaaagggatttcacttcctttgtgggtagtgtcatttgtagcattaatgcctatagtctggttcgccttcatgagggggaagaaaaattcactgaatactttgcttaaatggaaaccaccttcattcaaaaaccacttattgcttattggagatggtccatacttgcgcttcaggcacagctgtgtctttaaggtttatcttctgttcggtttcacacagagacaagccttatgctcagctttgctgttatcagctttgtcaaataccggtttcctcactagtaaatcacacgcatttttcttttttctcttgtgtagtcttctttcttagggtctaagaagggaatgggaaggaatggtttaagatgggtgggcctaactgcagtagttatatattgaggagacctgactggcatcacaggatatttctggaagagattctgataccactagtaagctattataccttctttaatgttgccttattctaacacaagtgaataagacaatgagaacagagaaacagaatgcaagggtaagagctgcctttcagtattgagtagtaatagattgggaatattgtgttaaaatcaaggaatttattaatgatacctgaagggaagcccttttctttcccatacccagcccaaagggatacttatttcataaatgttatactttataatgttcaaataatatcttttattatattgttcaaaagccaaagttaatttttctttgcagatcaatcaaaaaaccatgactctccgcacatacataagtgattttatcaaccattgcagcacttagcagattgaagatacatacgtaatcgtttttctccaccaagttatatattttcaccttttattttttttaagttaaaaacgctttcttcagtagcctaattccaaaggaaaagtgatttaatttttccgagaatacagagctttacagaatcataaaaatagttgaattagagaagattatttaaaaggtggaataagggcaccttgtcaagattagttacaaaacaattttataaaagcagtttctaaacaaaatttgcatttgataattgctatcaggtgcaagtttctttggctctggtgtacagaaaagcaagtctttccttataggaaaagtcattttctctttttatatcctaaactattttataatgcttgctttctcatgtaatgtgatgacaattgagatttttagcagctttttcatttttctttaatacatggaaagatggagtgaaatgaaaatttttagcagaattcaagaaagagacccatgataatgtgcataaaagtattagagcctgaatataaatgagaaattagtaataactgaaagattgaaaggagagtgttgggggggggtcatgtggggagtataatactaaacattcaattttctagaagtgttggtcttgtattctcatttaaatattcctatgaagcgagaattcaatagctcctatgagttgcatgttgaattcatatggaaagtagttataaggacaaattttatatgttagaacctgtgagactagtttcttttgcctccgtttgtatttctttgaaaagcttttgcagtgacaaattgtgtgaaggcaagaaatgatagttctgttctattcttaccataattgaattctttagttcttttctttttttttccttttaacaccctccacctccacctgacttagccagtttttcatgttatgctgtgtttattgcatttagaaggttattcctcaccaacccccaccccaggtctaggaaccacatgcagttttgttttgtggacttggcacacctcgttaatgggcagcagggtagacagagggtgcgaggacagcctgcatgccaattgtgtgtctgtgtcctgctgagccttgctgccctctctgtttttaaaaggaaattgtccttagactctggccaagagtacgttctgtgagagattcctccctgtacgatagtgtcttacttttccactttgcttgtatgttcttggaaataaagctgtgatatttaactttttgagagaaagagtcaaaaacccattaggaaatcttatatacggcactgtactttcttccaatacattttgcatgcagtttttaggaagccctggcatatagattgaatgaattgttttaattggataattttggatgtttttggacttaaatacattcagtaagcatggtctgagtccttattttgtgctggaaagcaaagataaaagatgaaatcaaggctcaagagccagcatgccctgagatgctctctcatgcctctcttccacctttggagctgtgctttttctcctctgctagtacagctcttcccctagacatctgcctgactgacccactctcacttctctgctcaaatctttcgtctcatggagtctggctctactcacgctattctatgctgggacctacctctctgcttttgcaaatcattgattacttaacccacgatatcgtttacttattacgtttattgttcattgactgttccctctgttagattttaagctccataaggggagagatctttgtggtcccccattatcctaagtacctaggacagtgtggtagtttcccaacatgctggtaaacaggtgctgctgcagctcatcctacagctatttcactttctgcattgcttttgaaattgaccacgtgctctgaatgtcatgtgcagtcatacaaagcttaatggcccatcttgttttagaaaataacagcttatttgttatccacatccttcatctgaggcatcctgccttggccttaaccattgcctggtatgtctccagaactctttattttcttcccagggcctgggacaggtagttctgctggtgggaaagtgcattaagctgatagtaccttcagtcacttaagccaagtgagtagaggggctgtcatggtcagcgaatatcctcagggcaaattctgtgccctttctcccatccttttatctccttccctttgcatgggggctaaaattgccaatatgaggatgacgttttattttatttttctacaagccagtagagccctatgttatgttcttcggagagaacctcttccatgttttgtttggataaagagtgtgctgggtgtgcaaggtgggtgttacatgtcctcgggtgaggcagctattgaaaggcaatcttatggctctttctgctttagcttgctcagatcctggcatcccatcccgctacaccaaccccattcagccagggtcctgtattttctcttgtacacaacgaaatgagttgattgaaaatggggatatagggatatgggaataaaaatatattcctctgtcatatgtaagccatccagtggggctatttctcaagacagtggttttaactcatactttgagatcctttaattaaagtcatgctaatgcagaatatttagacgggtgagagtctgtgcccatgttagtttgtgcagtgcagtgaaacctgctaacacaagagattacttactgcatacccacctccatcctgacctgcacaaccctccctggctcctcctgcagcctctgacagtggatttcagctggtttcaaacctaagacataaagcatgcatttgacatggcttacgctaaattttgatcaaaatcccttttaaacagaaagaaaaaggccaccattggtgttggttttcatggtttcccaaggcatgttattgttaaatttttcacattcagcatttgagtgtcccttcatggttgttgttccctgtccagaaagcagggctgcaataaatcacaaacattgactacactgtacagaggtcacagaaaatagtgacctgatcccaaattacacacctctgctgagcccgttggtcataacctacgctgtctccttgaggcaaatagtgcttgtgcaagtaatttgctttgcttcacaaattcctgcctttacgaattctgttttctttcagaatatactttctcataacattcttcactcttccttcctacttaagtctttgctgtgaacttggaggtttgtcttgttaagcccaagtgatggggaaaaccacccaatttatggtgctgactgctcattctgcatctatcgaccactctgtttttgcgagaaagttgggtcagttacaggatcttagaagataagggcctttgagctctgtctctaacttctgaccacaagaaaagttcatcaggacattatggagatttttacccaggcatgaaaatttaagtgtttgccctctgtgtttcagtaggaaatgaaatatatttctactgaaatataattgattaaagagtgtgtctggaaaaaacaaatgtgctaattattttgaataaaatcagattagcctaaccacttagggtcacagaatatgtcatttgcatattaaattacttattgcaacacagttcaccctctcatgagcatttatattctcaatacattcttgattttttaaaaacattttttctgttaactttgtttccctaaaaatgtgtaagagaaaggaaagtagccctaattagcgatttgtgtatccgtggttttttgaaaatgaaattgacaaaaagagacaggatgctcacttttattgctttttgcaggagggttcttaccctgagctggcctggccactttaggaattcacaggcacgctctgaggggcctgtgagtagggaggctctcttacccagaggggagaggaaggcatttctccctccttccctcagtctgttatttgaagggaatcacttgaactgctctcctagagctgcggtgacagttaagtccagggttgcagaataagacagtatttgaggagaagaagctttctgccaggtgtctgtttctgcctctgtcctttagaatcacagggttatggtaggcaagttatattttcttatttaagtgaaatgtttgttcagatgcttttgttaaggcttctgttctatacacttctttctgtgttcttttttcaaaaatgggaaaagggtccagtgtccttatatgtatatcctaagtaaagccctcacacacctctgattcaaataggagttatttaattagagggagcatattttgttttctggcaactaagttaatgttgatattctaatacaattttctttgttataaatatggaactctctatttaacttgtcaatagattctttgataaatttgatgtcagtcttctctggtttctaggtgatgcatctttgtctacaacaagagacattctgattagtaagaatttcttctctgagttagaaaaaaaattagaaattctgaaattcaacaacaaatgctgacttacatctgctaagtagcacccaaaaaggggagaattttttacctatggcaaataagagtgccaaatgtgacatcatttacatatccatgttttgattagtaaaaaccaaacagatgttagcagtacagctggctcttgcatatatgtgtatctttgttgctaacagatttccatggggaaggatgtagcactggtctgaagtctcagataggagaagataacatggtgtgatagcttgaaatgaggagcataattgcatgatggattatatctgaatgttttgaggtcttgagtttatagcattcgatatcaaagcagtccttaggctttcaatagaggaggacacatggagggggacaaagtgaactagaaatgggctttatttcaattgcttgggtatagtgtacctaaaatgtcaagttgtttaacagaatatcagactactttataaatgtgttattccttcttaccaatttatgtaatattttatttttactatgaaaattccatgcagtatacaaacagtacgtggaattgtagtagaaacattgttaaaatataactttgaattaaaaacaaaacatggtatacattgttatataatggataacatagtgtatacattgttaaaatatatccttgcaattaaaaacaaaacaaatcagctgcaaacctttgtttaattatgtatgcagaactttctcccaatggctttataccacctaaggcatggctgtgattttcaggaataccctctctggactgtttcttgcttggaggtgtttgcgatgtatttgtatttgtctgtctatctattctcagttggtagattatgtaatgcctatagattattctgtcctgtcacagtttgattcattttgaagttataactgtgaatttattacagcgtattgcaggagacgtaatttgatgatcaaatctgatatccaagatcgtaaagaatataggcataaatgaaatataaatctgtgatatattatttgaatcagaaattccacattgctttgctttctataaattccttaacgttctagttccagtgttctctaattgtaagatgagaagctaaatgctgtctcttttgagtttcagcagtttttgttttaatccttctcttcccaatcagaagaactgtcggagaaataagacccagaaaaattggttctcactagtagtgtttccccaataatgcaacccagaagccctgtatatgagaataagggaatgtagtgagaggatttatgcagagaaacaacctaggatggttggaaagatgtacttacatgacctcattgcacgatctgattggagactggtccatggattgtatgggattattgcttatgaaagtgcccacctggtatcaagtttttgcagatgcatgcggtgtatggttttaagacatgtttcaccagtgtgaatatttaggctctacttctgttggtgggcagttagcaattgctggtatctaaactggtttgagacttactgcctcatttgaacagtatctgtgcagtagcgctaaactcgttgacatgatctgtactgagagttcctacagatttgtttcatatatatttgttaaattttccaaggtaagtagagagtgatggttataacatttgtttattcagacccctctaaatctacctaagaggtaacatgttagcataggcattagacaaggctgcattgtgaagtcagagtgactgtctggggttgtcactgtcatcttccaagctttctcctaaagaagaaaattgacataatgctctcagacttggcacatgggaccagtgccacagcaagcactggttctagcctgctactggtttttggtaaaatgcagttttcagaactactcaagggtgtaataagattaatttttatgatattagatataatatgttaactttttagctattgttaatcttaaacactgatggctttatttttattctatttaaaaaaataatttttgaggccaggtgcagtggctcacacctgtaatcccagcattttgggaggccaaggtgggcagatcacttgaggtcaggagatcaaaaccagcatggccaatatggtgaaaccccatctctactaaaaatacaaaaattagctgggtgtgatggtgcatgcctgtaatcccagctactagggaggctgaggcaggagaatcgcttgaaactgggaggcagaggttgcagtgagccgagattgtgccactgcactttagcctgggtgacagagtgaaagtgtctcaaaataaataaataaataaataaataaataaataaataaataaataattttcaatgcttaagaattttttatcagtaaacagttcatttgaatttttttttgcattcttgtttcccaactatagaaacatagctgaatatttgtggcatcattaatgcataatttcaaagcattttacacattgttaattaaatctcaccatgttctttcaggtagcaaaaagtaagtttatttttgattcagaagtatttgaagaagttagaacaagatgattttattgctaaataataaggaatatctgtggagtaccaaggaatgagatataatgaatttggttagagtatatcaaagtacatattatagtttttgtcttacacttccctgtgggtctgtttaactattgaaaatgtcttcttcaaaatgaaccttaaacatttgcaaacttactctttgctaattattctgccaggcatttttttttttcttttttttttgaatcttgctctgttgcccaggctggagtgcagtggctcaatctcagctgactgcaacctctgcctcctgggttcaagcagttctccagccacagcctcccaagtagctgggactacaggcacatgctgccacgcctggctaatttttgtatttttagtagagacagggtttcaccatattggtcaggctggtctcgaactcctaacctcaggtgatccacccacctcggcctcctaaactggtgggattaccagcgcgagccaccacgctggccctgccaggcattttatagacatttttcatttgacgctcacaaccaccctgcaaagatggcatattataacctttttttgtttgtttgtttgtttttttgagatggagtctcgctctgtcgcccgggctggagagcagtggcacgatctcggctcactgcaagctccgcctcctgggttcacgccattctcctgtctcagcctcccgagtagctgggactacaggcacctgccaccacgcccgtctaattttttgtattttttgtagagacggggtttcactgtgttagccaggatggtctcgatctcttgaccttgtgatccgcccacctcggcctcccaaagtgctgggattgcaggcatgagccaccacgcctggccctataaccgtttttgagatttaaaaactgaaggtcatgtgattgtgtaaatatttaaaaagtgatcatattaaaaaatatcatagtgatggcacattgataagattcaagaacattttgggcaaggcaggcagtcatgaggatctccttaagcagtctcttgtgaagtgatcggtaactgaattttgctttttgggtggtcttcaattatgtctgctttatctgttaggtttcactagctattacattcatgcaactccagaaatttacctccaatttatatgtgacttacaacattttcttatgtctggtaaatatttgaaaggattgaattacaaagagacggataaggccatgaagctaagacaaagttttgggtatgtgcatgtaaatgcaatttttctcaggaagaaatacaccatgatcagataactcaaaagttttataaccttgataaatagatttaccttcgtttctgttgtttttgaagaagttaaatgtctgctttaaatgtttccctgagtttcaagttttcttatttcagactcataattatatcattttgattaaaatggagcacagactggagttattacttgcttaaaagccaaaaacttgagggtatccagcataagaattgtgtgttttggtctgtggatagcagctgcttgaagtccataaaaacaagaaacctgaagttgattcagatgaatctgaagtcttgtacctgaattatgtcaaggttagcagtaaatgccatttaaaaagactgagtacaaattgccaaattcctttgaatgccaaaccatatttctcaggaaagttggccactgccaaatttataacatttgtgtttctgttacctgaattccaagggcagaggggtgattgagggggtaagggaaaggcacaggtgaattttattttcagatgtctaataggacagtgtgacattgcccagagatagtctctcaaaggtagtgagtgccagcagaacttctcgaatgcgaagttgagaaattttacttatttacttattttcccattgaaaaaaaaaaaaaaaactttaaatgttttctgagttaaaaaggcctctgactggtagtcctgacacagcttcttgagagtctccgagagagcctcttctcagtacaattcctaagaagataggaagaaaaaaaaaaatattcttaacacataaaactagaattagtgggaagaaatgcctactgtaaactcaacagaaccggggttaaaaaatataggataagttttgactacctaaaagtagcagggcagacccatctcttccctaactctgtccataattcagaaagggcccagggaactgtcctcaggaatgctcttcccccctcttccttgtcctctccgacagagcctttctaatcagtaggaggtcacaacttagaaaataaccagagagagctggaatggtaagttaggggctattactgttatattctgagaatcctgatccatgaaaataaagtgctgaaggtggggtagagttagaaagacctgtgttcactgagggttttgagtattacaggctctccatcactcagagcatcagaaagtcaggcggtgaacgcaggagatttttctctcaggctaaccaaaaccatgttgaaatgaaaaccactttggaattggccttttcgtctcagactgccaaataactagcacccaagtggatcccttagctcagagcagtcaccaggcatgggtaggtctttccttgtttagtgataaacaggaaaaacctaaccgagcctactgaaccatgtccatctataaaagaaaaagggagatcatactggagatttgaaagaagagtagacctccagaactgattgattataatttatttctgttatagtatttccacttagtattatgatttatttctgtccctcatgaaagggacagaaagtagtcaggcggttatgagatgaaaagacagtaagatgggatgaaatcggagtgaaacaataaaaaaaagactaagttaaaaatgtaatagcatattaaaattcatgtgtaagggggtaatgagctgaaaataaagtctgtgttttgaaggagaaacaagataaagctctttggaatccaaaggataaaaacataaaatgagggagaagatatatagagagaatatctaacaggagaattacaagtgttgataaacagggaaccaagtgaaatagaacaacatcattataagaagttttcatgcacgtgtgcagatttgaaagtgttgccgtatttttcatgtgaaatcaatgaaaaatatgtttgggcatttctatttaagaataatgttaaagtaccttgccaaaatatctggcaagatattagctaccagggaacaaagttgtttttcttctcctttctagcaataaatgccaaaaaaaaaaaaaaatagtgcattgattttagtagagttttgaggagaaaagatggtgacttaagaacttactgagcttcctccttatatgttatgtggaaaggcaattgagaggcattcgttgataagcaggagctcaggaaagatacactaaacctcttgttcacgtgggagtacctaaaggttgcctttttattgttaagctttataatttaaaaaggtgtaaatttaaacttaattcattttggttaacttcagtaattatcaaaataataaaactataaagtatgtatcttctaaacacctagaaatatatattccaaaagataggcaacaaagaaagaataaaaataatacagggaaaatgtttactatatatgactactttaaagaaatacagacattaacatatgtatgtacgtatatacacatacatatatacatataaaattgaccatatacatatatttgtgtgttcaacacacgcattatttttcaggtactgcactaaccttttattccattgacttgttacttttcctaagaactctgtgacactggccttattatacctgttttaaagataaacaagtttagttagagatggcccaaggtcacacagctagtggaggagctgggatttgaccccaaacagtctgactgttgacccaatgctcttaagcaactgtgcaatacagcgaaaggggcgccgggggttaatgttcacactgcttgatgctgctgacttccgaccagccacaaggcaccccggagccaaaggcagatgactccctggcttgccagtgacgtgtgatgcggtctgatatgacaaagtgagttaaacaagcagatttttcctctcaggaaacagacacaagaacaactgaaaagaataaagcagatgtgtgagttactattccttacagcaaaagaacctcatcagaaccgcaggctggaaagaggtgattacttttaaagggcagttcattcctcctgcatgttggaaactgtggctcttaactggctaaaattttaactttcagtgtagccctcacttggcttgtgcttcttaatgttgtagataacattatagatttatataatattcaacttttatatatatattacttatatataaatgtttatgtataaatatatatttgtatataatatgtattcgtatatgatatgtagtaaatgttatatttaaaccatcatatagaaaagccattattgggtacactgtacaaatctgcctttataattgagtgtactgttctactaaaagcagctttagagaaaggattgaaagccagctctttctacttcactagccttcattgtttggattggcattatgtgtacagttatattgtaactgtcacttgtggtctaatcttccccttaggggaaacttgagaaacctggtcagctttaacatttagaggaagtttaaacatattggagcataaaattcacagttgtttaactgaaactccagttcttgtcagaccacatctctccagcccttctgtgattggaatcatctaactttggccctcaataaggaaaactttgacaagatgcaaaaaatgtttactcttgttttctttgccaggaacctgagtctgcagcagactctgagacctctttgcctgccccaaataagtgaattgtcactgtaactgttttttatccccataactgctttcggtgaatgccaatctagttgttacatgcctttaatattttgggtaattatgttctttaagaatgaaaatattttttccttccttcctttcttctttccttcctggttttgttatagtctagctgtgagaccagttgcctttcatatattctagaagagaaggatgaggtgagtttcacagtgatctttttccaaaatacaaaaccactgtcactctccacttcccaggcaaccccactcattctattttctagtgagggttttgcttagatgatgacgagtctcttgattcagtggactcctaagggaccatctttcaccagcaccaaatgctgtttagttcacatattgaaatgttttaaattataacttagcaattgtagttagtaatcttcacattatattgtctcacatttaatgtataatttcctaagagaaggaaatggtcctggtgggggttaatagttatagtaactattaataatactgatgactactagttaatagtaattaaggcctcctaaaatgagaggaaaaaaaatcttttgtttataaggtttaaaaagaagagttgatacttaatagttttagtaaaaccccagtgcatgttcgattaattttgttactttattctgggcatgtagttgaataattacctgcatttttgatttgctgaaaaggtggtggttacaattttttttgtttttttttttttacagtactgtttttagttcattacattgagatgctacattttccttttcttaaatacatgcaagatgaaatgttttacctctgagatgaaaaatttgaaatttctttaatgtgactccttactaacacaattgcaggcaagcattgaacatttgctttgttccaggcaccatgtgctgtgtgctctacctacctaatctcacttagtccacttagtgctatttgcaggttgaggcttagaaagaaaaagaaacttgcccagagtccaacactagtagctggtaaagagctggtctttgcatgcagcctctctcacttcaggatgggtgcttcccagcaccacactgtaccaccctcaagacgagttgcaggaggaaaggaacctctagtggtattaactaaatcttagcaagtagttgcctgtaaattgtagacttttaaatacaatctcacatttctgtgatctttacccatacaccagttaccttcaaactaatttaagaatcttatagatattaaaaatgcttgattggccaatatctcatttctgtcaaaatcatgtactagaagcatgtatcaaatcagagacttatttatgacaatttgcacacacatttggataaaatgcatcaacttctttcaaagtttacttgaaataaaaagggaagaatacgaagtatcacaggttaaagcaatgccctcattccatttaggcaaaagtgttgtgctatttgaatagtgttagtttgagaatatggagttgtactccttatagcaattccaacctagaaaaatgtttgtgttttaattgatgggttaggcaaaaagttaatctttgcatagaggaaagaaacagctctgacttagaggtcttggggctagaacatggatcaagtgtctgaagtttttcatgtggcctcaagttgaatcttggtcagagaatacacggtggtcaaacttcacaccatagtcataatgtatgaagccaaaagaaaagtcctagttgctgggtgcttccattatatcatcaacctgggtttaatgattttattggaagcacgacttccagtgaggcaaggcagtaagccccagaagagaggccttccatgggtagataggaactcaaatgctttcccaggctggacccaggagactgtgtcagctactgtgatatggcttgccaccaggacagatcattctacccgtctaaggagttagggtatccccaagagctgtgatgggaggtggaaattcacacctgtgaaatgggaggtatgctgagttgaacgggatagcccaaggcctgtccatgaactgagccatggccaaggatttcttaattctagaggcctccttcttgagcttgccttcttttgaacttggccctcagtgtctgggtaagttggagcgtgactatccagggaaagcccctggtttgtatttagtcaagttggccagagaagactggatctaagcgggaataaaatttgctgacccccatctcagaggttaacattttcatttgtgttttgcatgactcattttaaattacagtgctctacaagtatagaaagaagccttcctcttcccaccgtccccagacaccacataatggaaaaagcaagaattttctgcataagcaaggccttaaaaaaaaaaaagccagcctctgatgggacttctttcctgccagaaatcccactggtccactgtcgcaatttttacaaaaggccacgatgaaagagtaaggcccattttgagccctttgcttctgtattatgtgaaacataacttgtatttctgttcttggtatcagaagaattgttagtttttgaacatgtaaaatctactagggtctctgactgttaaagtataattttgattaagaaaagatttgttccactgctttgattagacacataaaactttgaaaagttttgatgttctgtttcctgttttaaaaaaatatgtcctctcctatgaactctaactagatgagaggattttcctcagagaaaattcagccctgggaagaaccatctatggaggtcataacctagaaaattcttcaagggaagttgcagtgaattaaaagagggcggagttagaaagtcctgttctaccaaatttgtgctaatagttgcacctttctttctttcccagaatggtcactggagaaaatgtgtaaaccaactgcaaacaagtttatccgttgccacctttcttttcctttagtgacagttcaattcgttaacctgaaggagctactgtaccatcaagactagctcccagcccagggcttcagcataaagcagctgctcagttaattttggtggatcacgggcagaaacaagttacctttgggatgcagattctgaatagtctgccatgaaatgattaaatgaatgagagtgatgaggggctacttaattggactatgtaaaatggctccttaagcttcgtggacaattgagtaatttcagtttcctctcttcactcttgtttacttcctgctcttctagcatcaagtgttaggtattctgttctcttacaatgagaagattaaacagctgtagtttaaattaaagcattaatttggagtgttctgtggctacattaattatattttctactaagattaaattgcagatggatataagcagcaatatatgtttatccagggcaaaccagaattctgttaaccagccatccttggtgactttttatttatatataaaaacctttttaaactgaaataatgtaacttgatttttccccccagttaggtagaagaaaaaataattggatgcagaaaacagttgtatggagcgtatttgcataggtacaggacttgagtgacagaaaattccttttatttttttccccagtgggatttagcaaaaagcatgtgttgaaagtctcttgactaaatgggtcataattaaagactttgggatttatttatgggtattttaattagaaacattaagttcactcagtggtccttgtgaaaacttttttctaactgcttattttatatcaagtaataaataaaatttctgtgggtatgaagatgagttttagggctgcctatttctctaggactgccccccccccccccccccgccgccgcttcagagagcttttctctttctttcacctattaaacttctgctctggacctcaaaaaaaaaaaaagagttttagctgtaaccacattgtaattcgtgctgaatatatgaatgctgctgttcactgaatagttaactggttatatcccttgttaatttgaagttttcttccttcgttttggaatgatagttataaggcaacatgcattttagaaaaatgcacttgtttgaacttctcagatctaatgtgactctgtgggactagatgttaagaaaccatatctttaactgaacatcatctatgatattccatctcataacatgttccatgagttttatggacaatttctaagaaatccaaagtagcatgcagttttatcaacctctctgcatccccttggcacaaggaataatttttctgttattgaggggcaaaacagaggggtaaaggcactcatacagttaaatgccagattaagtcaggcatccaagtcactctgctttgggttgattctctgagactcagctggctgacttcaaaaggacgaaatagatttcaacattggaaaagaatacagtatagaatatatgatgggtcttgttagctatctcttattttctaatccaaagagcctcctagttggaggaaaaacttgaactacataagtatatcagcaaattttcattatattttataattctttattgcattatacgtgaatatatttagcagtggtagtacgtcttggaaagtttaagaatttagacaaatatgctttttttttaaaaaaaaatagttgagttttaaatatgctgtttgggtccttatgagcatgtgggagatatataggagaaagagtttgttgctgatgttatagaatcaccaatgcagcattgcacttttgttcttttccattcattgttcttgcttacatggagcacttgcaaataggctggacgtctcagagttctgaacaatgcccttggctaaccgttagtcctaattgctgtgactaatgtgctgtgtgacctaaagacggtaacatacttaaccttggttttctcatctgtaaaatagaattgatgacctctaccaagccaaggatttcagtgaggcactcaaaaataaaaattaaaaaatacatttgggacaaacatgaaaaaaattactttttagacttaagcaatgcatttaaacctgacgaaaatgaaaggaattgaaattgtttagccacagaaaataaagaccaaggaccaatttaaacagttgaaaattatatgaagcagtgttttatggagagtagtaatgaactcttcttcaccttttttgaggctgtccaaagaagaaatgaagttagattattgcagaattacataagttagtaagcatggactgaccagttctttctaagacacatacttgagtatttattctcttcagttgcaatgaaggtgacagtgaatttgctgaatagctgtgtacatgtttccccaaagagaccactggaataaagttttgtttcttgagacagtttccattgcatttataagtcttgtcccttgaaggatgttttctggtaaacacctgtattctttttacattatatatcttcattaccgtacaagtttggttgtgagccattccaaagtctttagtatgctgtatgggtgtattctatactttataccttatttggaagtcataataatgtcaaaaccatgcctagccatccccttccctgcagagtctcttttgctttgtccacttggtgtgtatattttttttttttttttttgagacagagttttactcgtcgcccaagccgcagtgcagtggcgcgatctcggctcgctgcaacttctgcctcccgggcccaagcgattctcctgccttagccccccaggtagctgagattaccggtgcccgccaccacgcccagctaatttttgtatttttagtagagacagggtttcaccatgttagccaggctggtctggaacgcctgacctcaaacggtccatccgcttcagcctcccaaagtgctgggattacaggcgtgagccaccgcgcccgtccatgtgtgtcttttttattttttgttttttgagacggagtctcgctctgtcgcccaggctggagtgcagtggtgcgatcttggctcactgcaagctccgcctcccgggttcacgccattctcctgcctcagcctcccgagtagctgggactgcaggcgcctgccaccacgttgtgtgtctttttaaaagatttccaggacttctttttcctttacaaatccaaaattgcagtagcttaataaataacaaatattttggttttatgattactgtcaaatagctcattagtaagagaaaaaaaaaatgctgagccttaagaggggagaggaaaggcagtctttctgaagctgaatcctttgcctaaattgtcttagcaataaatcttgccacctattggtaaaaaggaagaactaaaactaaaaggtgtttgccgttctcacaggtagttagtagtgtgatcgaaatagaattctttcagcggtgcttttggataaggggcttggaaatatgtgatttgatatggaacttttccctgtgctttgaatttatcatggctcatctctaagtcataatagttttttgagtagaggaggtatgctgctctcatggtctctcttaaaattatattttttgagatagaattccattttaatagatcagtggattttaattggacacattttagaggcttgattgattttgaaaacatttttcttttttctttctttctgtctttctgcctttctttccaccacggctaactgcagtctgaacctcctgtgctcagttgatcctcccgcctcagcctcctgagtagctgggactacaggcgtgcgccaccatgcctggctaatttttctgtagagatggggtttcaccatgttgcctaggctggtctcaagtgatctgtctgcctcagcctcctaaagggctaaaattataggtgtgagccactgcacgtggccttttttttttttttttcttgagacagggtcttcctctgtcactcaggctggagtatagtggcatcaacatggctcactgtagccttgacatcttggggtcacctgatcctcctacctcagcctctggtgtagctgggactacaggctgaaaacatttttctaactctgttgttagtttgggctttccttcattccagcctctgaaatccattatttcctgcccaacgggacaggccagtggtgacgttggcctttggtgccagggcctgtttttccagatcatgggcaccatacaaagataactgccctaaacggcatcattgccccagagtcattgaatgtccttaaggtgcatttgataaaacaaaaacagttttttgttttgaaaattctcaagtatttccatactgggaaaatgttctttttttttttttgacagggtcttgctctgctgcccaggctggagtgcagtggcgggatctcaattcactgcaacctctgcatcctgggttcaagcaattctcctgcctcagctgggaccaccggcacatgccactaagcccggctaatttttgtatttttagtagagatggggttttgccatgttggccagactggtcttgaactcttgacctcaagagtgacccatctgcctcggcctccgagagtgctgggattacaggcatgagccaccatgcctggccaacaatgttctttttaatggtgttttccccactatctggatagatatatgaattcagttactaagatgacttagatttaaatataaaacactagcatagcagtttttgattcttaatattatcttaaatccacctcccctcattgtcctctgtatctaaacacccttcaattcttgagaaaattaagattaccaaagattagtaatctatttgtgattgtgtgtgttggtggacatcctaacaaatttatgaataaagccaatactgttttgttagtgtccttattttttctttacgtctgttcatatttggaattctaaggcactacccagataatcatttgataccctttgttggcatgacatgtttggtcaattgttttggcaaaattatttatccaccactgggaactaagcactgtaacaactaaagaaagaggtcatacaagggaaattggaagaactatatgttatttgtttcaatttttatgtagtacacctatatatgtgtgcaaaaaaaatgtaaactgttacaaagcaacatattgatgaatttaaatgagtagagcataataaaagcaaaaaccaaacagaagagtggttggagtgaggccataataaaccaagagatattttctgaaggaagtgaacatgtttgcattttccagcatactgctatggatgtcagcgttaggctaatacatagtattgcagcgtgattcaaaaaggtgagatagaggggaaataagatagcttcataaatattaccaaggaatttaagacatgagcattttatgtagggaggttgaaatgcattgttataatcaggctgtgtaatttccttctgtcaagacctacccatttaccagtaatgataccttctttctcttctatttttgtctcttcctttaggaaaaggaatatatgcttactcattatttaaaattcagagtcattttcctgttccagttggttttgttcctggaaccaccaaagaagagtagaattaggtgcatgtgaaacttttgtttctgctttttctactcaatcaacttttatccctttttaatttttactctctcaaccatcagttctatatcatggtatctcttcttggtctttttgtattatatttccataaaaccagatgtacggggttgttaaaatactgcctggacatattatctaccctgcactaagtggtcctatcacaaaatccagttaaacacacattgaagtatttaaattgtttcttttttaaataacatcatattgggcattggacttcttaactaaactatttctttcactaaatgacattggttaattcaacaagccattgtaggaattctgttaacccagtagcttctactactatgttactatggtaatgacttagcttcccataaagctgcatttaaataggtgtttatagtcaccaattaccaggtatttcaagtactctttgaaaggggactgcttgtggtggggtggggggcgttaacatagatactttctcagtcacgtagccatttgaagtttttcaggtagaagacagttgatagactatttggtgagcaaatgaataactggatgaatacccatctgggaacccctaaagaactgaagatagttccctggccaccactgttcacagtcatctattatgtgcttactctatgccaagtgttgggctggattctggggtcaccaaagggaagagaaaattttcactgccttgagggtagctaaaaacttaatggagggaagctgagagcatgagcgagcgtgccaccccagctgggtgagcggcacaccttgggaacagctgggagacccccagtggtgtgtgtcttccttcgcccttagcacttgctcctctccagctcactatgtttcttttctctctggggtctaaggagcttaggcttcactgcctgctcctcagattgtgggagcaggagcagagagtgggtgcctgccacgggacagggggtcctagagacaggccccagcatgggaaggcagtggaaacccatgcattgctctctggcattgccacacgtcttctgctgcctgccttccagccctttgcttttccccagctccgtcagctccttgcctctgacatcagtgatgaaagtcaggcgtggggggattagattatttccattggccttgatagacttagacatataatagaagctatgataagtgagttagttttccatgtttgtttactgaagtttatattaccctttatgtcaccaaaacatgcccgtttgcagtcattgccagtgtagtcatgcaaaatcacttgagtgaaatagactttggggatctaatctcaggacctaaccaccatttataaagcttttttggggaaaatgtgttctggatttcgcacagccagcttacaaatgagctttggaaacacaatccacatgtaagttggagacttcctattattagcattcagccctgcgaggagagcccttgctttgttagcaggcctatgtgtcctcagccctaagttcctaaaaccagcactacttgaggagcttgaattggtgctcttggagttctttagattagttatgagacttcagaacctgcttaccagcagtactgagctcaagaggaagcctaattcatatccttcagaagataattttaagagagtgtgtatgttttcgttttgtgaacaaaggaaagttaatctggtgctccgtgtctgttttgtaattccccaagggagaaggaaagggagggaaatgattgatttccagataggataaaaaccagtcagcacacaatgggttactgccaccgctttctgataaggatcctacttcaactatctgaagagattcttcaaggtggaggatacagtggttatattagttactctcacccttgttattatggaaggtaaaattcctggatcctagatttaattttaaaatagtaatttaataatgtctggtggaaacctcttaaaaaaaacactttgcagcacatctctggtagccctgtgcttgagatgacttttaggctgccagttcagaagatggaagatataaactgtgttgatgagttggtttttcagtggaccctgttaggttccttttttaaaaaaataataatttttataatgagtatgtcttcgtgagccctcacaacccttgaagtttttacttgtttggcagaactaagggcactgaacgtttgtaagccgttcactaacacttacaggaagggcataaaagggtgctcaagtcagtctgtaggtggtgggggcggggtggaaagaggggattcctgtaggcctggatgaatcagccactgatttctgatggtagccccagctgcaaaaaagtaggaagctttttttatggacagaactacaactcctttctttcaagtttttcagccttttcacacttttccattcttcagactttgcaagtttttaaacaaaatgtttgtatttccccaaaggaaatcacacagttgactgcattatgagagggaaaggagcaaactctgtctcatctgaggaggggctcagatcaggagttgtgtagggccctcacccggttgggggtggtggagccttggctgtgtgcaggagtgactgttcttggagatgttctggttggatcatgagtttgggcttggaaagcactgcctcaagttcatcagcaggaatgaggtagaattcactacttgctgtcttaagacctttctgtctgccaagtgtttgagcaatccctcacatctcccccttgaactaaagagcaacaactggtcaagagcccagcagggatgaaaaaggttggccccttgcatccttcatctgctgtttagactaagggccgcattgtagaccactctcggccatgctgtcctgaacccgaggatcagcagaattacaggcccaatttcaggcagacgtgagcttgcatctgatgacaggcaagtacctacatgtgtctttcattactccgctgccttaggagatgctgtttaagttggcagatatgcttatttgaaagcaaagcttgttgctggtgagattactgaatttacaaaaaaaaaaaaagtggggggatcagatgccaagggagagggaagggagtgtgtagcatttaaaagtgtggtgaagccatcaagttaacaagaaaaagtagaataaaatgtggttccaatttgttgtactgggctcaagatgataatattgcaatagtaaactgtagggatgtgtgcgtgcaaatgtgattacatgtgtgcttgctttctgaatttcaaaattgtagaagttattagaagttttaattttagttcccaatttaatttactctgatagtaaattagtaattttcaagggatttactgataatcagaacaaagatttgcaatttctaggacagatccccaattttgggggtgggaaggagctactttgtatttccctgaaaccttgagttactggggccgaacatgtagggcagatattgaatgaccaatcctaatgctcttagcaactttgctaagtaaaaccccgctgccatccagtggcaattggctatacggcatggtagctgtaaaatatgcccttttctgccttttctccctcagattccacctttctcagatgctcccagttttttttcccagatggcacctgacacagtacttgacaggaaaaattgactttatgtctggcttaggtaattcagggcaagtgtgcatttatttaccttgtctcttctcctagcaatactaatttttatctacgttgcatttttattttctccccagatttgtcataacacacatactttttccttgaatatttttgttaccttagctaaagaattaatgcattgtggtatttctgcttgtcatagttttactttagagtagatttcgcttatatctttgtatttatgctttgagctgtggtttaccaatttcctagcatgtttcatgacacttatcctacatttcagacaaggatttatgtgtcccataggattcaagctggacttggagaaagagccagctagcaaatggaattattctgacttgtgaaaggttccagccttttaaaactaggctctgagaaataaaaaaacaaatattcttgggaagaaactgggtttgtgagtacttggctagaaattttaggaaaggaaagaacatttcctctggcctcgggagcacattcaatgtgaaatattgctgcctttaaaagagccaaacttaaatttctatttggatcatttacttgacttaaaaataaagggatctatttttttttaaggttcagaaccctattttaaataaaatgacattctagtaagtcaggcaagatgcccccaacatgagctattaattaaaaacagccggaacttctggaggtgttagcaagtatctactatgagcttggggattggcgaaatctggtacaagttagttccagctgcgcacatttgccttattacagttctttatgataaattaaatgcatgcttcatacatcctttggtgtagtcatattctctcagcacttgactaagcaggtggaaagcttatttagtcataggatgactgaaaacaatgaactataaacccatgtatatccactccaagaaaagagctaataaatgtcatgttttttattttcccgtggaccccctttttttttttttttttgtattttataacctttccagaatcttgagtgatttttaaatgtttgccctttggtcataaatgcagcaagtaaatgtgagtctgcacactcgaatgttatataaatcagttgaccagtcagtgttggagcaaacttctcaggattgctctgtgaactccctgttctctggcagttgccaaatacaaagataaaccaggagagacttattcccaagaaaagaatgattctgcatccttaacttacatataaactgttgagatgtttcattgttttgtatggtcaagccccttctcttgttctctctcttcatcaattagtatggaaaattggaagtttactgaaaagagtttcgaatcatgggattttagatttgaaaaggaccagagggatcatctactcttccaacaaataaaaaataaaacccccaaaggaatgaatgatccatggctgggacattggaatctctctataaaggagaaatcatattaaggtattttcatcttaggcctctaaccccaagggtatctttacaaagactttattttagtgaagccttcaataaacagtgacctcatgtcaagaattctaaagagagggttatggaatattggtttgatattaaagtcattgttatcttggagctggcctgaatggactaataagtggcctgtcaccagttgtaacttacttttacaattttaatgtgatttaagggaagacactcttggaaatgcttagttatggttcatacccataatcgtgtttcttttaggtcttaaaattttatataatacaggggagtagattgcatcagtacagtctttttctttttttctttttttttttatgatgcaaacaaagcagtatcttaaattaaatcaaggtttcttaaggttccagattcttattcctaaattttccactgagtaacctccaaattcttctcctgcctttgtccctagttgacacaagtcaggccacaattttttttctgcaaatggacgagctgctgctcagaggctgcacttactggtgagagatccttcaagggaaatgaatctggaatggcctggaacatttgtctttgggttgctccagggctttattagagcttctgagatttctaagtaggtgatgaaatttagcagcatctgattttctaaaatgaccaaaggagaattgtttcagtccctgatttgcaaagtactcactttttggtcctctcaaaatttttgtcagataaagatttttccgtgccatggatataagaaataacccactcttaccgataaagggaagttagtgttgtaaaggaacaaatggtgattcaggtttgggagactttggaggtattcattctccactaagctatatcccaataccatcattatctgggtcagcctccgattcagcctcatcctgtgcttcagcagtggggtaaaacaaatgtcacttgttagctgcttcttcatgaccttcatagactatgcattaatttgaagccctgcccccaaaaatagtgcttgggggggaaatgagttagtgattttgtgaagataatgggagttgaggaaaacacttaagtttgcttttctgagctctagcttcattttacttctcagtctcagtatttaattgtctccactgttttttctaacttggaaggaaatcagatggcgaaagtgaaacatacggctatcaatgtgaaaaagctgctccctatagcactggaattctcttgtcattaatagctcttgtagtcgacagattataatatacagagtcataaatgttcttgttgtcatttggaaaattacaaattcccaaaaagtggtgattatttggggctttgggtctgcaagacgtttcacattaaaatgctgataatatcttcaaaaaccacagagccatgggccttgcaggcttggtaactgactgcctttgtggtgtggttttattctttctactgaagcacctggttgaaaggagtgggatgctgaattcataggggcgtgttcacaaaaatctttaacatcaagtatctgtttattcaaaatagtgcatagttcaaagcaaccttgattccttaaactagatgtttttctgttctttaatgaaaacagcctgaacgtggttattaatctgagtctttctccattctgaccaccccactctgtttttctctttgaatatcaaaaaaaaagtataaaaacattttgtaattttttatttatttatttttgttgagacggagtctcgctctgtcgcacagggtggagtgcaatggcgcagtctcggctcactgcaagctccacctctcaggttcacaccattctcctgcctcagccttccgagtagctgggactacaggtgcccgccaccacgcccagctaatctttttgtatttttagtagagacagggtttcaccgtgttcaccaggagggtctcgatctcctgaccttgtgatccgcccgcctcggcctcccaaagtgctgggattacaggtgtgagccaccgcacccagcaacattttgtaattttttaaagggctacataaattcaaggtattattgctgtacttcttttctgttaccttatgaagttgattgttgttgaagcaccaacagtatgcatacatgggtatccagaatgaccatctagtctcagttgtgcaaaattcactatgtagtctcatggattgagaggggcaattagcaagagtgtgagataatggagaacaaaaaataatgccaagctgggttaaaaaaaaaaaagtttgggaaagaaaaaacaagtgctcaagacaagcctcctatttttcagtttggcctagccctagccctattgaagaaggttagtacattcacctggccagttttagctaacttggttacctggcaagtggcggggatgcagtacattagtacttgtcctgtggtacagagcatgtgtctcagggtgtggccactccagggagagggaagacgtgctttatggggcctcctcagccatcactgtgatatgtgccaccaggaacccaggacctttcatggtccagtctgaggtgggagcaccacagaagcaagagctgcctggcccagccaagcccagattaccctaaaatcttactgcttttttcccttcagcattttaaattataggagcaagtaaaagtgtacataacgcaaggcaatctgaacaggtggctgatagctgctccatccagaggaagagccatgaagttcccccgacccacacatttcaccctgtcttgtctaccaaaaatcacatgaaaatgcagacataaccatggaggagtaacccatgaacaaagggctggtaattacagtttaatgctgttctttttacccctttggctggctggctgtgcaaaggcaggccccggtaattacggtttaatgttgttctttttacccctttggctggctggctgtgcaaaggcaggccccacaggggagtaatgtatttgtgacagccagttggggtggggagagatgggctgtactacactttgaatttattatgttctgctaatacttttactcctatgctggaaagttatgttttccttcctttgttagacaatttttgcagagtagtttaacattttcaaacatttactatatatagcacttttaaaatccaggaactgtcatttccaaagaagattccatgtctataatattaattccctgtcctctcctcattgcctttttcagacatccactgtagatagcctctgttccccaggaactaacatttccaaaggaaactcccttgcctataattccctgttatcttcttgttgcctctcctgaataataatttttgattcagtaccttttagctatttataatgttatcgtataatctgagtttgggaactgcttgccacttccagtttctgacacccaaaacacattttatgcttagagaaaacaatagcaccctgactttttagaagacatagtttttccttggggatccaaactggaagcagatatttgagctgtgaacacattttttcttagaagagtcaattaggagctgggttgaagcttcagtctatgcacttagagtcaggttttaggaccaagagcaagcactgtgggcacctgttgtaagaaaacatctgacagcacgaggtgctaaattgcttcaaaatcctccgtagctcgtggggatgctacctttttagtaggagtttgaagcccagaatgcactttatattataaccaacacagttgaaaaataggttccatgttctataagaatggattcattaaactgcatgttctggaaaaaggatgtattagagactttgaatttgaggatcctgtgttatatacatctctgagccatcttatcaggaagaaaagcagctccttaaggtgcctgcctcttcctctaatactatgtacatatttcgacctctgccctctttaagttattttcatttgtcttgtagccagtatcagacatgttaatgaccactaactttgtaaatgaaattattgcagctcataatgtcaagatgtgaacctaagcaggccttaggttttctgacttaatagccgaaccataccagtctttccctgatcattgaaccttctgtcttctgcagtcagcagaccgtctctaatgagaggtgcacagacacttttgatgcttattttaagggaagccagtggcagatggagagccatcagatgaaactgttattaatcacaccatttctgaagctgttctgactccacaccctgcattgtgacaaacgccaggatgccaagttcctagtattgcagcaggttcttagtacataacaaacactatcagtgcccccagctcaacttcgactaaatgccttccaatagagttaagctgtttttatctaatacatgctaacagtaaaaggacacagaccctcttatttgaccctcttagcatctaaggaatatgatactttttttctttatacttagctgtgtattcaaagctaacacattctctaagtaaccaagttcacactaaagaaaaattgaaggccatcctctaaagccatgctgctcagtgtaggagccaccagccacatggtcaaagccacacagagccactgaaaggtggctgctataaattgagatgtgttatgagcataaaacaagagagaaatgaagactatctgcttaataatttttatattgattatatgttgattatattttggatatgtggggttaaataaaagattaaatttcaccttttgtttttgcttgtgatgtggctactagaaaatgtaaaattacatgtgtggcttacagcgagaccccactatttacagggcactgaaagtcattcttcctcttaattcctcatctaaactctactcattgactattttgtgtatctgcatcttttcttccaaaatgaatgatcagctgctagaaggcatgactatggaaacagtgtatcttctactgtgatttttcaagagtgaggaagtttggctatcaccatgggcgtgaggagaggggttctgttctcatttggtaaacatacaccagatatgctaaacatcccatagaatatcttagacaaagaaaattacagtaagtagagaaatggatcaaagagtggctattcttggactctctactttccaggtctttttggctagagaactctttttctaactttgttgcctggctcttggcagtcaatgtccaaagtagtgcattgagctgccccccaaaaggggcacagtttgtaaggaaaccatatgccctatgggacctcatgggatgacactcagttagtacataaggatctcttggaagggagctgcctttatgtcctctaaaccaggtcatctcttatcagttaaatcctggtgctgactagtacagctatatgagcctggacaaatcacttctgagcctgtttttcctctctgtacaatgacaatgatgatagaacctttcttataatgttatgaaagattatattttctgagataattttagtaaagcaacgtagcatagagcctgatacatgttaagtacgttgtgtatattggccatgattattattggcttcttggtaatgaaagcatcaaatactaagggcagcttttagtatattatttctgatcttgtgtgatcagaaataccacatttttgagaatgtattattttccaaagaattaaatgactctcagaggggaatggataaacccacagaggttctggaaatggagcagtttcctgtaagtatcatgacttccaattaagcccctttgtctgttttatccctgtcacttgtactcactgtgtagatcatgagctaattttgcttggactctcccctcccgccatctcttagagcccagcagtgctatgcatgcatgggttaaaaatttcaaactgtccaaatgaattgcatttattggcaatttaatgctgaaactcaaagagggaaaagaggagaaaaaaaatcaaagatgaagtggaaagacaagggcccttggatgcagccggacagaggttgtaatatctgctctgccaaacactagttaagtgatcttggtgtagtcaccaaacctcttgagtctctttcccacatacaaaatgaggttgatgtgtttcacaaggctgttatcatgactcaaggaaataacctaaatgactagggcagtgacagttcacctctctctcttcatattgctctcaatttcatgatcttcttctccccgcaaccccatgatttatagaagccaaattacgttctctgatttatagctgttgtaactttggaatacatttaagaacatggaattagttgtcttttgttagatccacatacagaagtcacagaaatgttttcatcattttgaattttactgttcattctggcaaagtgaaaatgtataccaaaacactattttaaaccacctatcccctgggttagaaattataagttagtgtagcccagtgaagtataattaaatgttgccattctcccatttatttaacttccttccctccatatttgaagtaattttcgcttggtgccaactccagtcattctccagatgcctgtgatttcttccagattttcaacacacagtggctaaagataatatagaattattttttaagtaatttgtgattaaatgtaaatttagtaattttatgttgggacatgtgatctccttgacattttctccaaaacacagaatttaagcactagaaatgattttaggacatctagttaaaccattaccacttcactgttatgacagtgaggcctggagacattaaatgttttgcccaaagttaccaacatgttgttggcagaaaaatctggaacatatggcctcatctattgtctaaattttttctactagtgcacagtgccttttcaattgctttttatttgataatagtgacaatcataaataggggatttaatcaatactcttttaaaaaaaaaagtcacagaaagaaagcaattgtattgaaaacccctttctagtttttccagtaggttacattaaatggccccaaaaagtaatttatgggctaaaatgaatgtcttcagaaggctaacataaaagatgaccaacagggggaaacctgaaacagccttttaggtaatttgcttaacttctagcccttttaaaaaaattactcaagctcatgttagagccaacaaaaaacatctgttgttttatttatagccacaatttctaagaagcatattctatagcagatgaaaaagtagttgacagcttataattcataaagttactgaggcctaatctgatagaacaaaatgtacaaactccctcccgtggttcagaccctatcccttccctttctgctgaagacagaaatggtgcaacagaggagtggagcataggttattacggttgttaaggaagaggcgactctgagatgataatgcagaaaggagtaccccgcagtgataaatgattgctttcacctctgggccatccaccagcctgagtcactgctactttttcattaacattgtatggactttcattataggaagccaacattttgctgtgttcaatctacagattgttaacagcgtatttccatcaggaatctaaagtgttaattaaaacgactgattgaatagttccctctctgagggaagcttttagtttgccccttcctttcaccagttagctctagtctatattgacataactttctccctgctgactcttaagcaattattagaattcactcattactcaaatatcacctctctgtatctgttggcttatttctgagaatcctttttgagaacatgaccaggcttctttctataatttttatatatatatatatatatatacacacacgcacacacacacatacactacatatatatgtatgtagaatacatatatatatctatatatgtacatatatatctatatgtatacatatatctatatatgtatacatatagatacatagatatatagatacatatctatataatgtatacatgtatacacatgtacctacatgtatacacatgtatctgcatgtatacacatgtatacacatgtagatgcatgtatacacatgtatacacatgtatctgcatgtatacacatgtagatacatgtagatgcatgtatacatatatacatgtagatgcatgtagatacatgtatacatatatacatgtagatgcatgtagatacatgtatacatatatacatgtagatgcatgtagatacatgtatacatatatacatgtagatgcatgtagatacatgtgtacatatatacatgtagatgcatgtagatacatgtgtacatatatacatgtagatgcatgtagatacatgtatacatgtagatacatgtagatacatgtatacatgtagatacatgtagatacatgtatacatatatacatgtagatacatgtagatacatgtatacatatatacatgtagatacatgtatacatatatacatgtagatacatgtatacatatatacatgtagatacatgtatacatatatacatgtagatacatgtagatacatgtatacatatatacatgtagatacatgtagatacatgtatacatatatacatgtagatacatgtatatagatacatacatagatatatagatacatagatacatatatttatatatgtacatatatctacatatatatctatatatacatatatctacatatatatctatatatatatatctacatatatatctatatatgtagaaatatatatatattctacattttagttctgctatatctatagggccttctgtatatcacagttttgtgtgttgttgttttttttaagtgcattggtttggcacaaataactatagtactatttattatcctgagcttttttgagaatgtagtgatagggttcaacatctgcccaaattgacccatctaaaattataattctaaaaccataaccagaagaagcccattaatttctttagtagagaggtgagtagcctcttgtttatttcactactgatcatagtctattgtgagatatgaagatgtattagcccaccagaattaatcacctttgtctgaagtagtgaaagtatattgcttcattttgttaaactctgattccttacacaattgttaaggattgtgtttacttttatctcaaaattgttaccttttaatatatatagtcttatatcagtgatcttttcaaacttttaaaatgaagtctgaataaatattattttcttatgcatttcttctgcaccagctgatagggaattttctgtacaatgttttcaggcctcttgcctttcttgcctttatttttctctgcaattccacacacaggtcattgctttcccttcctctccctttttgatcatggatgcttcaactcccttcatatatttgttaagcatattttactaagatttcattttgtgatgcttgcaaatatacattacaaaatatatatttttaaaaagtgatttgaagggccctctgtccatctgatgattaactagaagagtcttttgtaccttgctaaaagtgataagttagccagctatatttagctggataaaacccattacatccttggggaagaatgtgctttgtttagctttatgagaaaatatttaataaatgctgtcttgaaaatatttagcctggctgagtgagctggcaaggcttcaatactgataaagcagaggtgatggtgaaaagctggcctgccagtccaagctcaagttaaaaaaatgcacctcttgtcactaagggttgcaactgtcgccaagtgcttgtccatcagtgtcacgtaaagattttttaacctcacatatggcatcatgcagtttgtctgcctaaaaaggcaacctagattcacagagtggttacaattggctttgaagtcccatctgttctgtaaaatcctagctttatttcttactgctggtatgactttaggtaacttgtttaatttttcttaatctcagttttctcatctgtaaaatggggacagtgataatttcttagagcgttgtacagattaaatgagattaaacgctgagcagagtttcttacactaagtgttcactacatgggaattaatcagcagtagtagtgatttgtaatcagcctaacattttctgtccctccctaactcctcccaccccacaggagatacaaagagcaaagtcctcttgaatgtggcgaggtaggaaaggctctggcatgggcatcaggaggcctgggtcctcggcttgaacttcctgtgggaccttgggcaagttgtggctcacataatccctccccactcatcagtacacagtgcacagggcagcagagctcctggctgctagtctctcttttgatacctaattcgttgtggtatcagaccaaatttgatatgatagctagaccctccggtccgtcagtatcatttggggtctggtgtaagatcagcctgtgaaactcaggcatgtaggcaacaagttatcagtaagaaggtcaatcattgggattctgtctcccacaatggtctggattttctctctgtggctggtgggctcagccccaatccttgctactcaaagtgtgattgtggtccgaggaccggcagcatgggcatcacctgggagcctgttggaaatgcagaatcccagactgcaccccgacctcctgaatcaggctgttaatatgtacattaaagttggggaaccactgcctcaaacttactgcccttgggaatattctgacacgcagagggtatttatttactaaatacttacagaatttgtgtttgacattgacattttctagacaaggttccattcctctctttgggtgtagtgtactgatgtgttaggtcagggttaccatcagactggtgtttatgtctgtaccaccatagacatttagaaatctatttctcacagggtgccagtgtggttgggttctggtgagggccttctccctagcctccaggctgccaccttgtcactgtgatctcacatgggaagggtggggagaaaggtctctggtgctgcttcttataaaggcactaatcccatcgtgagagcacttgccctcatgacttcctgtaaactcagctgcctcccaaaggcccatctccaaatattatcacattgagggtcagggcgtcaacatgaatctggggggaagggacacaattcagtctgtagcaactgacttccacatctgactttaaaatgcatctttaaaaaaaatgtgctggcagataaatatgtaaataaagcaaatatgaaaatgttaatcgtagaatctaggtgaaagataatgtgggcgttcactaaacaattctttcaacttttcaggatatttaaaaatgtcagagaaaaaaccccctactctctatagttatttaaaaggaatctggtgctgcttttttctccttatttccatccaggctttcttaagagtgcttgttcggtctggctggacaaacttgcctttttggcagtttctctctctctacccactcactttctccttggtcagccagtggcctgcttctgcactgtcagtgaggtcccagcctggatccaaagcttctttctggtctctagtctgccagtagcatctttctgtccagttcctctccatccccctgccctctcctaatactaatcaggggatccttcaattgcttgtgacatcgcagcttctcaagttacattttacaactctgctttattatttttaagcatttctaacatgacattttataagtttgactctgaaatttatcatcacatgtaagtaggaaagaagtgtctccacaagtttgccctcagccagagatagtgtggttcatctggaatgcccctgcctttctctggttattaataggggctcctattgcttttccatttacagtgttaattatctgcatttcaaagtagttcataatgagagggaatatattaacttgttatttggggaggaagtacaaaaactgctattatcaagatcatttaacttgagcataatcagaaagtattaaggttattcccttgtgggattgaccatcagatatctgtgtgtttcataacacccttattacagataccttttaaagaagcgaggcttgcaggaagtgttgggaaacttactataagcttctttccttgactggcacttgtatactctggcgcagggaagacaagcccaaactaaatacataggcattacttaagagctttgtgacattggacaaatagtttccttgcctttaaactggggataatagagactatacacctttgaactgctatgaaaaataaatgaaaatatttctgtaaaatacttactgtgggaatgtggctcctagttgatgttcagtactaatcattcattcagcaaacagcctaccgcccactgtgtgtcatggcctgtgatttgtcttttttctttttgggggcttctgggtcatacttcgtatgaaatctttcttagcacaccgaaagaccaactttccttataaatcattggcttcaaaaatcctgtggactcaggtataaattatttttctggtgaggagaggaggaagtccctttcttccccatttacatcctgcctagctattttaatttgctgtacaccgtaaattgtaatcttagaatcaaactccaatttaggtgataaggatcacaattaattaggctagcctgtcaaagattaaatgtaatcttgcatttcagttacctcctaactctgaggctttagctaagcccgtcagaaacaaagctgttaggtctgcttaggtttaataagatctttgcctgctgtttgttttctataccagtctgttgtctagaaataaaacgaatggacagaggatctcaattccctttcatttgtttttagctgtgcagcaggagagataaatgagagaagataaacttaacgatattaaagactaattaggatatctgaggagatttgcaaacttctagtttaaatctgtcggcaactcttttaattccctcctgctagttatctctgaaaataatgtagttatggctgaagatttatttccacatctactctttgtactctcattttcagttgcgcatactttttttctccttcttcctccaaaaaaaaaagctcttgtttcggccacactcaatataatttagcacacagtcattccaacttcattttgtcttcacattcagaaaactgaagtctaatatctcaaatatattagtattgtggtccttttggggaaagtatgataaattgaaaatattttggttttgacttctgaagattttgagtattgtttatatatacaaaggcaaaatgcaaatatatacaaggcaaaatgcaaatgtgcttccagcttgcttccttagaaaagtattgagaacagtctaagtatgataatttctggtcttaaaacctgcaattgcaatcgggtatttccataatctaaacaataataaagattacatgactaattctaacaataataactacctattagtttgtgctttctacatactgggcacgatgcctgtcatgtttatatatatatattatttaatccttattactgcacataattactcccattttacagatgaataaatgggattcaagttaactaacttgcccaagactactgaattcagtaagtggcaaagcaaggattaaaacctaagcctctttggctttaaagctctgcttctaatcacttttttactactgattaaacagatgtgtcccaaaattaaggaagtcatcgttgttttttttgctttgtttttgcttagtcaaagagcacaggccatcatttgttgtagtgtcacccgtaaagcttaataagtttaaagttcagggtgttaatcattacaagcataaagtatgaatatgctttaaaggtttatttaagaaaagaattgggattagatttgcccaccagaatatacatttttcacttgaagtcctgagagagattcagacagaaacagctttgactcagcagcagttagcagacaaacatcttgatataatactgatccacactttgcatatacactttcttttctttgtattacatttttagaggtaagtggcagtttttcacacacttccaaactgcttccatcagtaatgaaatatttggcttgggcagcctctggagtcccagtgtttcagcttaaactttccagtgggccctgccaggcactaacttcaaaatatctttttttatggtgaatgcctccagaaggtgcaactgtgtggtggtttcattttgcacttcataacggtgttggcatcacttaatgcaaagaatgccactgtctcccacacaccgctggtgcccaaggactgtcgaggcctgtccatgttagtggtttgggaagggctgaagtttggagagaaggctctttttctattccatgtgattggctgtcaccagggcaaagggggaaaactagaacgagtggaaaatgcagcatcggatgtgtcatcaaatattcttcctacaacctgggacacctagttcattggtgttctggtcaacattgaaggctgaatcctcctttcttttgaaataatgcgtgtcttggattcactacttttaaacctttctgctgatctttatccttttcttcctaagcaatactgatttctttcaatgaaaaatgatttagctagtgaaaaactgggattgggttgtagtaaaggaatcaacaaatttgcccagattcttaagagtggagttggttctccacacttatacactgtgctacagcaagcttcacaaccaaaacccattacttattcaggtataaaaatcaaaagctgaactgtaatgagaatttaaatgtaaactgttggaggatggtgctctgttaatttgtgtttgctccataccccaccctatataattgataatatttgcatctttttgtttttagtactattattttttggtttatcaaactttgtaacatggtgctttattgtggacttttcaaagaacaccttgccaaatttggtaattcctagcaattgtcatttcctgttggaatttcttaaagtggaatctaatggaaaagtaattcttgaccttgtgtatttagtaaaattaaaggcatagttgattttaggattgtcataaaaattaatattttgttttaaaagactttttagactttcaatgctaattgatcctattgttggaagtagatgatataaactttaaagctttttgggtagaactttcacattcaccatgtctaaatattttaaagaggaaatggattgactcgcagacattttgtactaaggaatagaaaatctttgaattgctatttaaaaaaaaaaaatccctgtaaaatttaccattttaaactccagttgcaaaatcctgatcagctatgatgattcatacatttgagcgataaagcttttttcaatattacaaattcagtggggagtcactcaatacattacaaaaagagtacttacacttcctagtacccatgtgtatttttttttctttttaaagcaatctggtgtgccttttgagaaaagttccagtgttctcacagatcctgacttggtgtagcacagtgcttttcagaaacttggtccaacacctgaatgagtaatgtgtaaaacatataatgttttgtagctcaggatactgcaggtaaactaacactttttgccgaaaaaacattgaaaagacaaaggaaagcaaggaagttttgcttttttaaaaaattttttcaagcttaatgaagaaagagctggaaatccttttgtatggagcatttgccagcccagcaatataacaacttttgggtgcatatttcaatcacaattagatgaaatctttaattatcatttaatttgactttcatatttgcctgcagaaatgattgtgttgataagactctggaatgagacaaacctttattaagtaattccattttcagagccaacattaaagttttttttaattaaaaaaatgcctgtgtaatttatgagaaaaggggaagaggaattggcatgttggttgcatgagagttgcatggatatgtatttactatttaatctttagctttttgagatttggggtgtgctaagtcttgttagtttgaggggcctaaggagtgacacaataatggatcttaataaataacacttttctacatcatttctctacctttatatttcccttctattatatatgctgacaggatgatatttcattgtattcagtgtagaaggtgtttgtgagagaggatacttttgtgagttgatattaaggcaaagggaagtggtttataatttatcagaggaaatgaaatggtgtgctctttcattttataatatttcttttaaaattttataatgcttttaattggactgtgaaacctttaagacatttgtatttgaagtgcttttcagatatatttacattttaacatacagggatttgagagatgtcattgctggattttttcataggatcacccacatgaattttcttatcaaaagagtatgtcctaaagcttatttctaaccccaaacaggttactagcccattcctggatgttccgattctgaagatttagggtggtacctgggaatcagtatttctagcacgtcctccaggtggtgcttagctctggcaagtgtgggagagaccagagagaggtgaagttcccacccagccctctgcacagtgactggaaagttaatggccagtcgtttgtgcttctatgaaacctaagatgtgttacagtgatgttgcagtaggacaaagtcactcaggaaatcgagtggtaaacattgcagggctttgagttcaaatattgattagctctatgttaagatgccttgtcttcagggatagctttagagtgggatctctaacacaaagctgactcgggaatctttcatctgccattgacaaaatttgcccttgtgcaggcaagtaagactatactctctaattttatgggcactagccacctatggttgtttccatttaaatcagttaaaataaaaaattcagttcttcactgggaatggctgcattttactcaataaccgctgtggctagtcattgctttatcagagagcacagctgtagaacatttccatcatcacagaaagctctaatagtgctactgtaggattttccctcataatatagctcttctctttttatcctgggtagttgcaatggctaatagaattaggtggaaagatcatgcatccatctatgtactgcacattgcatactgaaatctgaaagaatgtttttgcaaaatgacttaatcatacttctctgagatcaaaatttaataacattactttcataacgtgaatttgttctatgttgacttttagtacttgaaatacaggcttaattaaaaatttgttggccaggtgcagtggctcacacctgtaatcccagcattttgagagattgaggtgggtggattgcttgagtccatgagttcgagaccagcctgggcaatatggcaaaaccccgtctctactaaaaatatacaaaaaattagctgggagtgatgctgtgcactgtagtcgcagctactcaggaggctggggggggaggatcacatgaactcaggaagttgaggctgcagcgagccatgatcacgccactacactccagcctgggtgacagagcgagaccctgtctcaaaaaaaaaaaaaaaaaagaaaaaggaaatttgtttaccatagtatatggcttctaataaagagctatactggtaaaatctcacagaaacaaaattgcaaatatttagtctttctcagattatataaattattcctagaaaagactgcaagcaatgaggctaataaacaggttgtacttatattttcataatgactttaatttacctttattttgcagtttcacaaatttaagatgaatatatttagctccctcttctggcataatttgagaatttttttgcttacaatggtcttatttattttttttggactgagaataaggttatcaatgtaatgttgaagaatgttatttatgagtgtcatccagttagattttttggtatcattgtaaatggttaaaacgcatgcaaaaagtttacgaaaacaccacattttaaaaactactaattgaccaaaaaatacataaacaaaggctttgacaaagttatacagaaatttattttgatatcaagtgggcagtgatcattcatattggcttctggatctgagactcagcccatacctggcatttgtgaggcttggggcaagaatgcaaaaagaggcccaagtaccctgtgcctaagtatttttgttataaatcatgtcaactgttcaataaaatctgtcccatcctttctaggcagttatttcttcctaatgaccaggaggagagatctgaattcaggttcttgggctcctgagagttctgccctagagtgtggtattatggggagagctggatcctggttcatccctggcttctccctgcacatccaaactcccatccatcctgccactccccccacctttggggcccaggggtgtacctagacaggggggtttgtcctggggagggtggacctgggggaaaggccataagaggccatttagcaggaaatcctggagcattactctgagtagaccctaggtgagaagcagtgggcatatcactttggcctggaaagtgcaaaagcccagagcaggggttcttcttgctcgggcctgatgtaattaaattattttgtacgtccttcattgtggtctaatgcattcaactatccaaattaaatacaatggtgggattttgttgtttgcagctttgactctcccggatcttgcagagcagtttgcccctcctgacattgccccgcctcttcttatcaagctcgtggaagccattgaaaagaaaggtaaccagactgctagagggcatcagttcctttgttctacccttatttcatggctcttattatttgtctcttgtgcattcattaagtaaatttcctactaccagctatgtccagatactctgctggacactcaaactgtttggggctaagtactgggaaaaatgtctcggtctataatttctaactctagattatcatgtagtttccatatggaaactattaaattcttcataatttaataaatatgattaactttcttcttagaggccagatggttttgccaaaattatcaacatgccaggtaagattaatagtaggagttgacttccaagaatatttggtacacatctagaacagatactggatggaaactggaatgtctctggcagcagcctcacaggttctccagagagctgtgttttgcatacatggtctgtggtctgttttgtgtcctaggtctggaatgttcaactctatacagaacacagagctccagcaacctggcagaattacgacagcttcttgattgtggtgagtgtcacagagctagaaatgcaaatgggaaagacaggtcttggctttctgtttcaggtaatgcacacacacaaaattgaatttaatctatgcagtgttctaaatttaaagggaactcaaatcatgtacagttctccctgccctgttatggtaacagtgcaaacctttgaaatttttctcctgagttgggctgcaagtgtgtgcacgcctccctgcaggcatgttggtcatcatcatagccatcaggccctgggtcctgcagaggagagaaaccacctcttggtgtttctctcgctctgtgtatctaccatctttccttgaccctgaatttggctacatctaattcatctgaatcaattaaaaaatatttttaagcctatgtcacttaagaaatgtctcttctgacatcctttttcttttattacctttcccttccattttccttttccgtttccctttctttctggcttgccttctttctttttttgtgttgagtgcattaagtaacatcacgatattgttatgttcagtggtgtgctgataaaccaactctctaggaagaaaaaggccctggtttgtagcatctgcccatttttgtggcatgaatattcccaccggggcttatttcaagctaaccaacatgatgtcactggatgtggaattgggaagaattgaggacagtttgttaaataacactaattaatttagccaagagggctttagtaccccaaacacccactccctcctttggcatagatgaaaaactacaaatcaatttacttgccagcattccagcaagtcatcttcttataaatctttcaagatccttcattccctcataacgcttaaaaaaattatatactgcctcacatcattttaactgaaattaggtgtttaagccaaaaagagtgaaactcagttttggactccgtcagaggtataattgtacaaagaatgcccacatgacagtaaatgagaatttgaagcatgaggcagtttcaaaatgaggcaacttctgagacttttagaaaagaggtttttttggagaaaaggaggagactagacctttatcagtatcagtaaattcttacacttgaaatgttctgaccagatgtttcaaaagttaaaaaaatgtttaactccatttttcctttgtacatggaaatcagttgcatgcgaacagagcatatcctctttgctgctctgcctcctgcacttcccacagagcaggtcattagaagttaacatgcagaacactcaaggtgaaaaggcttgtttttcggtgtttctgacagctttatcagggctttaaggaaacgctgaattttgtccttagccaattgaaatgaagacacatgtttgggtcagaaaattggtcaaattatgaacacgtttagtcacaggaagagtttagacatcagagcccgatgaagtggaagttatttgagaaatagtggttaggtttataatgtgatcaacacaaaatgatgcagtttagttatttaaaaaaaaaaaaaaactcttcacaccactcgtgagatagagtcaacaaccaagattcacgtcaatggtacattttgaccaacaggtttccttccccagtgagatcaaaacacatagaaaactggtttcatttggagtctgtgctaaaaaaaagtgaaatttgtgccccaccccaaaaaatataaataaataaatgatgtccaaacttgggagtggatctgccagatctgtttccaactcaaagatttttcaatacataaaaacattgtataatatcctggaggaagctccaaaatagtcacttacacctaaaaaaaaaaattatggcttttaactaaccttgtgaattaccagtctttgaaaaggacagacatggcagacaatagcccacttttattagcacctgttatgctagttcatccatacattaactttgtgatgtatgtcctagtaactttaactcaccagaaaagaaagctgaccctcaggtaaataatttctttcacatttttcagtgccttagtggctaatttttctgactccaaaagtccttgatttttttctcttttttaattttgccctaaaatgaattgtttctttgtctcgtgcaagttttaatgattcagattttcacctgacagtttttggtttcatttaacctaattcaggctttcttagccttggtactattgacattttaggctggataattctttgctggaagagtgggagcttgtcccgtgcattgtgggaagcttagccacatccctaacctctacccatgaggtgccagcagcattctcccccagttgtgacaatcagaaatgtctccagacattgccagatggctcatggcagagggcaggatcccactcccactgggaaccactaacctagggagagacctaaggaagaggagactccattccagggggagggagggaggagtgaagggttggagagtttactgggtacctgtcatgagtagactcagtgaaaagtgaggtaggagagaatgcaaacacctccaacccagacctaaagattatgtagctcttcaaaagtcatcgcatgacaggtaggaatagctaatggaagagcacgttaggccagtttcaatgcagaaaaggattcttagagagcagaagtcagataaatagaacagactttgtcactagctctagtagaatttgacataaggtaaggttacccaaagacctgcataggataattttattcatatactatgaaagttcttttgatatacctcatgtgttggaaaagggctttgatgaattaacttcacttgtggattgagccttctagttcaatccacaaacatttaacacgttgtatgtgctggacactgagggatgccagaagagcaggtgacagccacagtccctgcccttgacgtacctcggtctagtagggaaacacataatcccacactatgattatactccttgggaagtgtcttgttagaggggtggctcattagcactgcagaagcacagagggaaaccctgcctgagggagggatgtgtgcatatttattatcttaacgtttatactgcatcaccaaatgttttatcacatattttaggataagcaaattcggtaatattaattttccgggcagagagacattagatgaaacatgcggggcaaagtgtatgggaaaccagaagcacggccaagagtggtgaccatagagaattcctatagcagcacacacacaattttatttgacagtatttaattatgctcacaattgcattaccttcaacgtagatcctttatgcagaggatctactacagtggtattgcccctcccacacttgttaaacatgtgatatgtctctggttggttgtttgtaggacatttaagtgatttaacacttcgcctcttcaccttttaaatttaataattcttttcctcaagttgacctatccatatcctattccagacctacttttcttagagctgtgtggttgtgtgactcactttcggaacgtcggcctacctagtggggcaagtttggtttatgatgatatgtccaaggaatttttgtagtcttaggctcaacctagaatgatttgtactgtcatatttcattcaaggttatctaggatactaccttctcccactcatttatactcaaacactttgcagtaaactttcatacttcctcattctctcctaggccacagcccaatgcagtcaatcaccgagttatatgaggtctcgataatattttgtacatttctaactgcattagaattcagacccccatcaccttgattcagagaactaaatctggtagttttacttctagcagcactcccttccaatttattcttaacactgtcattagtaaagctgttacaaacgtagtatcttgcccatcagcccacctttgctccactgagtacacaagtccccagattactttcctcaagttatccttcgcattgctagtgtacatccttcagcagcagccaaagtcctctccttttctagaggcccatggtcacccctgcccccagatctttgtttctagcatccctttcttctgctgggcattgtgtctttttccaacccaagtacttagagtgccatgcgtagtgagtgcctggagggtggtattgattagttttacccccattattggatcgcttgacctgtttcccagctgagggatttactggacaggtatgctcatcttattttctgagattgtctgatatccacaggttagattagtaatactcagacagaattagggagaaacattctaaaaatgttcaaattattttcatggatattcttgagattggttgctaaaagtctgtagtatcttactgttgaatccatcactctgttggtgacatttacatgaattctgagacatatcaactcaagtcttaggaaatctgggaatatgcatttttaaatttttcctgttgaggttttaggaaacatttactatatgactaaccattcctagttagaacccttttcagtcagggcagaaccaccctcagaggatgttaggaaatgtttgggttctgtattcgtttgctcaggcagttataacaagttaccacagactgcgtggcttaaaacgcagaaacttggccaggcacagtggctcacacctgtaatcccagcactttgggaggctgaggcgggtggatcacgaggtcaggagtttgagaccagcctgaccaacatgatgaaaccctgtctctactaaaaatacaaaaattagccaggcgtggtggtacacacctgtaatcccacctactcaggaggctgaggcaggagaatcgcttgaacccgggaggtgaaggttgcagtgagccgagatcacaccagagatgcactccagccttggcaacagagtgagactccatctcaaaaagcagaaacttacttctcgtggttctggaggctagaagtccgagaaaaaagcatgtttggtttcccctgaggcttctgtccttggcttgtagatggtcacctgctcactgcatcctcacagcgtttctcctctgtgcctgtgcatccctagtgtgtctctctctgtgtcctcatttcccctcctagaaggatatcagttacattggattagagtccactctaatggcctcattttaacttacatgcagtcactttctgaggcattaggagtttgggcttagaggggtgggacagaggatggggtaggtaaccactgaagatgcagcccaattcagcccataacaaaggcattattttttgttgccccaaagtgtggaggtctgctactggcatcatgggcagggggtcaggcatcctaagtgcttgcaatatgtcagagagacctccacaggaaaaattgttctaccccaaatgcccggagcaacccctacaagaagtacggctaacgaatactttgtgtcttgtatttatcctcatattgcttccttatttttttttttttttgtcacatgtgagtcaaattgttcagaaaattagcccaactgatgtattctataaaataaatgtctgaaatatttcttaaattgtttcctagatacaccctccgtggacttggaaatgatcgatgtgcacgttttggctgacgctttcaaacgctatctcctggacttaccaaatcctgtcattccagcagccgtttacagtgaaatgatttctttagctccaggtttgttttttctcttctgggaacctcattgaacatacatggagatgtagaggtgcttgtatatgtcttgcatatatagaaatagtggttagaaaatagtagtaataacctgtccctcccccaacaataccacctcaaatttcctcctccacccaagcatccaagagaagacccagattctcatttgcttgggaagcccgtctgcatgtcagaatcagaaatggctcattgttaacctattggtcttaacaaagtttgtacgtcaatgaaggacacggtcttccaagtactagtgtcagattcaaggaactgggactagaatccagtgatgggggatgttcttgtcatctttcctgagtggccataacagaatgtgttgagggaagatggctctcagttttaggagataaggttcagttaagtgctttggggacaggaaactggttcgtaaccttcaaagttaaaacctgtgatacttatctgatgctcctctgagttagccaatcacacttgaagctgctcaatactgggtaagttgctgccagcacaccctgaacagcttgtggtttctttacacactgagctttttgcatttccatttgacctgagatttctactttctcataatgcgttttctaatgagaaggacaaatgtactgtgtgcttctcccaacaactttttaaatgactcctatagcttgaagaaagagcagaacttttctaggtgtttattcactgatacctggaagtagtcgcttactcatttctctttttttttttttttaaacttgtagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccaggtaagtgaaaggagacaaacatgtattttggggtgatgagggtagtcctaaatggattggtcatgaaaatgtattctgaatatactactccagagatgcatgtgcagatgctatcacacacattcacttgagtgtatataaatgaaaatgagtttgcttttagggaaaaggtttctaataaactctctttcttacagctctgataatactgaaaacctcataaaagttatagaaattttaatctcaactgaatggaatgaacgacagcctgcaccaggtaatgctttttgagcatttaacattctctcattgttcattttttagagccttaaaaaatgatggctataaacctcctttgaagtaacacagcttcttatggaattacagttggtagtaatatgttaccttgtgatttaaagaaaaaatagctgagtggtagtgtatatgttaattattatccgagtttcaacatttgtggattttaaattatcttggttttaggtgagagtttggagagttccctgtacccttcaacatttatgcttcaggttgttgaagagatttatggagttcattttagttgttgacatttttgtttttctttctaatacttacaaagtaggggatttataattactatataatttaaagtattttagaatgtgttttttggaagtgggtatgctgagaaatgcctgtcaaaataaacattttcaataatgcaagcagtatgaaaccagtgttccctgcagcaagttcgagcaagccagacacttctttgaaagcaggctgctgttcagttagccatttaacaaagcaggaaatgtagaccatgttagcaatgcatttaatttaaactgatgtatttttcttctaccgtggaaagtctaaacaacctcattttgctatataccagttaaaagttagctaatcgacactggtcatttagaatagtaattagggtactatacgtgtgaagtttcaggaccagtaaaaggtgttgcttgtagtcttaatttatgcctggaacttaaaatgaaactccatgaatatatttattataggtaatatatgcagattaccatatttatctctgtatgagcaggcatggggactcagtttcatcttcatgcaatggagagttaagttgtgctttttcttaattgggtattgcacagccaggcttggttacttgcatctggatggggcagcctaagagaggccagggcctagactcaaaacccacctgcagcaggtaggatagaggatagggtaggtaaacactgaagatgcgggtattgggaaaggtttatgtggacaggcccaaaatgtaccaaaggtgagagagaggtatccggtatagtagataaggcaagcatgggatgttctaaatcacagcaagcagaatgttttaacaggggtgcccagaattctaggtaaactacgtcaaagaagactgtcaacaggtagggactaggacttcagtccaggggttggccaaaaggcttcatctcgtgtgagtacacaggtcactgtgaatggatttgggagctctgtgctggtgttcagaggctgcctttggacttagtggaaaagaattggggtaggggtgtggcacatggcacttaagttgaggtttatgttagagactaggtagagctggaccctgctctcagtgaagggctagtgggtagtcctgatcttttcagcggccactcctctagagagaggagacacatggaagccaaagccagacagggtttgacagatacccacaaatgaatttatcacatggaattttggagaatttctactacacaaggtatagcagaatcagtggtagagtttgattagcctgactggtgtaaactagttaaacgcctttgttagtttcatcctaattccaccaaagtaaaaacgggtatctgcactattttcataatgccacccggaaagctgtttgatatgtcaaaggaccctacatttctctgctgagcaattggtgcgcctgtttcaaaggaggattagttccatcagctctgctaaaggatgacaaagccttgaacatttgctagatcatcccagtatttatgtggcctcttaaaaaaaattaaatccaagtcggttttaaactctagtttgagccgttttcccaggaagtttgtgtgatttgtataggacctttgggattaaatggctgttttagtatctctcatgtgtgcatacattgtactgcccactccaggaacaaaacgtccccatccagaacatcttcgtattcaggaatggctccagtgcaaatgactgctatggcagcctgggttgaagaaatgattcttaggcctggtttaaaaaatgcaataatttcttagagtccttcagcattgccacagcatgtgctagtaccagacagaactttgaaagcacagcaccttacatctccagcgaatggccatttacagtaacattgttgtgaacacaaatgagtacctgaatgatgtttaagggagacaaaagcaagactctgttatagggcagatagacagcatttctaattattaccagatagaacttgaaatgacaaagcttatgatgtttgaggcaaagtatcagttcaaataagagccattagcacatagtatctaattaaatgctaggtgggagtgcacatactctaagtacaaaaagaactttagaaatgcagctggtgactttctagggtaatggagtagacagaaaaggctcatagaagaaatagggcttgaaatgtgccttgaagaataggtacaatttgaataggcaaaggagaaatagcattttgatgcatggagtttaaagacttattcaaaataaattacacagtacaaaataatggcttggtattttacaaaagcagtacatattttaagtgatagtatcacaaaaaacatcattttagagttgaaagcattgtccagctttaccaatttggacatgaggaaaccgaggcccacagatagaggttcgctctgtgctacccggccagtatgggcccaaaccgggtctgcccaggagccgcctcctacactccagcccattctatctgccatgccctgctgcctggatttttggaaacttcgtgagcaatgaggctgcttttagtgtccaatcaaaaactcctctgaagtttccagcatgtaataaactaaaaatatgtgaaattagcccccatgggtcacatatagtaaacaaagtcagggcaatgtttatacttttcaggataaggctccaaatcactccatgagctgtgcagtggaaaaaaaagtgggcttctgactcaaatagatctggattggaatctcaactctctcgagtaactcagcttttccaaattgttttccagactgtggaattgggttaatgcctctctcctggggttggtatgagatttaatgaactgataatttctctgctatctatcgcatcaactctagcttttgaggccttatgggagctgtcctcattcagcaggtctgattccttcagtccacccattcctcattagttgtgtgaatcctgtcaggcctttttccttactgacgccatgttcccagccagcagagctacggcctctaggagcctgtaggggctaaaagggacacttgggaagttgccaccctgatgtgggtacattgcttggagggagaaaggtgcctttgtatgaatatgtggcttggtgaatggagcagcctagatttcatcaccactcctccatcttgcctaggtgcctttgcacagtgcacaaaatatgcaaccatacgtcgctgccccaagcagtgccatccactttatctgcactcaagtaggtccttcccgttttatatgcaagttaagtcgacccattcagtatgtttatgcctttaagcttcctgtcaccttatgtttaactgtctatagtttttcctattcatctgcttaattacatttctaaagggtaggggtaaaggctttttctccttttgagctcttcctagcagagaactaggtacagcataataattatctaaatttttctttgataaacttccaactttcaaagaatagtaatacatcaacacatctaatacatccagcaatcctgggaaataaggattctcctcatttacagagggaagctaagatttggaaaaggtagggcacagagtaagctctctagactttgttgatagtttgctgttctattttgttactaaaaagtcttaacttgtcgtttggctttcaatatttttttcttgaatcattgtgttatctttacccaattaatgcttaggcaggtaaagtagatttctgtaggcaaaccaaggtaaaaataagtctatttaacacagggtgcctttgaatgaaacccattataagtgtatttacatatttcagatttcatggatatattcagaaatattaatgtaatataattgaagtctaatattgcaccctcaagcccagagtggaaaataaatgactctttctaccccttgcccttctacacctgtcaaagttaatttttaaccactggcacattgcaaaacattcatcctgaagagcctgattcataaatcttgttttaaatgctctgggcttggttctcaacccagactaaaggcaagcactaaggtagagggaaatgacattcaaagagttttacttgtctctgatttaatttttattggtttaaaatgtggtctgacattagagggttgcttcaaaggtgaaaaatgaaactttgaaaaattacatgtttgtagatgcgtagaactaaacgggcaagccacactaggttttgtcaaacaatagttttatttgtgtcctgagagacacaggtattttggtatgtatgtgtttaggaggggtatatagtcagttttacttttgttttcacagtgcagatgtctctttgtctcaagggacaaagatctgagggagaattgcaggggggactactttattctgctaagcagtggggatgcctttatcagaaacctggtagaatgtgtcagagtttatacatacgtaaacctgggcttatttatatacttaaatggatgttttccttagcataatgtcagttaagaccagtggatatggagcaaataatttgaattaccctaaaaggccctctgttctaagttgtcttaagttaaaattatgaagagaggtattcattttacccttagatgaagattttggttaatttttgttgtctattctttttttcatggtctttgttcataaatgatgtccagaaaaagaagaagttttctaggttgaaagctgcttgtgcaacatttgccacttgatggtgacttgtacatatgaaatatagtattcagtttgtaacttttgaacagtttaaggatcaagagacattttcctaactatatctgctgagaagtgaaacaatgggctgtatttgcctctgaaatgagttttacgaaactttgaggaaagggagaatgatacatattgttttaaagaatccagaaggtaaagttagttttccagtgtgtctaggcctttgaggtcccagagaaatgctgacattaaaataaaagttttcctacaacactagcagcttcgtgaaaactgtacttttgatttactaattagtgagtcatatagatcaagtgacagtaatacaattatgtacattagttggtgtcaaatttggacatacgaaatatacagaaagttgatggttttctcccaaagcaggaattactgattcagttctaccagcagagggctcccttttttaagctaataaagaacatgtgtcttgcagatcactttttaaacactaaaattcaacgggaaaaagattcagctcacactttcctaatataataggacctctttggtagatgattgtacatattgtgagaaatttgtttaaggcaaagtttttccaatctatttcaagactttctatacgttgagagagtactgctttccagtggcttattttcttctgaaacagaaaatatactggtggacttaacagagcattttaatcttagaaggttttgacatgaaacatcatgtgaatccagacaggtatgcttaggagactgatgtttccaatgtttctagctttagaaaggctatttttaaaagtagggcaagattatgcagctcaggatgcaagggtattctctgaactaaccatatgtccctatgatcagatggcagattcacttatagactgttatttccattgggaaagtttttcaatattatatcagttgcactaaaggaaagtttgtaaaatcactttcattgtgggtttaacagcactttccagatatttcaagtaaccctgaagctagttgctgctgttggcctgtgtggactttatgtgaccactggatcactttcccatgcagagtatgagggtattattgaaagaacctatgtcttcaaagggaatgaaatgttttgttttaatttaagcaagctaaaaatagaaaacagaaaaaaccagagttttgttaggggtgtgaaattttttgcatgtggcttaaaagattaacttcagttttgtccatttttttttacgttctctagcaaagggaagtgaggagcagggacaatgggtagagaagggcatttgaaaccatcagaagattgggttctagtcttagggctataatcttctgtaaaccacttcacctccctgggtcagatttcgttttcccctctatggcatgcaggaattgattgaagtgaactctaaattactttctggtgtaaagtttggtgatttccctggataaccttaaagctatctatgctcatgcaactgaaaattttcttagatcaaattttaattaaatagtagtcagtaatcccaagtctggtccattgccactttctcaaataaagggcaaacatccgcttagaaaggtatgcccttctctgcccttctatcctttaccccattagctggcacataaacctaatgcagagacaccttttaattagcaggtcatatggccatttaaatgcgagttgcaatcgacctcataaaaatagccgcagtgttgttttattctgaatcgtcacatgatcatggagtatagtatgcatatggtgtggggtttaatattcgtccgaggatgccctcctactacttactattgaacatttttgtaatctcctccctgcccgagttgctcacaagggctttcctgttacacctgcagggctgtctgtgctggtgtgtgggaggaggtgcaagaggtggacacgagcgaggcgctgtgttctgggttgttccaagaggttcaggcctttacaagtgaggctttgattctattttttgctgaactagctcagccacttcctgtgtttggctgtgcatagtgcctcgcttcactgtcggctacttgagccccgcgagccagccagcgcgctcagcagccagtgagactattttaggtcccctcacaatggccttctcatttcccaggcgaaaatgagcaagttggtcttgcattggccacttgtcagccgatgacaactttgacttgggctcccctccccctcccgaaatccctagctcagcaaatatttgaacctgcccaagttaatcatgaagctgcgatctttatctaagggagacgtgcgagcgcctgggctcctttcctccccgatacagtagcgaaatccagttggcttctcaatgaggagccggcagtgagcggcggtggcccggacgcactgccgggcggggcgtggggcggagggacgagccgagccgagccaagcggagctgggccactgtgcacgcccggagggtcctggcggcgcccccgctcctgcgcgcactctcggcgccggacacgagcactgcctgccgggaacaggctggggggaggtgcgggggcttggcccacttggtggaagaacagctttggggattttttttttttcattgtcggatacaggcatttcaaagggaaaccgttgaaatgcataacctgcaaagtaagttgccttgaatttgtgcacttctctgttccttatctgagcggtgcctttctgtagtttgtcttggagtacgtgtgtgtgcgtgcgcccctgtaagcgctgcctggggaggacagatgggagattaggggagacactccccctgtcctcgagggggacagtggctgggaaagatagggtttaggttggaatttcagtaagaaggtactaattacaacgtgcttggttggaagttggtgccaggccagggcttggagagaccatgggaaaatcacctgtctccctgccttctccctgagttagtttgccacagaagatccaacagccagactggtttgcaccgacggttcccaaatgcatggactggcactctgggctgttacacccgccacagctgctcggagaacttgtctccttgcttcgggggagggtcgacattttaattaaactaaaaaagaatgtttttctgaatcttagggcatacagccacttttaccatttttatttgaatttgagttcaggtaaacttaggcaaatagaaaagtgggagagggtgggaagagacaaggtgagcctgcttttcccaatactgggaaaatgaattaaactagacgggggacgtcagagaacagaatgccttgcctttggtctgctttttaatatattttatgatcccaaattttacagaaagtctcaagggtttctgtgttttttaaatggtcaaatatgtgacatacatgtgtacatagatcacagagccccactgtagttttttaaatgagccacatttaccttggggaagagcccctccccccccgccatcataatattgtgaatgtaaagagagattggttcacaatgagaatgtacagtaggctcctataagggtgacaggattatatgcagaatgactttgaagagccaaaattgatttatttatgttaagtagtgctaagaaggaatatttgtcccggagtgaggcatttgagatagagggggaaaagcaaaaaaaaaaaaaaaaaaaaaaaaaaagtgattacatcatcttcccgttcaagcagtattagtagcgaagatgggttcatcagtgaaatattttgcaaagataaatatacctccactctgcattctgatctatagcctctttctttttggaagaagcattttctttgcccagtttttttaggcagtcacattaaaattctcattaataatgttgacagacaattacgtttattatttctgctaataggcatctgcattcctattcagaattttcattgttagtctataaagtctagttttaactttggaatgtttggtagaggaggacatctatacattttcttttaactgtcctttctaatgtggtacatttgtgacagtgtttgaattctgggttttcagtgaattatggaggactaaaataccaggagtagtccgtactgcttctcttatacatgagagatatctaaggactataaaacataacttaagtatacccttttaatgcctttgtaagatttttaaaccaaggaatgactgggctatctataaacccagatgcactaagtggggagaaaagctcggagctgcagcatatcagcttttgtcaacctgccaacagcagagcgtaccatgctgcaaggagtaataaacaaggaattagaaaactcgctgctggagaacagtcaaattaaacacctttttgaaaggatgagcatgtatatattgcagttctattaaatgtagcttcttagtgaggttggcattatgttaaggctggtatggaagagaactgatgaagcaggagtggtctggtgacatttttctgacttgattggctggggcgtgtgatgtaataggtttcagtgcagccccttataggttttaaaatgaattccaagacaccattacaaagaaagccggactcttttcttataactgagctcagccaaggaaactcttgcacaaatgtacaatactgtttggaatatggaagacctggatttagaatatgccaagacagatataaattgtggcacagacttgatgttttatatagaaatggacccaccaggtaatactgcagtattattgtagagagttagttaatttcgtggctttttaatttttcgaaagctactgtaaaagatcctttttggatttctgtttttattaatttgtttcattgataaaaattagtttgctcatggcttaaaaattaaacagattgtttgactgtctgtggaagcaagcagctcaggctgtgtgtggtaaatgcttattcttacttgaatggatatgaattgaactccagtttttcactggtgtcttttgttaatcgagatccttccctgggtgagttatgttgtgggatattgtccctgtaattaaaatgatgcatcttttgtgctgcttttctctgttgccagtggatgagaacagtgtagcactttgcagtgataacacttggtactttagaaagcatgtaaaatgtagcagtgattacaactcagttctctaaatgttgagactttgcttgctctctcatattaagatattataatgaaaaaagaagttgactttccattattgttagtctttgtaaaatattcttggtagatacctgaaatcattttttgtataagttaaaatagtaacagtgctttaaaacttatgacagaatttacctaaaaatcctagatttattttgtttcctaagtaagttgttttattccaatgttagctctccccctgcccccatttaaggtattcaggaatactgcagtcttttatttgtcaccaattggtatatatgaatactgatttgacattgaggaagggggatatcatttttaatcagacctagtatatagagcacaatttatccaacagaatattaacatattaaagagatttagggcacagatgagagtttcttaaagtggcttttggcagaacagtgcctgaaatactaagattagagaaacccaattgctcctcttaaaacatactgctgtagatgagcctttttattactgcaacagagtttgtggaggacagagaccaaatttgtctttcgtaattaaataagaggaaattaaagccaactcatgttattcctgctactcatatgttcatagtttcttactttagatggatttgaccaggcatgaaactttaatataactagaatctagaagtacagaatgtcatgactctggatttactttgaaatttattcacatggccagcccaatttatttgttagtttctaaggctctctctcttttctccttttcagtttcatttctttttgagccatgctctgaaagattttttttaagaaaattatcttccatattgcatggaattgtgaactaatgctatatatttcagttactctaactttttatttttttaaagtaaaagtattcatctaaagaaatttagttctaatgtagttgggattgcgaacaactttttctttttcatctgcagcactgcctcctaaaccaccaaaacctactactgtagccaacaacggtatgaataacaatatgtccttacaagatgctgaatggtactggggagatatctcgaggtaaggctacagaaacttcattttcagagagttttagattaaaagaaagaaaagcaccagcttgctaagttccatttttaggatatcatccaacataagcatgaagcatagttggttctcttccaaagacgaccagaaaaagtcactgagcactggagaactgtgggtgctggatgccacaggaaattaaatacccgggaagtttcattattgacagagatgtcagtgaagtgccagagtgaagtggcactgcctaagaacagagtgtgaaggcactctatctattaagcacaactctaagaattcttgccttaaacacaataagaaaacaatgccattttatgttagctttgggaagggggagtaaggttggagaaactcttttgagatcatgagtttctgtgctcatttgtcagagagattgtaatgtttggttgaaaaaataaaaacttagtaccacagatacaccaatagtgaaagtgatatgcacctgtttgtgatgagactgcaattgctaacatttctatttaaacaaattattagctcttattagtgagctctgaaaatgcaattcattaatttaaatctatgtgggcaggaggaatatgggcactcactgtactttccacttgattttgctgtgaacctaaaactgctctaaaaaatagcctattttaaaaaatataaatctgtggtcactaaaccttaagatgagcattgttttgtgttttcatttcagggaagaagtgaatgaaaaacttcgagatacagcagacgggacctttttggtacgagatgcgtctactaaaatgcatggtgattatactcttacactaaggtaagccagggaatatagctgaaattagggttttgggctgatattaaaacatatttccttattccaaaatgttaatacctttatttttatattgtttttacaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggtaataaaaactgaatgaattatccagttacgatgtttagacaagatccttttaatacttagaaaacatttgaagcagatgaattacatgtaatcaagtctaaaaaacttgacactcgtaattacataattgcaattttaaagatgtttccatgtcagctattttgttaaacaattgttatttgattaaataccttatccattgaatttattttaatctttctaggatcaagttgtcaaagaagataatattgaagctgtagggaaaaaattacatgaatataacactcagtttcaagaaaaaagtcgagaatatgatagattatatgaagaatatacccgcacatcccaggtgagttttctatgaaaatcagattaaaaaataagagttctaaacttttaaagactaacatggaaaaaagaatttaaaaggttgagtttttacgaatgaggtgggggtgagagcatttatttgtgaatcattgttgattattctagtgtaatatctctaaagctttaaaccaaaaattttaagtatcagaataataaattaagttcacgtgataactgaagcagtcactgagtttcaagttgatttaattcgtgatagaaggatcctgtttagattggaagttagtaataactggaagtttcacagacttgtctaatccctgaaatggagatttaggcattaatatatatcctaccatgaaaaggaagggctatatactgctgtgcttttctagacccttattcttcactggtcactcatgtatctgggaatgccagagggaacagaaaacaacagggatgctataaactacaatagcttttaagaagataaaaactataggaaattgctacgcaatcatttttcatagattgagaaaattctccagaggaaatacttgtttctgggatactgttttaatggattttatgaatttgagtcccactctgctaataatacagatcaaatgtcctggtagtgtcttgcagtaagagattgttctatgaaaggtatgacattatctttttaaaattatgttgcaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggttggtgtttcccttgttcttgtgctagagataaccaaaatcctctaaaaccatttaaagatgatctcgctttctgtgctttgaatgatcacgtggacacaggaaggggaatatcactctggggactgtggtggggtggggggaggagggagggatagcattgggagatatacctaatgctagatgacgagttagtgggtgcggcgcaccagcatggcacatgtatacatatgtaactaacctgcacaatgtgcacatgtaccctaaaacttaaagtataataaaaataaaaaaataaaataaaataaaatatgttgagccactccaaaaaaaaaaaaaaatgacaggaagagaagccacgctttacctaaggaaaactgctgggaaaccatagtgaaacttttcataaactttggggaccgttcctgatgtacccagataataacaaatacgtttcttttgcctgcaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtaagtatttgaaatggaatcctatacatgaataattggtgattgctacaattcaggatgagttaatgcgttctcttttcaaaactgtttttcaggtggttgactcaaaaaggtgttcggcaaaagaagttgaacgagtggttgggcaatgaaaacactgaagagtaagtagttactaaagatggtgatagcagaagatttttctcattttaggaaaatgcatgacttgctttgtttttagaacaagtgaggaattttactgagtttggaacatcttgtaggagaaaatgtataaactcagtgccattatccagaattttaaaaaaagaaagcttagctaaggaggactaggatttatttttactcataatgctgtgaaacaactctctgtgtccataatgatgtccctgaacatctgaaaaatcccaaaatatttttggaacagtcagagaaaaaataattatgcttaatatattttaaagcttaagtatatactttgtttgaattagtcaaaaactggcaatctgcctagtcaatttcctgatctaaactggataaacgagattgttttaataccttccactctgcccaggtacctgagtgtggttgcttgaaaacagaaatagtacagttgattggtaactctttgtcctgggaggttgcactggaggctgaataccaggagaggaaaactcaggtcgggcagaggcaggcatgtgatggccagtctgactggcttggtaggggccaggagggaagtgacgggggtatgcctagggaagacagcaaggcaggctgatggctcctgcactcttcatttagaaactttctgtcctgcctgcctagccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtgtatgtatctccagcaaacttttctttacaacatctcatgaagagatgtttcatttattcattcattgagttttgggggcaaagatttgacatagttttagtcttgaataagcttacagtacaataatgtagaagagaaaccaaagcagctgtaataccattttaaagtctagccagaagtgtatgttaatacagtctaatagatacctactgtttagttggaagactaggtttggattcccattcagtgctaattaatcatgagaaatcgccaagtctttttttctcatctttaaaatggaagtggcagtgcctgccttttttgcctctcaaggctactatagttagaatctgaggtaatttatgtgagaacatcacccataggaaaaatactcatcaggaacaggtgaaaaaaaaaaggattctgatcattatccttgagataggtacacccacattggatcactgacatcaccatttccaagaaattaatgtcctctagtagggaatggttctaaaagtatgttacactccatgatcacctttcatttaatgagagaaatagtcctacagcaaagaagggtacttttgtccttactgtgcataagggcacatgcagagatggagagttgtgcagacacctcaaggacagccagaaagaaggaatcctatgaatagtcataatgggagtaatagtaacactgctagtcatggagcactgcagatagttgtcctcatcatgattggaagctaccacttgttgcatgcttactgcatgtcaggcattctatctagcattttgcatgcatgatctcatttcatttctcaaagtaactgtattacatgcattttactattgtcttccctttaaaccattttaaagatgaaaatacagtcagtcagtgaagctgggttacctacccaaggcactcggccaggtgtcagttgtaacctaggaccctttccccaagttgagactgcacaataatgctttttattaaagatgccctgaagagttgtgaattgtcttggacaagctcaaaagacagtttttcttctctcctctctagggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaagaaatgaaaaagatatatgaatatgacaaagtattgctgagtccaacaatgttgttttaagactcttaaaatacggtacctggcaatgtttatttcataaagaattgtgaacttcttgaatctagggagggggaatgtagtgaagggatgtatcaagtggggtggtgggagggggaggcaaggttatatgcactttctcatgatttacagagaagtgaataactgcaaagtgaagttgcttcttctacttcagtcttctctcactttgatttgctagttgttatcaattaatgacaattacaaacctactgtatctctaatacagtgtgactggtcaggtatttcagttcttaggaaggaagtgccaagtttgtttttgggttcctggaacagcgctcacctttgtttagaacactggtttaaagggataatcatctctgtcacattagactatccatcatgaccagcaaatactcattttaggaaaaaaaaaagcatgatctgaaaaatacttttggtggtatgttggttaccctcctagctttccatttggtttagaacataaagcaaatagacacagtcatactgtcactgctctggactgtgtggagctcgctaaagtcatggtcattgcaggaatccaagtggcagtccttctcattcattctaatcattgtatgtgcttcactacgggggggagaaggaaacgttagcatcatgtttcccatttagggcaggagtgagaggtctctcttcctgatttagatatgcaaaagctggtatgttcagtaggaactgtacatgtgttgggaggcataaagactaattagcaaccataatatggtcactaccctaatagactaaatgaaatcttgcaatttcaaattactctttctccatattagatttacccacagctatatttctgtttaagtactagggtgagggttttctgttactttgttttttaatgttgttccttttgaaagaatcagtcttgcagctgagtgaaaaatctgtggaatgtattatttgtcctctttacatgaaactactcatacttaagcaaaagtcagtcttatagcaagactgttagccctcaaacttgactctactgatctgaccatttccctctcatcgccagacaactgacgatttccctggttttagtctgcgtctctgctttaaagttattgtgatatccttctagatcatacacaagtctaacagttaattagttaacagtttttaaactaggtttgtgggtatttttttggtagcacatgtatgctattacatacaaatttttatttctaaaatataagatctgagattgaatattttcattaaaagctacagttttgtgaatctttgtgcttcaacattctttgcaagatgatacggtatttaggcatttgccttatttttgcatctcacaaacataagtgcaatagatcttttcattgaacagcaaagtaggattcatcattccatatgacttgagttacaccagacctgttctgcccaatgcctttttgattacagtgtagcttgcccaccgcatttgtcgttttagatactttgctagccggccactttggatttcatcagacagtcctaacaatattgtctgaacggctgaatatgaatagatacagcagaggcactcctgatatatgatttttatccatgcgtcagtttttcccacccagtgtagcatcctaaagataaagccagaagctaagctgcagtgaggctgtgattgggcgtagaagtgggagcattgggacctcacattacacacacgagagatcataaccatgtgaaaaggcaaaaagcatgtgtttgcaacatctgataacttcatggcctttgataaatgtatatatgtatatgtgcatggactgtgtttccagtacacctttcagccaaaacagatccacagtagttgttgagttcaagtacataaagtacataacaagcgaacgtctagtacaattcttacttatgtgtatgggatttttccctttgaggttgctttgttttgtcttacaaaggtgaaaattgtttgtaagtgaagtgagaagttcatatttctttggcttttttgtgtttttaaaagttactccttttagggagctggtctgatgacttgcttagcttggaaatccttgttttcagtgtgtcgagtcaaaatgtgtttatgtgagctgtcactgtggggaaccaattgctttgtcatatagctggttatgaactagtaacatgtttgggaagtcctactgatgttcctttggaagaaaaaatctgctggttttaacaactgtgcttttgctatgtatggtatccaagttagttgaaacgcagacactgagatctgtttgagtttagggtcatttttagaaaggggcagtttaaagcacaatgtctcacatgggacaaagttccaaaatgccaaattcttattttttaaaaagctagttctataaaatactggtattatgggtggggaggaaatagaattgagtcaattggaaagactatccaacttaacatgaaacttgtcaccatgagatagcattagctgcccaggatgctgctatatatatatatatatatatatatatgtgtgtgtgtgtgtgtgtgtgtgtatatatatatatatatatatatatatatgtgtgtgtatatatatatatatgtgtatatatatatgtatatacatatatgtatatatatgcatatatatatatgtatataaataataatcaaaacgaaaaaaaactcatttatacctgtgtattttttaaagctacaatctgttcaatgtttttaaaaatctgtttatatgacattgttaaaataaagttggtcttttgacgagagggaggatgtcacggtcagttgtaactttgccttcacaaggcaactggggtggggggtgggggtagtgtgcctccttgacatttcgttcaagttatagattcaatggagctatgtcttgttttaagttgctttaatgcattgtattagatcttcaaacagaataaaggttgttttgaaactgaagttttgggttgaaatttcacttatcacctaagaaatctttctaaaacagctaccttttggcttataaatgttgctgctatttctgttgtctcccacccactcccttttgattgttatcacagtatctcatttttgtaaagttgagaaggacattgagtggtcacatgtaagtaatacatatgagctgtctttcataatttcactgttttttgagacggagtcggagtctcactctgttgcccaggctggagtgcagtggcgctatctcggctcactgcaagctccacctcctgggtttacgccattctcctgcctcagcctcccgagcagctgggtctacaggcgcccgccaccatgtccggctaattttttgtatttttagtagagacggggtttcaccgtgttagccaggatggtctcgatctcctgacctcgtgatccactcg

SEQ ID NO: 1449 - DNA, 3358 bp, Homo sapiens
tacaaccaggctcaactgttgcatggtagcagatttgcaaacatgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatgaagcgcttactctttgatccttctcctgaagttcagccaccctgaggcctctggaaagcaaagggctcctctccagtctgatctgtgaattgagctgcagaaacgaagccatctttctttggatgggactagagctttctttcacaaaaaagaagtaggggaagacatgcagcctaaggctgtatgatgaccacacgttcctaagctggagtgcttatcccttctttttctttttttctttggtttaatttaaagccacaaccacatacaacacaaagagaaaaagaaatgcaaaaatctctgcgtgcagggacaaagaggcctttaaccatggtgcttgttaatgctttctgaagctttaccagctgaaagttgggactctggagagcggaggagagagaggcagaagaaccctggcctgagaaggtttggtccagcctggtttagcctggatgttgctgtgcacggtggacccagacacatcgcactgtggattatttcattttgtaacaaatgaacgatatgtagcagaaaggcacgtccactcacaagggacgctttgggagaatgtcagttcatgtatgttcagaagaaattctgtcatagaaagtgccagaaagtgtttaacttgtcaaaaaacaaaaacccagcaacagaaaaatggagtttggaaaacaggacttaaaatgacattcagtatataaaatatgtacataatattggatgactaactatcaaatagatggatttgtatcaataccaaatagcttctgttttgttttgctgaaggctaaattcacagcgctatgcaattcttaattttcattaagttgttatttcagttttaaatgtaccttcagaataagcttccccaccccagtttttgttgcttgaaaatattgttgtcccggatttttgttaatattcatttttgttatccttttttaaaagtaaatgtacaggatgccagtaaaaaaaaaaaatggcttcagaattaaaactatgaaatattttacagtttttcttgtacagagtacttggctgttagcccaaggttaaaaagttcataacagattttttttggactgttttgttgggcagtgcctgataagcttcaaagctgctttattcaataaaaaaaa

SEQ ID NO: 1450 - DNA, 2175 bp, Homo sapiens
atgagtgctgaggggtaccagtacagagcgctgtatgattataaaaaggaaagagaagaagatattgacttgcacttgggtgacatattgactgtgaataaagggtccttagtagctcttggattcagtgatggacaggaagccaggcctgaagaaattggctggttaaatggctataatgaaaccacaggggaaaggggggactttccgggaacttacgtagaatatattggaaggaaaaaaatctcgcctcccacaccaaagccccggccacctcggcctcttcctgttgcaccaggttcttcgaaaactgaagcagatgttgaacaacaagctttgactctcccggatcttgcagagcagtttgcccctcctgacattgccccgcctcttcttatcaagctcgtggaagccattgaaaagaaaggtctggaatgttcaactctatacagaacacagagctccagcaacctggcagaattacgacagcttcttgattgtgatacaccctccgtggacttggaaatgatcgatgtgcacgttttggctgacgctttcaaacgctatctcctggacttaccaaatcctgtcattccagcagccgtttacagtgaaatgatttctttagctccagaagtacaaagctccgaagaatatattcagctattgaagaagcttattaggtcgcctagcatacctcatcagtattggcttacgcttcagtatttgttaaaacatttcttcaagctctctcaaacctccagcaaaaatctgttgaatgcaagagtactctctgaaattttcagccctatgcttttcagattctcagcagccagctctgataatactgaaaacctcataaaagttatagaaattttaatctcaactgaatggaatgaacgacagcctgcaccagcactgcctcctaaaccaccaaaacctactactgtagccaacaacggtatgaataacaatatgtccttacaagatgctgaatggtactggggagatatctcgagggaagaagtgaatgaaaaacttcgagatacagcagacgggacctttttggtacgagatgcgtctactaaaatgcatggtgattatactcttacactaaggaaagggggaaataacaaattaatcaaaatatttcatcgagatgggaaatatggcttctctgacccattaaccttcagttctgtggttgaattaataaaccactaccggaatgaatctctagctcagtataatcccaaattggatgtgaaattactttatccagtatccaaataccaacaggatcaagttgtcaaagaagataatattgaagctgtagggaaaaaattacatgaatataacactcagtttcaagaaaaaagtcgagaatatgatagattatatgaagaatatacccgcacatcccaggaaatccaaatgaaaaggacagctattgaagcatttaatgaaaccataaaaatatttgaagaacagtgccagacccaagagcggtacagcaaagaatacatagaaaagtttaaacgtgaaggcaatgagaaagaaatacaaaggattatgcataattatgataagttgaagtctcgaatcagtgaaattattgacagtagaagaagattggaagaagacttgaagaagcaggcagctgagtatcgagaaattgacaaacgtatgaacagcattaaaccagaccttatccagctgagaaagacgagagaccaatacttgatgtggttgactcaaaaaggtgttcggcaaaagaagttgaacgagtggttgggcaatgaaaacactgaagaccaatattcactggtggaagatgatgaagatttgccccatcatgatgagaagacatggaatgttggaagcagcaaccgaaacaaagctgaaaacctgttgcgagggaagcgagatggcacttttcttgtccgggagagcagtaaacagggctgctatgcctgctctgtagtggtggacggcgaagtaaagcattgtgtcataaacaaaacagcaactggctatggctttgccgagccctataacttgtacagctctctgaaagaactggtgctacattaccaacacacctcccttgtgcagcacaacgactccctcaatgtcacactagcctacccagtatatgcacagcagaggcgatga

SEQ ID NO: 1451 - DNA, 96599 bp, Mus musculus
  misc_feature (4189)..(4208): "n" at positions 4189 thru 4208 can be any base
  misc_feature (9652)..(10001): "n" at positions 9652 thru 10001 can be any base
  misc_feature (27805)..(27824): "n" at positions 27805 thru 27824 can be any base
  misc_feature (54062)..(54139): "n" at positions 54062 thru 54139 can be any base
  misc_feature (88386)..(88405): "n" at positions 88386 thru 88405 can be any base
ggaatgacgctttacactacgaggtaggcaaggagatgcggatgaacacatgcggatctctgatgcggatgcacagaagtttgtacccaggaggctggagtgggaggtcccgttttttggtggggtaagggggggtggggcaggggtgaggtagggtctttctattacacatcatttggcagtccaggaacttgctacatagaccagtgtagccccaaatttgcagaaatgtacctgcttctgcctcctagtgcaagcactgggatcaaaggcatgcgctcccacacccagcaggcactcacagttgtaaagcctcaagagaaatgtatcaataatatcaaagacaaaagcaaagtgtacatttgaaaattaacatccgcgaacttaagaacagtaaaggaaggtctgttactcataaaatggagatttaatactagaggtttactttctaaaggtacttaactgtactcaaggatcattcgggataaaagtcaaatgctacaacaaacaaaagctaagactctcattaccattcagattatataaaaacctcggaaagagtgttgcagacagaaggtattctatcaatatctttttgatttaagaaatgaagaaatggaaataagatttatcactaaatatcctaaggagacagcaagacagcattttactgcaaatgggtataataaaaatgtatacggcaatttaacataccagaaaatgtttatgtgataaatggatatatgtacagagtcttattaaaaacctgagcaaagccgggcatggtggtgcacgcctttaatcccagcactcaggagtcagaggcaggtggatttctgagttcaaggccagcctggtctacaaagtgagttccaggacagccagggctacacagaaaaaccctgtctcgaaaaaccaaaaaccaaaccaaccaaacaaacaagaacccccaaaaacccaacaacaacaacaacaacaacaacaacaaaaaacctgagcaagatctagcaaaaaaaatttttttctcatgaattcttattacctgtgaactatgatgtaaaacaatccataccgaagtatcagaaaatactttgactttcaaccatacatgttcaaaaaaattaagaaaaaacaaaggattgattgataaggaattcaccttaggcattataactcaagaaggctatttaatagagtaatagtagtgacacacacagcagaaatgcctgtcagagcattccttagaaactcgccagatttccataagtgtgtatttgtataacttcttttgaaaatttcaaatgtacagaaatggtaaaaaggaaacagcagtataaagattgctatattctttacttagttccccagttgctaacatctgttatatttctttttatttgttcagtttgtaacaaggtctcatagagcccaggctagtcttgaactttctctgtagctaaacctggccttgagctgatcctcctgcctccatcttccaagtgctggattccagacatgtgtcatcgtatccaaaggatgttctctttatcaatttttttctgaccaatttaaagtaagtagaagacttactatttcaatcctaagcatcagcgtttaccttataaattaaggattttcatattaataattaatactaattcacaaccatcactggacaaatcctgtttaaattttcttcattaaaacaaataaataacaaacaaataataataataaaaaccagaacaaaattgttctgtagatttctatccagaccttaggtaagtttcttttgttgctttaggttcttttgtcttttaaacagcaacagccccctacccttgattttcccccctgaggttgagtttgatgtcatctatcctgcataacgccccatggtctatgtttgtttcctgtggttacaaacacactgatatactttagctcaaataacagatgatgcatcatcacatccacatgacgtggagtttagtcctgttggtgattggtgatgctaaggctcccacataacacacacacacacacacacacacacacacacacacacacacactcacacacacacacacacacactcacacacacacacacacacacacacacacacacacacacacacacacagactcacacactcacacgcacgcacggtggttaagtagatcttacacagtgggaaagaattctgagaaactgtcatagcctagctacttgcaacagtaaaaacctatactcagaaaactctattctaattgggcctagagtttgcctgggatctcaactactccaacagcagaggcaggaagatggcaagttcaaggctagcctaggtaagttagcaagaccctgtctcaaaatgaaaactaacaaaaggacaggagatacaactcagtagtaaagcacttgccaaccgtgagcaaagttcaatctccaatactacaaataattatgacgcaaaaccctatattcaaaaagtaactgaattaaaaaccctacattcaaaggatatttgagttaataatttcctctgtacaattatcaatttagtatacaattaggtccattttttcatttctcattttcatctatactctgtattctttttaaaaagtagttactactattctctgtatgtgtgtaggatatatgaaggtgagcccacgggtgccacaatatggaggggagagtacatgttttggagttggttttctcctaattttacaagggttcttagttttgaacttagggtgtcaggttgcacagcaagcactttgctagtacaccatcctgccggtccttcattctattctgacccatccatgccttctagatactattattcttccaaacccatatatacacatagctgttttcccttatccatgaaaaatatgtttcaagtctcctaggagaagcctgaaactgtagatagaagcaaattttatattacttatttattgtaatacatgtacatctctgacaaaatctaagcatttaggcaaaaataacagagggtaaatagtaactaaaataacactattgtaacaatccactgttactaatttgacagtctccttttgggtctctaagtaaaataagggtgaattaaacatgatcagtgtgatactttgacagttgatctgataactgagccagctactcagtgactcatgggtcacatatcctttatggatgtgccgtgcaaagggagactcccattccagctctcattccaggttagacagaacaggatggtccaaagggctataactctactcgatggaatagaatttaaaacgtgaattattgagtagtggtgcacacctgtaatcccgatactcagaaaaaagtcaaaggcaggaagatggctccaagttcagggtctgcctggcctacacagtgagttccagagcagctagggccagaccctttctcaacctctctcctcaaaaaagaaaacaaaagcaaaactcttaaacctgatggactctttatttctgtaatttttcatttaatatttaaggccacagatgaccacatgtagctaaagccaaaggaaacaaaatttcagaaggcagtcaggaggaggttgctcttagactatagtcctccctcccctcctctgccaagagataacatatcattctatgccttcaataaaagcaagcaaacaaacaaaaaacttagtataggagactagagagatggcttagcacttaagaccacttactggtcttgcataagccccaggctggggtcccaacacctacatcaggtggctcacactgtctgtaactcctattctaggggatctgatgccttctcctggcctcctcaggcatctgcagacacacagtgcacacacagacaagcatgcatacacatatgtaaataaaaataaaaattaagcataaaaataaaatcacaaagaatatttttaagaactctgtggtggtttggatatgaagcgctcccaaaggttcggagatttgaatgcttagtcaccagggagtggaactttttgataggattagaaggataagtaggtgtgaccttgatggaggaagtgtgtcattggggggtgggttttaatgtcaggctcaatcttgttctcttcttcttcttcttcttcttcttcttcttcttcttcttcttcttcttcttcttnnnnnnnnnnnnnnnnnnnntccctctccctctccctctccctctccctcttctccttctccttctccttctccttctccttctccttctccttctccttctccttctccttcttcttcttcttcttcttcttcttcttcttcttcttcttcttctttttcttcttttttccccccaagttgaatatactaatgtggggtccgatcatctgactagtaggattatctaaggtccatcagaacgcaggattcaagatggaaatactggctagacataaactcatttgcaggggagacaggtgaggcccagcagagcctggcctgtctcagtcatctgctggaaccacatagggattactctggcactatctacttatttgcctgcagtttcttgtggcggtgtgactgcccaagaggtgcagtggggttgagacatgcttgcaagagctgttgaccaaaaaaatgtctgtaagaatttaaagtgcacggttgtactgtcttgatgttcacacaacatactacaacacaaaaggaaggtgttctgtctgtctagatcacattcttgcttggctccttaagaacagcaaaaacaatgtttggggcaaaagcttccagcatgcctacccacatatggctacactagactgtgggagggagtacccaagaacagacaggctgtgttcaatgaaaaaggacttgcgcctactttttcatgaggtgagggctcagaagttgaaaagataaagggagggtatgctccttaggctactgagacacagcttggtaatgccccacagcagagcagagagaactggacttgcgttcaatctttttgggactgattgagaggaagaaagcacactcagttctacagaggacatggtccattgttctaagaaagacccagggtagttttaaaacaagtctgagccaggcacggtggcacctgcctttaatcccagcagatctttaagagtttgaggccagcctggtgtatatagtgagttccaggccagtcaaaaagtctcacacagtgagatcctctcaaaaaacagaacaaatgaaaaaagctctacagtatccagaagagaaacaagagagaaagtgcaaactttggtgtctaaagttcaggatgccagtctgccaacattttcactacataatctcataatgggtaaactccaatccctgtttattgggttgtttgccatggcttatttgtattgctttgttgctattgtttttagatagcatctcactttataatctgggctgggggacctccaattgagcatcctcctacctcactttcctgaatctaggattacatgccactctacctggctttgtcttgttttttaatctaataataacaatctagttaagatagcttatctagcaatgacaagctacatcaaacacaacaaagaaggatttaaacttatctattatattacagtacagtgaggatcagatattatagtcttgccttttgcaaactgtaaaaattaccttcaaaattcaaagtaaactaaaggtgacttatctctttgctccatcacgtctggggcttcagcagaaagactcaatgcctagggctatcttcatgattgaggactggagagctcctgaagacatatttactgacgtggctgatcattaaactggaaccaagctaagtatccatacacaattgcactaccttcacgcactctcagcttcctcagtatggctgcttcagggcagtcagacttcgggcctctacgactgtcacatgccttctgttgcagtagcaagttgaaaactgtttgattctttgtggtctagatcccaagggcacacagtatcacatctgttgtgttttattatatacaggtaagtcactgagtctggttcaagagggactatgcatcctaccttctgatggaagttggatcaaagaatttccagccctttttgtgttttctttccgatttttatgacaggggtttctctgcatagccctgactgtactggctgtggacagtcaggggggaatctctgagattaaaggttagtgtacaagcccccacccccagcttgcttttatttatttattttcttttttaatgatgggactttcaaatggccccccaaataccggatagctaaaatttgaaggcaactatcctactttgctttctattgttgtgataaacaccacaaacaaaagcaacttagggagaaaaggttgattttagtttttaggttatagtccatcgtgtatgaagctcgggcaagaactcaagctggaacctggaggggaagacgggatgaccacgaaggagtgctgctcagggctctgcttcccgcgctttgctcagcctggctattatttacgaattatgtattattgcagaggaagaacagcttttattagaggaagtagacaaatatatgtagcaggtatagagaaaaatgtcttacacaaaactgatcccaggctcgagaagctgaaaatccatgtcttcttcaggtctcaggcttttcaagtttcggaaaggtcttagggctggtcagtttgcagaaagacaggggcggctgattggcccacatctattgtgtaaacctgtccagatctggccttgaacttgttaaaccagtccatccgcagtggggcatgctggcaggagaaaggcccacaaggcctttgttttaagctgtgatgcttttgtctcaggtcagaagggcgaggaggaagaagccagccatcttgaaagttcaacatctttattacttagtcatggcccttctccctatatgtctgcctaccaaggactctgtctaactcctagtccttcatgctgtcctttgaaaggtcaccctaactgctgttaggggtttgggggacaggcttctcacttgctttgagctgaccaaagggatgagaattgaggggcaacagtcaaagtgcctcagaggaggcctgacctaagggctcaggataaaacttaaccactggcaatgatctagaacctaaaacagcctttggcaatactgtatattctttttgtttgtttgtttcttgtttttgttttgttttgtcttgtttgagacagggtttctctgtatagccctggctgtcctggaactcaatctgtaggccagaccaacctctgatttagagaggtcacttggctctgcctcctgagtgctggggtttaaagggatgtgccaccagtgctcagctggtagtatgtattcttgaagtgtcacatgagagatgtatcatcagcagtagacatctctgcccacgtaccagaggtaatgtccaatggaagtgggctacataggccaaatctgagtgacatgcagattctatttgttaaagtcactagacatcagcatctaagtgacaactttgatgagttggtggtcctggaccagaaatcctggacaaggtctcaaaaatgttaacaatcggggtctttatttacttttctctgccagttaaagagtaaaaggcaggaaagatcttaagcttgtctggtagcagtggagaaatctcaaacatagccagcaggagcagacaggatcagcagttgaagaaaggcctttactgagggtgaggaaacacacacacacatacagcaggaacaccattagttaacaaaactaaccaacacacaaggaaaaaaaattgaatgagtggaaactaacagaatccatcttaaatggatgaggccagccatcctgtgaagaaataatcacataagacgtgatcactgtatagactgatgctgataaggatgttgtttaaaatggaaccatggaaaatgtcttagaggcagggcatgggggtacatgcctttgatcccagcactcaggaagcagaggtagtcagatctctgggaatcaagttccaggacagccaagcgctgttacacagagaaaccctgtctcaaacaaaacaaaagagaaatgtcttagaaattttaatgttgtaaaaaaaaatgttataatgatacattcttagggaataatttcctaaagtaaacctggacagttagggactaaacaacaacaacaaacaacaacaataccccaaaaccccaacagttgtgtttcagacaaaatcaaggaggaagtgtcccttgcctggttgttggccctattttagtatgcttagacattatgtatttatggtttttaaaaactgccttaaactagcatagcttgataatatagtctctatctgtgatcatctccttcactcgaatctgtcagatcatcttctgacttaaatgtagctctcaggggaatgtccctgcttggaagagaatgtacaatgtcattggcaaacacagaatagctatttgattggtggcattttttttcaatacacaagaacgtaatgctttgattcaccaagcagccacacgtgcactgcttaccttgaagcaaagcatcagttgccgggcctgtgctgatcagaccaaataggcagacatcctattgtcagaagctttctacctttcaactcatcctaaatgcaataaagaggttggtggcgaccatccccctttccattaatagaagtgcacacacagacacacagacaactcaactcaagagttaaactggaaattcctgaatagtgttggtagcttctgtttttcactcctgttttctctttttcttaacacacttcctctctccattatttccttctttggttaaacgtactttaaccatgtaatttacataaagaaattgggtttaatttctgcaacttgggcttctctgagatgatttaattctcttctcccaattctttttttcatatacagtttgaagagaatgccttggatcagtcaggatctacaaaatattttaaattattttctttggaataaaaattagctatgatgcataagatgtctaaaatggtcatgtgttctcctcaggtcctagtgcatggaaggagccaattgatagtaaatgactgaaactaggcaataaataccctgaagaccagctttagattttcatttatacttcaacagatcaagtcctttagggacaggatacaaacaccatactgagaatttagctgctccaagacagttctatgaaatttggcttggctgatgtttcaaccttggcgtttaaggtcttatttttatgacacccagagcttctttgtaacggcagtaataagtactacagactttccggccttcttccctctaggattttaacttctttaaaacaccaccccctgctcttctagtaaatcccacatgacagaacaggctgagaaaaaataggaagccggagccatggaaactgtgcgggtagaaacgtgtgagcgcgagggtggttggaggagaaggaacactcccctggcgacagcggcgcgagggtgctcctcggatgacgtcacgcacccaggtgacgtcacgaccgtgacatgcgggtgacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncggcgctggcgccgcggcctcttcggctgccgacccggccattcctgaagaggtgagtggcggcgccatccccccccagtgctcgcgcgtcaggggctcggcgggccagtgtttatgcgagggaccgaggcagcagaaggagccccggcagtgcttggtagccggcggggaggtggttatcggccgagtgtccccctctgtcttgtagctcctcgctacgtaaacacacacgatggcccaggggggttccccggcccccacccagatgggattggggcagtgggggcagagctggagccttttcagagggggcgaaactctgggttggagaaggtcacgcctggctgaggcttccagccctgcatccctgagatgttttcctttttgctagccggcagggacggcgtcgaggatggagcttagtggccagggcagtaccccttggtcccctagccctaggaaccgccgtgtgcgattactccctgatcctggggatgacggagcgcatctttccactctcctcactatcttccctttgcaggcccttgtccccttcccactttgctacttgtttgggggatttttcttttgaccggtttttgcccaggggatgatttttttttttggtgtagtctttactttttcagccccaaattttactgttccgaagcttttcccatcctggtctctgatccccgaataatactgtttgtcagtgctcccttgctgacccgtaaacctctatcctcatccaccaccccgctcatttctcaactgtacctacttgcttctaaccttagtttccacggaagagcatttttgctcttctcttgccctagtccccttgagtgcctctacttcattccactgcaccgtcaccttgtaatccgttgttatcttcacaaatccttttggacactttgcaagctattcactccctgaaccccaaagctgtcaagattccatcaggtttcacttggccctttgctcccttgcactgctggcagtttgggttagtctttcagtgcacatacacacctcagttgatatccttcgtgggtttgtttgtttgtttgtttgtttgcttgcttgcttgcgtgctagcttgtttttagtgggtttaagtgatctggctcgctcccattttcgtcccatctttcgtgtttaccagtctttagtacttggcttttggtagtccttgtatcattcaacttattacattgtcaaattacctaatttattctcttttctctgtatgtaaaacttactacatttaccatttgggcactgtatcgcataaacaataccatatcttacaaacaattggctagaatacggtattttacaaacagttgtcgagagtgacttgtttctgttgattttacttgaagataaattttgtttaaagataaacttgctacttaagtttcccagttctcgtactacctccttatctctacagtgttctttttcctgcttcattatatttacttgggatgttcatcctccactctccatctatcgttagcagtctgtttgcaataatgtttgttttccatcttttgataccatctctacccagaatgtgttcagtaccatcatttgagccaccctacatttctcacagttttttttttttcttatttcttaatttgaaataattccaacgtaccacttgaattcatgctcaggtcagtttccatttgcatttatttccctcggcttcttctccagtctaaggataacactctttccctcatccctttcctagctcccttatccctagttaccatccattccgtcttgtttcctggcttttggtacttcacttgctgacacttcctcttgtcttccccacacctccacattccatcttatttataaacaactttgttccgttgacatggaaatttatttttaggatacattgtttttaatggagaaatgctaggggtcacatctgccgtctattttctccaggaatcggatatgcctttgtcttactaggcacaggtgtctctgggttttactatgctgcacatgcttggttgtcttgaactgtatagatgtgtgaggaccaggatccaagtatgggcaggttgatggatggagttagacaaggataattctgggatgtgacactgacttgagaactttgcgtcagggtattaggacagttggcatttctgtttggaagattttgctatttacttgggagagctagagcactggggtgggtcccttaccttggcccctcctgtcttctttctgaagtagtgagtattagggttgttactttctgtttgacactttctaggcaatccccatggaccacactgcctgaggacctctaggctagatgaagttaaattaaatcaccaataactgaaggcatgtttgtatctcctgaaactgtattctttatttagttaaaagcagatgtttcccattgcccccttcccagggtttaatgtttgatgatgctataaaaagagaaaatatgacaaatatacataacaaaataaattcttccggaaagtagtatggtggagcccaggcttgtcagaaactctgtgtggctgaggctgtagttaaaacttctgatccttctgccacttcttaaggctggaattactagcatgtgccctctacccaacaagtttaaagttaacatcaactcagaggaaactgaagtatcctgtggtcttttaattaattgtcttttattatgaacttaaaggaatatctttagttactaaagtagatggaaagatgaaaatctgtgaatgtgtttaatgacattttattatacatttttatcttacctgggtttaaaaaagtttgtcaaagagaaatttcagctgtaccaaaaagtaattacaaaaggaaaacatatccattattgaaaaattagggaaaaagtacaaaaagtgcccataatatataattgctataaatatttgcatgtattacaactagtgcttgcacaatgcattttatatatagacttgtaacttttgaaacaatagtacagcaaaacttatgtgtccctacataaagtatcatttaactgataacttttttggacattaggttattattatttttagttgctgttatcaagcatcttcgacatagaatgtagacatttgtatgtaaaattatgttcgagaataaacagatttcatggcctatttgtattactatataggtttccaaaataaaatattctgataaataacaagagtttactaaatgtttattcagtatcttataatcttactgttaagcatttaattctgaccatttatatttccttgatggtacttttttgtgactatatggtaaggcatggcacatggtataatattaccagatggttaataatgtatgtattatttaaaatgtgtgatacaagggtgtgatatttattacctgtgcctttcatgctgtgttttcagagaagagagtttcttaaaactgtaatgcaattgcaactgtattattttttgttttcaagatctcttagccagccttggctaagctgtataattataataatgcattggctagggaatattctaggatgggatctactttataatgaggcccactgtattaaaatacatctttgtgaaccctgccaggttagattgcatcatacctctggaaagtggtattctcactaaggtaagaaggtgtgtgtgtgcacagtaaattttagctgttgctattaatacttgtctaggtatatgcaaagatttcctttggagggggaagctatgaagtggcttggctgtcttcagcatggctgtgttccttcctttctgaacccatttctttttcctgacttaacaccttcctttaggcatccattcacccttttatttaaaaagagttatcttgtatcagttgcttatatatgctggcaatctattttaagtcgaccaaaaggaatgttggactggacacttggattatggaatgtcttaaatgtaattgcagatttgatttaattgtgtttggaggccagaaagattacagtagtacagcagacgagagcaatcagactctgcttgtttttctctccaccgttttacgatcaggacaaatagtctaatggcagctgaaaagccatgttctcagtgacaaagaagaaagtccgtgttgctttcactgtgctctggtgttttctaaggcttgttacctaccaagtcacacaatggagccgagcgcctgctcattcttctttcccctttatctccaatcataaacgtgttttctcctttagagctgcagaaatgtgttttgtttcgttgacaacttaatattgatttaagtgagtacttcgtgaacctcttgccataatccccttcgttttagaaatcttgtttgctcctattcctggattcctgttaggataagcctttttgtcagcagctcttgctagattttgccttcctcaaaagttaaattgtttgcagtcccgtattctttcctcttgcccagttcacctatgctggttcttctggaaagccccagttatagatcgttacagaacttcggaattcagaagaagtgggcctgtcggaagctttttctagttgttgaggtcatgctgtgctttctttaccatagtgctagagatcacttcatgttagtgcatcaaggcatgcatccttgttggctcccacattgcttttttaaacattttgtagatgcaatgacagtcttgaaggcagggaatggttttttgttttttttttttttggtttttttttttcagtctttactaaccaatttgctagcatacttagtgagccatggtagtcttaagcaacttgacagtctatacctaactttaggcagttatttctttctccctctattgttatcttgctttctgtgttttctcttgatctttatttttatttatttgtttgtttgtttacttattttgagacatggattctctgtgtagctctggctggcctcaaactcagagctccccctgcctctgcttcccaaatgctgggactaaaggtgtgcattaccaccgcccggctttctcttgatctttagttagtaagtaagtaagtaagtagataattgttgttgttacttccaatatcaagactattgactatgtagtatcaagaaattgatgccaagtaattttaccttcctccctgggccctgtgattgccttatacagaatgtaaaaattgttctgagctcactaagctttatttcttctgaaagctccgtaatatcaaatcaaacctcattttcattctttttttttttttttttttccgagacagggtttctgtgtgttaaccctggctgtcctgaaactcactctggcctcgagctcagaaatcctcctgcctctgcctcccaagtgctgggattaaaggcgtgcgccaccactgcccctcagtttcattcttactatgcagctagttattgacagcacttctggggaagatgtaccatagtacgatggtttcccagtaactccagtgctacactggctgaccagtgggccctggggatccttttgtctctgccttccagctttggcagatgctaggaatccaaactcaggtctttgtgattggcaaaaggaattttacctcttgttgagcccgctccccagccccggagttactttaataagttcttgatggtacagtttttgataatgtataaggaatttaatattcatttttaaagtatcctattttctatgaaggccacatagttgtttttataactcttttggtggtgttaaaagtactatcttgctgggtatgatgatggtgcataccttcaatcgcagtcctcaggagttggggcaggtagatctccgtaagtttaaggccatcctggtctacacagtaagttgcagaacagccagggctatatagagtgatcctgcttcaaacaaagcaaaacaaaaatactattttaattacttccaagtaactaattggtttcagcttttgtttctctgtggggtgaaggggtagggagctagaggagtgaggaggcagggaaccctgggctctgtatgtcataggcacaatctgccatgagctgtacccacattctcattcccccagcatattactctccttccagagctcatcaggtagggaacagaatataattcagagaattcaggaggccttacacaggggtattctaagctgttggaagtatccatttctcttcgtttttatgtgattgcctatatttcatccatagagtcttcctacacatggcttctcatattagcagaaagttatacaattgcaacagtttctttatatgaatacataattcattcacagcaagctttttgctggcacctcttgatcttcccccacgcctccgtatgctgtgcgctgcacttctgttagtccaagtgtggcttagaagactgccgtgggaataaagtgaggtaataaatatgtaaaactgtcactagtattttttctgctgatttgcaagacaaaaggtacatataattaagacgtttcttccagaaatctttgttgtatatgtttgttttaaatgaaatccagcaatagacaacttaggctctagttatgaaattttgacagtccttaggattgatctaaaactgagtgatgactacattctgttaatgttgtcttgaaactatctttgaatccaagaaatacaaagtggcaacatattattgacttactggataaacaattcaaggataagaggattaatgcgatagtacaaggtctaactatgtttttatgggtgataaactgactgtgctttggcattttaaaaactttgatgtaatagctttgctggcacctaaaactacattgctgacttttgcattgagttatttcatagaaaaaaattcttatattcagtaaatacttgagagcctacaatatgtcaggtaatacttttgaaattaggaatgtatttcaaaacaaaaatctgtatcctttatgtagtttttttctgacagagaggcacatgttaggatttgtgggacaacaaataagctcataagtagacaaaaaggaaatctgtagtctggctgtggtagcacacacctgtaatcagttctgatgctcaggaggtggaaggaagaggatcaggtgttgaaggctatccttggcaactctaggcagtttgaaaccagctggttctacgtgagactgtttcaaaaaacaaaatgaaacaaagccaaaaacctgtccaagaaacaaaagtatttctttaaaaattatttttgatgtattttatgtacatgagtgttttgcctgcgtgtatgtatgtgcacactgtatgagtctggtgctaatagggatcagaagatgtgttggatcccttgggactagagttacggatgattctgagcttctgtgtgggtgctgggaatcaaacctatgtctctgtaagacacaaaagagcaacaaaaattcttaaccactgagctgacaccccagaccctctttttaaaactgtttagagtctcactatgtaattaattaaggctattttagaatgtgtgctctgaacccaagctgtccttgaacttaagatagtcctgcctcagcctcttgagtactggagctaaagacatgcaccatcatgcctagcttcaaagaggaagttatacagtatgtttgaagatactaagttcagtggaaaatttcaaggaaagcagagtaggcctgggaaggtggactgaggtttaaaacaagggagagcaaggcagacctcagttgtagaaggtggcattcgaacaagagttgggagaaagaatgagagtgcattcctgtagaactaacacacttgtgtgaagaatgtaccttgcttatttaagaaatagtaagaggccagagttactggaataactcaaaagaattgaaagccagtgggagatgaaattccagagggcttgggggcatggcccaaagactgttgtaaaggagttttaacattttaaaggaaaaggaaagccctatttaagtttcagtagccagagctaagtgatctgatcgaacaggtttgtgtgtttatttgttcatatgtgcatgcacatttgtatgtgtatgcacacatgtgtgttcatgtatgcatgtggaagctggaggttgatgtcagctgtcttcctcaattctgtccaccttattttttttttttgagagaaggtctcttagtgaatctggaacttagtcatttggctagactgtttagccagcaagtgtcaggaatcctctctattacagggagatttcattatggacagtattggctgtctaaactgggcaagtactttgccaacaagccccagttcttctcacatcttgataggaatgctttggttacagtatagagaatagactaacagacaaggtaagagaactatggaggacagagtcgtatcaggagagcagataaaggggtcagattttgaatggtttgaaagtagctcaaatctgatgtgttttaccctgcccccagtaacagtggtggtgatttaacccaaggcttcacatattctagcagaaattgtaccactgcaccacatcataagcccttgggtttgttgatagactgaatgtaaaatgctggggggaaaaggagagagagatgtcaatgggaaagagaagacccaggtcaggaattcattgtgtgggatgctaagttagaggcagatagcaaatgctgtctaagattttgtataagtaattagatttgtgactctggagttgaaacgaggccctggggcaaatactgttcatgatagccatattttattttctttttcatacacagcaagttagcatttttactttgtagttaggtaggtgtgatggtttgtatatgcttggctcaggaagtggcactattaggaggtgtggccttgttggagtaggtgtgacactgtgggtatgggtttaagaccctcaccctagctgcctggaagtgagtattctcttagcagccttcagatgaagatgtagaactctcgactcctgctgaaccatgcctgcctggatgctgccatgttcccactttgatgatattggactgaacctctgaacctgtaagccagctacaatgaactgttcttataagaggtgccttggtcatgctgtctgttcacatcagtaaaaccctaactaagacagtaggtatgatcaaagaattgggttccagttagtaggatatggacacaactgatgtgtgccatttctagatgtggcacatataaatagcctccattctagctgggtattgatggctcgtgcttttaattaattctagtacttgggaggtagctgcaggcagatctctgtgagttcaagggcagccagggctacacataggaaccctatctcaaaaactttcatttgagaatttaggctgatagaaaacttatcatttttaaaatggcttggaatgaaggtataatagctatcattccagtcccagcaaaggggagggagcatgaaatagaatgaaggatatttgttttgtttttgagatagggtttctgtgtgtagccctggctatggaaatatagaccactttaataactggttgaactatgtattattgttttaaaaaaaacctaggaaatagacttcagtgcattccttttgtgtattatagcagttgtgacacaatcagaggacaatacccgtactctggttctatgccatttaaaccctccatcattcagaattgtaaatcaaataactcttttttactttaaaattattcacctcaagtattttcttatagcacaaaattggttaagagatcaagaactggattgggacaagtgagggaaaatagaatcaagaaattatgtttttaattttaattaattatttttgtttgtttttgttttttgttgtgtctgtcctggaactcaatttgtagacgaggctggccttaaatcctgcctgtctctgcctcctgagtgctgggatcaaagcagtgcccttccacctaattaattttttaaaggtttttgagagaaagaattgttctatggttcaaattgacctcagattcataatcatctttcttcttattgtaggtgttggaattgtatgcatgtgttcccatatagcctcaagcaaaaataaattttgtttggtgatgaaaatcataaagttgtaagaggctagaaaggaaatattagagcaaaacaccaactatttcaggaaggataagaactgctgaagcagtgtttctgtaagggcaaaaagaaaacagggttagtgtataagtaggaaggatggcttcaatacgatcctctaggataaaacaatacctcagagcctttgacagtaatctgctcagggtctgtttggctcgtgtcaggcgtcgtctcagagtagaaagtttcatcccagaggatcctgatgtttcaggggaagtgagtgttacaattcagcgcagcccaggagagaagggagtagaacagatcgtaaagtgggtgcgcagtgttaacctaggagaagctaggcagcactgtggcttcctaacctttgctgtcacatctgcacggttaaatgtaacttgacaagccagtttaaaggctcggtatgagtcactctcattttgactcaaataaaacatgaattattactgcatgaggtatctataactcttctgtcatggctttaagcaaaattgtgagagatttggtgactgatttttctttttacgaaaatttctcttctgggagtggtaatgtacgcctttaattccagtattcaggaagcagatgcaggtggatttctttgagtttaaggttagcctggactatgtagtgagttccaggacagtcaggactacatagagagactctgtctcaaaaatgaaaaaagaaaataaaaaaaaaagaagaaaagaaaaaaagaaatcctatattttatgtagagcagcatccttatcattgcagtttgtcttttatgctgtgcagtgaagcagttccctgtatttttaaaaattatttatttatcctatgtatatgagtacactgtagctgtctttagacacaacagaacagggcaccagatcccattacagatggttgtgagccaccaagtagtcactgggaattgaactcaggacctctagaagagcagccagtgctcttaaccactgagccatctctctagctccctttcctgtacttttttacacttcaaattgtacttggttttgtttacacttttcttattgcccgaaatatgaatcccacctctcccctctctgccctccaaacctccatgcttcagtgacctgccatctactgtaggaagtatccttaatcccctcctaagcctgcccaattaggtgcctttgcggcagcatcctgtatcgttttattcaccatattgcaagtttgtttttatttttgttttcacttatcaccttcctctagactaacacttgtcagtcactgccagactttctataatgttgaaagtgtgctttcttgcccagtggtaagctgctgctcatctgttcattcctttgcctgacagcactgatgcactaaatttatgtaattttcagattagacagtctcgtgtaatgaggagctgttccatcagtgctctgtgagagcattttatttctttgcagttttatttttagatctttaaactaactcactctctttctctctctctctctctctctctctctctctctccctctctctctccctctctctctctgtgtgtgtgtgtgtgtgtgtgtgtgtgtgtgtgtgtgtgttctactgtgtggctgtaaaggtcagaggacaactttatggagttaattccttatgcctttatgtgggttccaggggtttaactcaggatcctaggcttgtgcaccaagtatttacctgatcccaatgctcttaatccaaagagctagcactaatccggggtgtgctagtcttcttctccaaagttctgtctttaactgtagttttccagtttgttctgaattgtgtcgatttatgcagctcttaaattcttctgtaatgattggagttttgtgttgtaagaggttcagcttttattaagtgctctttaccattctaagcctggtgtgtgacacatacctgtaatcttagcaacatgagaaaatttagttaggagaatattaaattttgtaccaacctaggctgtttacagagtaagtttcctacccattctggattatccagcagtcccctttctcaaaacaaaaaggctccttgggttgatagaatattttaatcagttgaggacccaaggacctaagtttgatccccccaaaaaacaatttaaacccatacatgtgaacacacacacactttttcaaaggaccctagcacacttaccagcaatcatgtccaagcagcttataaccacctataactctaggtccagggggtttggcaccctcttctggcctccaaggtaccttcactcaggtacatacacatccaacatatatacatatttaaaaataaacctttttgtaaaagccaggtgtggttgcttgcattcagtcccaaaactgaggaggcagagaaaggtggatccctgagactcactggtcagctagcctgacctacttggcaatctccaggacatgagtgactctgtaccagagaaaaagtgtgagtgatgcctgaggggcctatgcacacatacgaaggagttctttccactttagaaagtctcagaattgatgacagcaccacttacacagtatttgtgactgaaatggtttccatggcagtctgaagttgtgtcaacaaccacagtgattctttgtataagtacaagcaactctcatttatcataatcacctgtacattcttgacttatcttcttaaaaatttatttttgctgtagttcatagtagaattagcattagtagatattactagctcttaaaattgtatccagctaaattatctttgaaataggatttacagcagagattggtttctgtttttataatgatggagtgggctttgtttgttttaggctctgtctctcgtaggccaagcttgccctaaacctactatgtagctatatctatctatatctatatctatatctatatctatatctatatctatatctatatctatatctatatctatatctatagcttacattcttccttttgagtgctacaagcatgtgctaccaccttggtaggaatgttattttaaaagaaaagaaaaagaaggaaaaatatgaagatctgaaaagatagcaagaaatttgctctgccaaaatctaggaaaaagcaccccttccaccccccaataagtagctggaatcgcttttgtcttaagggcagtgtgctggttagttattgtcagcttaagctactcaagtgagaaaatgctctcatcggattgacttataggtaagtcgggggggggggcgcattttcttgattgatgtttgatgtgggagggtgcagcccactgtaggacagatggtcctggggtatataacaaaataaagtgagcaagccaggaggaacaagcaagtaagcagcattgcttcatggcctcttctttagttcctgtctccaggttcctgcctagagttcctactttgtttcccctggtgatgagctataatgtgtgaacaaaattctttcctcccaaattgctcttgcagtagaataggcagtgtgcatgttttagctttggtgtcagtggacttcataaattgaagagtacaaaagtcaacacctaaagcttatattaagtgagagtcaaagacagtttcttttaggtaggaccctgaggattccttcattaggtttgcctttgaagtagaactaaattatctactaagtcccacatttcagaaatgtgagactctagagaagcttgattagaacagaggaatcaaaaggaaagtaaaaaaaaaaaattgtgactattggtttttccttcatattgacttttagagcagtttttgtttgttgtttggtgtgtgtgcgcgcgcgcgtgcgtctttgcatgcatggtatttggtctgagtggtcctgtagctcagaagctctttatcctagttcctagttgcagagatagtactcgtccaagctttggtggaagaaaagggaagtcacctgtggagaaaggcccgcccttactagggaattgttactaataatttttctttttaaatttacttattatttatttttaatcttctgtatatgtttgtgggtctgaaatgtgatacatgtgatgcataccgtgtgtatatgagtgcttacagaggccagaagcctatatcagatgccctgggactgaagttacacacagtgaccttctcctacccatgtgggtggtggatattggaaactaaactaggaacctctctgcaggagcagcaagtgaataagctaatacattgttaaaagtaaccaagaacagttttaaaagaattaagcaaaattgcacgtaagaaaacacatattctgagtcaaaaaaggtcttattacagtataatttaagatttatgtaattctccttgaatatatacctaaaggtaattaaaacaagacaaggcagtgttcactgtgtagccctggtgttctggagcatgctgtgtagaccaggctggacttgaactcaagatgcccacctccctttgcctcccgagtgctagggttggaagtgtgcaccaccacacctgactccctcaaagtaaactctgaaaagaaaaaacactaataaaaaagcatggattcaaatgccagcgaatatggcagttaccaaatttaaaacaattgctgattcattttaaaatgaagataaactataaaaatggcttcatatatttttagaaaaaaaatagaaattctggagatgaaaattatcatgtatcaaatacatgagaagcttaacagattatttttgggtgaagaagtggttgcttagaagataaagctgaagaaatatcaaattaagcctacagtcaaaaagattgaaaatgctgaagagagcataaaagataagaagattgggaggtgggttggagtctaacattcagtcagtgttccagagtaaaatattgcaaagttaatatttgaagagtgggttctgagtgaaaattttctagctctagtaaaaaccagctgacaggtgtaagaaatgcactgaatttttaacagtataagaaaaaacaagtctatacccagacagatcatatagtaaaacaaggagaaatcctgaaagcagtcaaagaacagaaagacgtcctttaaagaagcaactctggggccagggcagtggctcagcaagcacaggcacttggtatggagcctgaattgagagaaggaaaagaacagactcttcactgagctctgacctccacatccacggcatggcagcatacgaatccatctacacacagacgataaataaacataatgaaaacattttaaatcgaagcaactatgagcaagcaattgtcaatttagaattggtaaatatcaggagtacaaatgtagttcaacgaatcatcagccctttgaaattatgaagtacataattaaagtaaaaagtctgagatgcaaggtggagtgaagagcaaagaggagcatgcataagtgataattgcataaagcactaaagacccttaatggagatatacaaataaaggcagtgttctaagacttttatttgggagaaatagcaggttttccagagtgactacctctagtcaaagttgaactgtgcattggggatcttgtccttttgtaggaccaaacaaaccatgaaacaaacaaacataagaactggaagggtagtgaagcctagcatgggctcagtcctggcaccacagaagatggggaggaaaggaaatagtgtggtgtctgcccaagtgaagatcagaggtggagggagtatcaggggttttccatagcatttgtatcaagtgaattaatagtaagacaatttctttgttatatttgtactgttgacacagatacctccaaatatggaacacaagtatgctttctttaatttatgtctccagttctactaatttagtcttctagaatatcacagaacaatctttctcttctaatttcttatttttgtactctcattatttagtaggtaggcacacaagcaaatctttagatatgccttgacactggtaacttgagtttgccttcatgtgtatatgtatccaggtcaccccaactccaaactaaaaatacctctgcttgactttgctcctatccttttttttttttttttttttttaaataaccacagaactgaagatgttgtacatgccaggcatggcctctcttgctgcttttgtcatctgtttctgattacttactacctgcgcttacagagttctcacttagaacttacttcttgacagtctctgtgtttcctaccactttgttcttttaaccatcaggctacatgtgcactgtaatgagtatctgcctgcgttttctgtatttcttggtcttagttatttgagtgtttcactaacatcacaaagtcagcaattcagttctagacccagttatctttgcctttaagttgaatgaatctccctgtgtcctagcaaacttatcacttagtagaatttacgctggatgctgcatagtaagtttctctgttctgcggtcctgatttcactatagagtaagcacccaaaccctttgactcaccatctgccctgatgcttctattttattcatctcaatcactctagtttaagccctgattatttttctcttaagacccttttatttttgttttgcccatagtttacttctattttttgatccattatacctattttctggtcagtcttaagctttagctattaaagcttaaggaatttagtaacatagtaacaaacaccctgttgtttacaaattaaacaaaatgtattcaccttcattcactccgcaaactttcctgatctaataatcacagtcccgtctgtctttgttcgtcttcctgtgttttattctgggacaaaccataagaactttagagttctgagcatgctgagctctcctgtgattgatttactttgtcgttttgtttggtttggtttggattttctagacagggtttctctgtgtattcctggctgttttggaactcactctgtttcaaggctggcttgaaactcagaggttctcctgcctctgcctcccaagtgctgggctcactgcccagctattttctttaggctttgctaatatttttaacacaaggaggactagaagtagagtaattctgcttaaaataaatctttcatagagtattatttggactacagatttgttattgaaagagaagagaatctactgctgaatgctcctcacagtcagctgatcttggggagagagggatgaggctctaaaggatcttgtggacatggattttaaagtgtagcctgtagaatatctgagaggcttataaagagaaaagggaagatgaatacaaaaggcaaatagtatgcagaaaaggttgtggatggactttatatgcttatgtaggggtactgacttgctgggacagtttcctactctaaggagatggctcagcaggtgtactggctggttttgtgtcaacttgacacaagctggagttatcacagagaaaggagcttcaatggaggaaatgcctccatgagatccagctataaggcattttctcaattagtgatcggagggccccttgtgggtggtaccatctctgggctggnnnnnnnnnnnnnnnnnnnnctgctaatatgagaacccatgtgtaggaagactctatggatgaaatataggcaatcacataaaaacgaagagaaatggatacttccaacagcttagaatacccctgtgtaaggcctcctgaattctctgaattatattctgttccctacctgatgagctctggaaggagagtaatatgctgggggaatgagaatgtgggtacagctcatggcagattgtgcctatgacatacagagcccagggttccctgcctcctcactcctctagctccctaccccttcaccccacagagaaacaaaagctgaaaccaattagttacttggaagtaattaaaatagtatttttgttttgctttgtttgaagcaggatcactctatatagccctggctgttctgcaacttactgtgtagaccaggatggccttaaacttacggagatctacctgccccaactcctgaggactgcgattgaaggtatgcaccatcatcatacccagcaagatagtacttttaacaccaccaagagggatgccgggtggtggtggcacgcacctttaatcccagcacttgggaggtagaggcaggcgaatttctgagttcaaggccagcctggtctacaaagtgagtgtcaggtacagccagggctacacagtagaaaccctgtcttgaaaaaaaaaaaaaaaaaaaaagaagggagggagggaggaagcaagcaagcaagcagagcaagccagtaagaaacatctctccatggcctctgcatcaactcctgcttcctgacctgcttgagttccagtcctgacttcctttggtgatcgacagcaatgcggaaagtgtaagctgaataaaccctttcctccccaacttgcttcttgctcatgatgtttgtgcaggaatggaaaccctgactaagacagcaggtaagggcatttttggataccacaaggtggccaaagaccaatttatgagagttgtcttctgacttccactcaaagtaaacaacaatctcagaaccttccaactccattttgttacttaaatattagcttctggtagattaaattttaaaaaggcaaagctgaaagtaaatgttgtataaaattaacagagttggggactgaaggaagagatgactcagcagttaagaatactaattgctcttccagagaacctgggttcaagtctaagcacccaaatggcaactcacaactgtaactccaatcccagagaatccagtgccctcctctggcaccagatatgtatatgatgcacagacatttacgcagacaaaaatgcctgtgcacacgagtcaatcattttatttttaaataagagcataattttatgagctcaagacattcttttggtttgtagtgctggagatagattcttgggccttaagtatgtactgtactgttgaggcatgcttctagcccaataaagaacttttttttttttttttggtttttcgagacagggtttctctgtgtagccctggctgtcctggcactcactttgtagaccaggctggccttgaactcagaaatccgcctgcctctgcctcctgagtgctgggattaaaggcgtgcgccaccacgcccggcaataaagaactttttaaatgatttaaaacctctaccacacacaaaaaaaaaattgatataatgtgaccacattagaaatagagggccagagagatggctcaccaggtaaaagtgcttgttgtgcgagtctagtaacttgaatttgatctctgggactcaggtaaaggtggaaggaaagaccagatgccagaggtgtcttctgacctccacatgcgcactgcagtggatggactgcagtgtatatgcttatccacaccaaaagaaagaaagagaagatagaaacttctctttataaataccttattaaggggcctgagaggtagtttagtgcataaagttcttgccatgtgtggtgttttaaataagaatagcccccattcatgtgtttgaatgctagtccgtagggagtaacactgttaggaggtgtggccttgttgaggaagtgtgtcactgtagaggtgggctttgaggtctcaaatgctcaaactaagactagtgtggcagtctcctgttgctgcctgcagatcaagatgtggaactctccgctccgctcctgtgtctccctatgagccaccatgacgataatggactaaacctcagaaactgtaagccagtcccaattaattaaatgttttccttattaagagtttaataatttaataattcccttcacagcaatagaaactccttttttttttaaagatttatttattttatgtatgtgagtacactgtagctgtacagatgtttgtgagccttcatgtgtttgttgggaattgaatttttaggacctgcttgctctggtcaacccggctccctctggtcaaccctgcttgctcagtccctgcttgctctggcccaaagatttaattatttattattatacataagtacactgtagctgtcttcaggcacaccaaaagaggacatcagatctcattatgggtggttgtgagtcaccatgtggttgctgggatttgaactcagaacctttggaagagcagtcagtgctcttacccgctgagccatctcatcagccctagaaactcttaagacaccatgaggatcagagtttagattcccatcatctctttatataaatgcctaatggacatggcagtttgcctacaattccagcttttgaaaggttggcatggaatctccagaacaagcaggctagctaagtgagcaatattgatgagcaccgagttccattgagaaagattcctgggctggagagatggtgcagcgtttaagaggaaggttgctgaggtcaacctcaggtctctctctatatatacatgtaccaaggtacatatgaacaggcatatatgcaggctcacataccacacacatattcatgcagaaacaacccccaccttattaagagactaaaagacaactgttgtgtccggccagcagaccacaacctgggttctagcctggaaaggcattttggaaacctggaagagaagaggggctaggtggcgagagaaagaaatgcagctaagacaggctttctgatcaaagctcaattttactgttctgcacgcagttatgaaggaaggggaaggggcccgattcccgccaattagtcttggagtccaatagcagggtgaccatgtgcacagctccgaacagcaaagcggcaggttctagcagtgggcatggcagaacgattgagcgggaagctccacccctgagcaagcaggtttcaggctgggggaggggagactacagacaagataagtgaagattcttgcaatccattagttaataagttcttccaaaatttagtagcccctagtattttcaaaacataataaaatagcaaacaggtcacagtttctgtggggcaggaaatcagcaacttaactggcatagctctgactctaggatctcacaaggctagaattaccaaggatgtaatcatttcaagtcttgacctagtgacagtcttctcccatgtttcctgatatggatatagcagactgcagaagacccacttccagatttactcacaagggcctcttcatggcacaacagccagattttcagaagagagtgaaagttttttgtttttaagatttttttaaaattttatgtatgtgcatacactgtctatctcttcagaaacaccagaagaaggcatcggatcccattgtgagccaccttgtggttgctgggaattgaactcaggacctctggaagagcagtcagggctcttaacctctgagtcatctctccagccctaccattgtctttttattgcttaatcttggctgtatcctgttagaagcaggttaataactcttaagcctacactcaagggattcaggtcattaaggacattttggaggattctaccaaacaaaaagaatggactaacatgaaaaatatacattaagaatcagccataggagatcaaggtctagggaagagtaatgacaaaagctagtgagttggaacaaaataaggactcagttatgtaaaaatgccacagtaaaaaagactgaggatacaaatgctcagtggtacagtgcttttcttaacctgtgtgaggtcttgtgttcaggccttaattcttaaaacaagaacaaacaaaaacttagaggaggattgagcctggggagttgggggccagaccctggctcaatgaaagccattactttgtgtgctgacctactaggttttaaagtagctatataattatgcatgagaaaagaaacgtatttactgttttctttgtgctcctagactgcctttatgaagctgggaggtgtgcctgtagagagttgtaaacagacttaccaggagcttgttgagcaaattttctaagttcttccatcacttgagaatgtgtagactagagagactcttcaaggaaacactcagcatgactcagggcatcctacaacttgtcagccaatttgtgtctgttagagagtgttgtctgctgctcagtggcccaaatgcttctggatgccatcagagctggggaggaaatcaggtgctcctaccttcatttggagagggcttaaggggtgagttcccttgctcagccgtttgttgtattgttttctgtttttgaggcagtcatgctttatagccctggatggcctagaacctgtgtagaacacggttgtgagctaccatttgggtgctgggaattgaaactaggttctctcaaaggaagacgtgaccactattttattaaattgtattatattatattatattatattatattatattatatttttaaccactcttaactgctgatccatctctttagccactcttgttcaaccatttaaaaggctaatgaaaatgttcaccaatgagtagcaaattagctatcctaattctaattattacttactattatcttgactagaaagtaaagtaatgttattgaggaaaatcactataaatcactataaaatttttactataaatgtggccaagaggaatgatgcaaactgtaatcccagcccgtggaaagtcgagacttattgggatagtaagacacccccctaatccccactctgaattaatcaaaaatagagaaaagaaaaaagtgcttggggagatgttcagtgggtaaagtgcttgccgttcaagtgtgaggtcctgagtgagtttagttcagtcataccagtgtttgagggtgggggagatagatggatcccaggagcttggggctatctagtgtaactgaaactgagaggttcagtgagagactgtcaaaaacataaggtggagagcaatagaagacacacagctcgatctctggcctccactccaatgcacgagcacataccacacacacacacacacacacacacacacacacatacacacacactacatacacaaaaaattaaaagtggtctttacatcttttcacagctaaaaaacaaaaatcaaaagaaaatgcagtaggtaggtagataggtaggtaggtagataagatagaaggataggacatgaccagtaaacattaggaatgtttttttacttcaggaacaatcaggaaaattaaaacaataagactattttatatagattagatttgtagaaatgaggacatctgacaatatagatattggtgataatatggagaagtaggggtttctttgatttctagtgatagtgttcattagaaaactaacttaggtgacctacaacaagcaatacttcctgtagacagttatcttactccaactgttttcaagcttgaatgtgcataagaattgaaattgttggactccactcctacagtttctgattaaagaggacttgggtggaaactgataatttgctttttaagttcccagttgatgctgatcctgctctcaacccctgaatcctgctttgtgcttcaatcttttccctagagcagtggttctcaaaccttccaatacaagccttcaatataggtcctcatgtggtggtgacctccaaccataaagttattgtgttgccatttcataactaattttgctactgtttaatataaatatctggtaggtgactcccaaaggtacggtgacccacaggttgacaactgctgccttagagaaatgaaagcatatatttaagaaggcttattgaggggctggttaagagcactcagcggttaagagcactgactgctcttccagaggtcccgagttcaattcccagcaaccacgtggtggctcacaaccatctgtaatgggatctgatgccctcttccggtgtgactgaagagaccaatggtgtactcatatacataaaataaatttaaaaattaaaaaaaaaaaggcttattgaggtcaggtggtggtggtggtggtggtggtgcacacttttaatcccagcatttgagaaacagaggcaggtgtagctctgagttggaggccagctggtctatagagtgagttccaggacagccagggctacacagagaaaatcttgtatcaaaaaccaaaaccaccaccactaccaacaaagaaagttgattgctattaaccaccaaatacaaaaattcagacactcattagtagaataaatacatatttgtgtgcttacttagtggtatattatatatttaattacagaatataaagctagttcaagtagattagaaatacaaaacaggaaaaaagcccatggatttgaaagagaatagatgtgttggggtacctgagaggtgttgaagagaggaaagggaagaagggagatgtaattgtattttaatctcaaacaaaaagttaaaacaaaaagatatacaaatcttagtcatctcttgtattagtatgtatgaatctcacaagtatattagtcaggtattagaagatatggtggtgtgggtttgtaatcctaatgatggcaagatgggaggcagagccttaggtgaatgacatctggaactctgagcacttcagatgcttacctgtaccacatgtgcacacctctctcgggaatatcacacacatacatttacaaaaaaccaagatggaattaatgatgttgtttaggaatgcaaatataggtaatagaattataagaaacaaattgtcagaacagtgtgtgatagtaatcaactcatgggaagcaagattgtcaaggccagtttaactgctaacagagggtttgttttatagttatttaaactaacatttttataaacttacgatctcctttttatttccacctctgattacttttaaggtcagatttggttttgtgtatttgttagcctttggatttttttcttttattatttgtggacatcttaggttgagatatctgttttaaaattttattttgaaggaatggtttattgtggacacaatataacttatttgtctttttatttagaattcttttttgtttctttagaaaatttgctccctagtgttacattatgttactatgttgcatctgatgaatttaagtttacaaaaattatgcttttttaaaatttatgcagtcttgtgaagatatgaagctgtctggggacatgtaattatcctaacaccatgtttgcatatgcatatgattttgttctcattgatttgtaaagcacccttgagtatataccagattctgtttgtcttttaatagtgtcatgtccacattactattctttttttatatagtgtcttggtttttgctaataccagcctctttgttgattttgtgcaaatctatactaacttactcttcatgagaccattagaattaagttgtgaagatctacacaagtccttttgggattgttttagattttaatactgtgaagagaaaccatgaccaaggcaactcttataaaggcaaacatgtacttggggctggcttacagtttcagaggttcagtccattatcatcatggtgggaggcatggcagtgtgcaggcagatatggtgctggaggaactgagagttctacatcttgatctgcaggcaccaggagactgtgtcacactgggtgtagcttgagcctaggagacctcaaagcccatgcccactgtaacacacttctccaacaaggccacaccccctaatagtaccactctctttgttttgttttgtttttttaaagatttatttatttattttatgtacataagtacactgtcgctatctgcagacacatcagaagaggtcatcagattctcattacagatggttgtgagccaccatgtggttgctgggaattgaactcaggacctctggaaaagcagttggtgctcttaactgctgagccatctctccagcccagtaccactctctatcagccaagtattcaaatacatgagtctacaagggccatacctattcaagccatcacaaggattttgattgtaattttatatgttcatataggttgatttataactaaaattcagtttcacaactcatgaacatggtctttatctttacttacttaagtgtttggtttttttccttaataggttttacctttctatccagtgctcttcagtttggatgagggtgtagtttttattcttttaaccttttgtgctgttgtgaatgagatgctttaaatacttatttttattatcatttgtatatgtgtgtttatgtgagtttgttatgtgcagatacccaaggctgtgagaatatgtgtcagatcttctggacttagagttataggcagttttcagcagtgggataaagtcacttcctctgaagagcagcaagtgttgttaatcacagagtcatctccagtcttgagataataaataaaaatagataataaatgaatatgaatgaatgagtaaataaaaattaaaaaataggggctggtgagatggctcagcggttaagagcgccgactgctcttccaaaggtcctgagttcaaatcccagcaaccacatggtggctcacaaccatctgtaacgaaatcttatgcccacttctggagtgtctgaagacagctacagtgtacttacacataataaataaataaataaataaataaatattaaaaaaataaagttgtatggaagaagctgttgagtggctagcacttggattttatatctagttctgatacagtgcttagtatttttcaagttcactattacattgcagctacagtgtacttacacataataaataaataaataaataaataaatatttaaaaaattaagttgtatggaagaagctgttgagtggctagcgcttggattttatatctagttctgatacagtgcttagtatttttcaagttcactattacattgccaggattttaaaataacatttacatgtacaagtaatggttgttttatgtagttattattattctaatacattagctagggccttccatatatagtcataaatgatggtggtcatctttgtttttcttttcttagaaatgtatctttgggctggagagatgatggctcagtgattaagagtactggttgctcttctagaggacttgggttcgattcccagtacccatatggcagctcacaactgtctgtaactccagttccaggggctccatcacaccaggcatgcatgtggggcacataactgtacatgcaggcaaaatattcatacatgtaaaataaatatttttaaaaattgtattcttagtgactttttgtaaatttcttatagatattctatgtgaagttttagactgtttcttgatttgtagtctgctatgcagttcttctgaatcatcatatgagtattgaaattttctataccacccattatactgaggtgatcatatcacctgttgatgtaagtcatttcattattaggcatcctatttttgactaactcttggattactggatatattttattgcactgtttttaacttattttgaaagagagaaagctcatgcagaaaagagaagggaaaaagtgaaaagactaaaatgtccggattatatattaaaaagcctcaaggtgatggaaggacagcccagtccctgggctggaatatcattgttgtagatatgatattccaggtggggactgagatgcttggagaacctggaggccaggtatgtaagatatgcaactcagctgtatgttcctttgtttcttgatttgtagtctgctatgcagttcttctgaatcatcatatgagtattgaaattttctataccacccattatactgaggtgatcatatcacctgttgatgtaagtcatttcattattaggcatcctatttttgactaactcttggattactggatatattttattgcactgtttttaacttattttgaaagagagaaagctcatgcagaagcagaaaagagaagggaaaaagtgaaaagactaaaatgtccggattatatattaaaaagcctcaaggtgatggaaggacagcccagtccctgggctggaatatcattgttgtagatatgatattccaggtggggactgagatgcttggagaacctggaggccaggtatgtaagatatgcaactcagctgtatgttcctttgttccagggtctgaaacccaacaattagagctgataagtctttcagatctatctatatcttgtatagttttattctagactagagaaatgtttctctgtctgtctgtctgtctctctctctaagattgagtgtcactatattggtctgtctgtctgtctgtcctggaactcagtatgtagaccagcctggtcttaaactcacagaaatgttcctcctcctgcattctccaactttatatttcttgactgttcagtgggctttaaaagtaacctctgagactacacctttctttcaactctttatgatgatttttagtatagattttcccccaaggcatatttttatgtgcatgtgtgcgtgcattcgagacagacagacagacagacagagacaaaaatacagagtgcacgtgtgcacgaatttgccagaaggcaggcacattatgatacagaggcagtggaggagcactgcttaatggcttgctcagcttgctttgttataatgtccaggactgccaacccagaaggggcagtaccacagtgaactgggccctcccacatcaatcaagaatatgtactataggcttgcccatatgccagtatggcaggagtgttttcgcagttgaggttcctcttccagaatgactctagctctagcttgtgtccagttaacagaaaagtacaggcagttgtgagtcccgtagtggtggcactaggaaccaaacaagtcttggaaaagcaataagtgctcctaactgccaagccatcccaccagccccaaattaaagagaagaaaaggtgtgtgtgtttgtgtgtgtgtgtgtgtgtgtgtgtgtgtgtgtttgagagagagagagagatcacatgctatgacacattgacacatacttgaaggtcaaaaggattacttgactagcaaatatggtttcttcttccactatgtgcgttccagggattaaacccaagtcatcaaagttttgcaaagagtgactttacgtgcagagtcttttgaaatagctttcttctgcttccaatggttttgggccaaggcgtttattcagaaggatgatgagtccacccaaggaagagataggtgaggcttctcgtgaatgggactttagatagagacttgtttaatgatttgatacttattttcagtctactcagctgacttaatttcttttctgttattttcagcatttattcttacttactaaggaacaggtcaccaccagaactgtactcttccatcctgttctgccaaccctgagtctttaattcagtgtttcctaaggtggttctgggcctacagggaagcatttgaaatgtttgattgtcatgaattggagctgctacaggagtcagggagtgccatgcactggcactctttcatggcaagagttacccacttcaaagtgctgcttacggtctctatgaagaaccttaaacattgaactcaaattttttcttgacatctatcatccatctatttttgaggcaaggttttactttatagcctagtctgacttcgagctcatgatctctgcctcagtcttgagaggtctgggattggaggcctatgccaccatatcagacttctgaatttattaacttttaaaaatgatgttgtgtctgtgggtacattactgtgtgtgggtggggtcaagccatgatatgcatgtggaagtcagacgacagcgttgtagaattagttcactcttttcacctttctgttggtcccagagattgaactcaggtccccagactttcacagcaagagcctttactctttgagctgtctggccagccccattaacgtcatatttattctttaaagtttagttctggggcagtgaggtggctcgttgggccaagtcacttgctgccaagcctgacaacctgagttcagtctctgggtccagaaagagaaaacagactctggaaatgtgtcctctgattcccccccccacacacacaaaataataaataaataataaataaacaaatgtaaataatgatagtaaaatagtaactatttagttctagccagtcatgatggcatgcgtctgtgatctcagcactcagaatgcagaggctagcagatctctgagttttgaggctggcatggtttacataacaagttctagctagtcaggactacaaaatgaaatcccgttttaaaaaagcaaaaacaacaacaaaaacactttgattatcttttccagatgtattaatcttttggtctcttctcctccccttccccttctcccgccccacattcttcctgtttgcttggtacatcctaacatttttatgtacatctctattacttgaagtaactatcttgtagtgttcttgattaagacactatacctgtaccttactgtgagctcaaatcattgaggcagagacattttgtattcttggtccatggtatatgtaattttttttctttttaaataatgtatcctacaaataagtcatatatatatgcatatatacatatatatatacatacatacatacatacatatatatatatatataaagagtacactgtagctgtcttcagacataccaaaagagggcattggatctcattacagatggttgtgaatcaccatgtggtttctgggatttgaactcaggacctctggaagatcagtcagtgctcttaaccactgagccatctctccagcccccgaggtgtagctcttaaaagccctgctttcttagagtccattaataatcttgtacaggtatagttgtgggaaataatgaaggactcactttacacacacactgtattatttactttcctcattgttgttatttaaatgcctaacagaagcaatttaaggctgggatatagtagtgcatgccttcagtcccaacacttgggaggtaaagaaaggcacacatctctgagttcaaggacaacatgatctacatagtgagttccaggacagccagggctatattgagataccctatctcaacatcatcaacaacaacaacaaaacaccaaataaataaataaacaaaacccccaaaacaaaccacagaatcaacttaagaaaaggttttattttggctcacagtttgggcaacagtcctcctggagcaggcttggtggcaggagcttgagggaactggtctcattgcatatgtggtcagcatgtagagaccaagaaatgctggaactcagctttctttctcctttttactccaggttcctttttgattattccacaaatcaacattctatggccttagccccttgatgcttacaagaagacagcaagcacatttttaaaaaccaaggcaaatgaatacggagatctacttgtctttgtaagcagagacaataagctagctgggtgggatctggctctgagatcaccattcctgctacatctggggctaaactagctctgttctaggctgaccttgagttcaggagtctgcctgcctttgtaagcacaaatgaaaaaaaccgtacctgggtgggatctttgtctgtgatcaccacttcccaaattgctttatctccttccttaatatctttctgacaagctcactcatagtgcagctgcccattttcttttaggtccatatatatcccctcatatagccaatattgcatgcttatattgtgcataggtgagaaattatacattcttgaactcatgttttcaaagttctttctcactatcctgaaggtcacagcacttatcgttttgctaaggacatagacatatcctcaccttccagactagtgctgtctctgattattatggagtcattaatcttggcaggagaacacctcctgaggaaggagcataaagaaattatgtacattattatgcaaacaagtttcatccctggcaacccatgaacactcctggaggcccatgccctgctggctctgttccaggggcaaaccatgtcactctgtaccttttaggccatgccagactcagcatcatagagctgcagaaatcctttaatacccagaaatgttttacagtgataatgtgttggcttcattttattgttagtcagattgaggaattgagtgcttaattcagttgtatttcagtttttaacttattttctgataaatactgagaatctctcaaatgagctctatgaatgtgttatgcatgtaacacatgaataaagattgatatgtcaaaaaaccttagaggagggtcagtggaaactggatgatgcgacagactaacttctccagggtcatacagctaagtgacaaaactggaattagaggtttatagcctgtgtacttatataccaaatactaagcttttctcaacaagtcttgagaggtagataatataaattctgttttgtgggtgaagtttgttttaaagcatatacaactggcctggggcaccctgcctcttgaccatatgttcatgtttctctgatactaaccccaagtgaggtttaaactatttgaagaagctgtggtttatttgtgtaatcaactgtaaaaaactgattcttcttaatggtttatatcggtccaaatactaaagaatttatttagccagctaacatctctgcaaaaagagtatctcaacttgagaatatacccattatgtagatcacaactttgaccattacattgtaatctattgttggagccataatatttaaaaagaaattttttgctctttgaattgaaattgacctaatcaggttatgttggttgtccaacggaaaatatattttgctattaggttaaatgtcagtcatatttaatggaaaatcattgaccttaagaatttagaatgttcattttacagttttaatgttttatgtgtaaggtctgtgtttgctttttttttttttttcttcattttgttttggattttgagacagggtttctctgtgtagacctgcctatcctgtagctttgtagaccaggctgacctcgaactccgagatcacctgcctttgcctcccaagtgctgggattgaaggtgtgcgccgccatgcttgacttctgtttacattttttactgtgatctgatttaatttatcagccaccagacataactgactggcggaaggggcttcttttacattcacatgagtggcgggcttatgaggatttattttgaggttgggattagaatttctcttaatagtctcagtcatctaagtgcagagctggaggactacacaaaatgattcttcagtccccctttggaatacttgcttgctctctgaaccttggcgcatctttggtgcattacaagtttgtaagagtattaaatctatccacagaagttcagactcttcctatgctttttgctgcttattgtagtgtgctttaatgcacttgcctcccttgtgtacctttatgacctatgagttaatctaagcattattgtcagagtaaacagtataaaatataatcctgaccagatcaaaagccacttcataacagtaaaagattgaattaatatttttattgaatgtgcttgtgcttacatgtggtctctgcaataagatggccataaaacacattacaaaaaaatatacatatacacatatggtttcgaaattgtgatacattccaaaagcgagcttaatgaagattcagtaaagattgagagaaggccctcttaggaagccggagttaattaattaatttatttatttatttattgcttaatttggaaagctgctgagggaagaatgttcagggataaggaatagaatgtatgaattgtgtggggtaagagatgaagggaccagtgcctgatgagacagaatgaaacaatcttgtaggtaagaagtatggggatctaaactctgtaagcaagggaagtaaagtggtgagatgtgttctagggattcccttctgaccagacaatggaggaacgatagcatggaactaagactaaagaaatggggcaattgatacctttgtaagtattttagagagagaaatgataatagggttttttgttttaaactaatcaaggcatgaatcaaggtaacccaggaaatgattggttgtctcaattaaaaaagaaatctagattagaataagtagtgctggggagatagcccagtgatttagcatagtagttgctttgtcagttcctagcacccacatcagatggtttacattgcctgtacctccagttccagttctacacgcatacatgaaggcacacgtacatatggataaaaagaataaactctaaaaatttagtcacatagctcttttccccacatgtatgtgtgtaccacttgaatgcttggtgcacaaggaggccagaagagggggttggattcctggaattggagttacaggtagttgttagctgtcatgtggattctggaatcaaacccaggtcttctagaagagcagctgatgctcttaactgctaagcaaactctcaaaacaaaatctttttttcagacaagatttggaagtcagatgtggtggcacatgcctttcatactagcacacaagcagagacaggtctgcctgtctctattagtttgaggtctgcctgatctatatatacagcaagttccaagccagtcaaagctacaaacagacaaacaaacaacaacaacaaaacataaaaaaataagaaccaaagaagggccagaaaattgaatatagttgttttagatatttgctatttggttctttaaatttttcaattgtatgaattttgggtgttgttggttatataaagcatattgtttttatctttatttacattgcaagaaaaaaaaagaatatgtaatgtacagaatattttgacttaggaaactttgatagagatttcactgaatctgtatattgctcttgatagaatggccatgttcataatattaattctaccagtccatggagatctttccacctaattgcttcaacttcttttttcttttctttttttttttttttcttttttgagacagggtttctctgtatagccctggctgttctggaactcactctgtagaccaggctggcctcaaactcagaaatccgcctgcctctgcctcctaagtgctgggattaaagacgtgcaccaccactgcccagctcaacttcttttttcaatgtcaagtttttaatattcaagtctctcacttctttgaatgtcctcattgtctgttgtagtatgctactttcatctctaattttattgctctgagactctcttccccactgttaatttggttagagggtaggtggtctggctaggcaagcactttactccagagctatatcaccccagttatgggtgagggcatctttaggatttctttttaaccttacacttacttacctatggtgtatgtggtggttgtgaggagtggcacacgcatgctatggtgtgtgtgtgtgtgtgtgtgtgtgtgtgtgtgatgcatgagtatagaagcacatgtaccatggtgcttgtgtttggaggtcaggggacaactctcagaagtggcttctcttcttgcactgtgtgatctacagattgaggcattcctcacgactgacttagttagcctctgtggttcaaagagtctgactcaaacagttcattttagacatatttaaacacaggacaattttggaaacagttttctggtgacagttatcacagtaaagcctagagtgtgactatattgaaactcttgcaaaacgtgtctgggacctctctcataaaaatgggttctgttgactgagaaacaacactcaagagtctaggaagaatctggataaatacaacagtctaggggattcgggccctgcaagtagcaacgatcaccaggttactgctacatccattcccagctttctgggcagaaacaggtatagatccctatctcaggaggcccttgtactctggcctttcatttgttctcatcttagaagggttcaaccttcatgtgggtacattgtaagacagctggagttaagctctccaggcacaatatattcttccatttttttggttttggtggttttgtttttcaagacacggtttctctgtattatcttggctatcacttgtagccttggctgtcacttggctggaactcactctgtagaccaggctggccttaaacttactgagttccatctgcctctgcctcccaagtcctgggattaaaggagtgtgccaccaccacctggccagtatcttctttcattaaaaaaataataataataaaagtctactcaagggctggagagatgactcaactgttaagagcactggctgctcttctagaggtcctgagttcaattcccagcgaccacttggtagctcacaaccatttgtaatgagatctgatgccctcttctcgtgtgtctaaagacagctacagtgcacctatacataataaataaataaataaatctttttttttttaaaaatccagtcaagtttatactgaagattaaccatcacaataacaaactcaaaaaaaaaattgctttctggtagggagatccaaatttgatggaagattaaaaatagattttcatgatttattctgtatatgtatgtgtgtgtgtgttttaattatatttaattttgaatgtaggttccacagtatagaaaatataatgtttgtatttctgagtctggcttattttatttaatatagtaattgctagttttgatggtttattctaaatactcaggtgtttgaatctcttatagatagggatgcaatactagatggaaaaaggttagtacagttactataatcataaaccccactcaattgtctaaagccccgagaacactggcagttactgcagtctgttgtctacattaaaatagttttaatccctatgctaagtgatctttatttagattcttttacttttttaggtatggaatatcaagcaaatgattaagttgacacaggaacatatagaggccctattggacaaatttggtggagagcataacccaccatcaatatacctggaggtaagttttgagtattactttatggtaattttgagagaaaaatgtattaaaatgttttatagtcatagttttggttatttagagagcaggattggaaacattggaagaatttactttgtcttttttttttttttttccttagtcttgttttcattcacttgttgcaatctgcatgtattagttttatttggaaaatgtcaaaactgagaggaatgtctcctataaacttcaaaatattgcctgatgggctggtgagatggctcagtgggtaagagcacccgactgctcttccaaaggtccagagttcaaatcccagcaaccacatggtggctcataaccatccgtaacgagatctgatgccctcttctggtatatctgaagacagctacagtgtacttacatataataataaataaatctttaaaaaaaaaaaaattgcctgaattttaaaaaaaattactaaaaagagagaaagaaaaagcacactgttttggtagtcagcagaatgagttaccatcttgggaaatttggatggttttgtaaaatatctttttgagagtaagtttcccagagttgttttctcctttcttatagatagtttataatcttggaatggcccagtactgctcagtcttgctgcttagtgatgccttgagatttgtatcatctgccttgagtgagattataaatctgtagttagccattgttcttaatcctgtgaggcagtaggtactaggtagtcatagataggccttcttgcccttagtttccttctaaaagtcagtcagtccttagcaagcaggctctgtgggctcgacaagactgcttgccacagctttctactgcctttctccagtaacgcttgctcagctataattgcatgatggtatgtgctgttagtcccaggtctgagactttgaggtcaacctgggctacatagtaagttctaatagagacacctaagctacacaatgagactctgtctcaaaaaaaataaaataaaataaaataaaacaaagaccaagtaagcatttggcttcaaatatcagagattttaaaacatggtttgaacaacttgtaactaaaatttctaatttaccaatctacttttttttttaagaattatttatttactttatgagtacactgtagctgtcttcagacacaccagaagagggcatcagatcccaatacagatggttgtgagccaccttgtggttgctgggaagtgaacttaggacttctgaaagatcagtcagtgctcttaactgctgagccatctctccagcccctcaattatttttcaaagaaaaattaagtcttcattattttgtgagaaagttaagtttgtgtttataaaacaaaccttggaactttggaaacaccaactaaactgttcttctcttgtcttcctcatgacttattctggatcacactgctgcttatgctataaaatgtaggactagaattctatctgtactttcagttgtgtggtaggagccaagcaaagaagtaagaagtagtcttagtatagtcttaatgaaagtgctcatttttgtttatcaaccatacaacagaagcaacagtttgtctctgtctattgggcactttcccacatttgaatcaatgaacatgttatttatagtcatgatggattgtttcagccagacacatactcttcagacatttgaatacttaaaaattgattagtaaaaagaaaaacatttgtgcttattcttattctatgccctgtactgtgttaaatgcttttattaatacttacaattacttttagcaaattcctgcataggtattttatttctctttgacaggctaaatagagaggttaagtaacttacttcaagtggtaggtaactattgctgaagggagaaggcagatatctagcttacaaatctatgatactgaccactgccttattctacagctttgctatcctgttgtgtctctgccctcgtgctaaacatttctaatttctttatctattttttgttgtacaaaatgtggacttttttttcaaatgtatttaattggattggtttctttttacaactatgcatacaaacttgaatcatatattcaaaaacagtgtaacatcaaagcaaagtttaatgggttttaagtatgtgacaaagtaatagattccatatgtactaatgacatatagctatagtgaatatttatgaaacatttagaaaaaaattaggatagtattatatgtaatagtttaagaactattttatagttacaaaatagcatagttcctgagatatgctaaggttctacagataggggtactcactgaataccctgtaatatttatactgtttgcagtgatatttaaaaaaaaaaatgtgccgggtgtggtagtgcacacctttaatcccagcactcaggaggcagaggcagatgaatttctgagttcgaggccagtctggtctacagagtgagttccaggacagccagggctatacagagaaatcctgtctcaaaaaacaacaacaacaaaatgtttaagagccaaaaatctgtatcttcaaacagattgtgcttcagagcagggagggacttatagacaatgaccatataaagcacttagaatattattaatattaattagcatttgatacaccatgaagaagactgacggatgacaggatgcttgcttgtggaaagctagctgaccatcccaagggaaaagactcagggactaaactttgaaggccttcagtcaaaagccagttcattctcctgatgactcccaaggtgtgccattcttcagggttttaggttcactctttaagaacagttttttcctagaataaaagatacattgaatttaccactttaaaaaataaatatttagggttggagagatagctctgcagttaagagcactggctgctcttccagaggccctgagtttaattcccagcaaccacatggttttaccatctgtaatggataccctcttttgatgtgtctgaagacagtgacagtgtactcatatacatagaataaataaatttaaaatgaataaataattttttagcaaattcattttattttgaaaccatcaacacagtccagaacttttcatcatttaagactgatcttttaggccgggcgtggtggcgcacacctttaattccagcacttgggaggcagaggcaggcggatttctgagttcgaagccagcctggtctacagagtgagttccaggacagccagggctatacagagaaaccctgtctagaaaaaccaaaaaaaaaaaaaaaaaaaaaaaaaaaaaggactgatctttttactttacatattaactaccagatccacattttcttctgattatgatctgtaataacaactacatactcctgtgtctgtgaatttgactgttttaaaagaatcacatcatttgtccttttgtgactggtttattttacttagcatgttttcaagaactatacatgttgcaacatggataacacgtgtgtaaaaagtcccttgcttgctagggggaatctcgtggtagaatgtttgcctatttttggctgcttgaattgcaaaaaatgatgaatggccatgggtgaaagataattgaattcttgctttcaaattttaaaacaagggttttttgttgttttgtttgtttgcttgtttgttttcccgagacaggatttctctgtatagccctggctgtcctggaactcactctgtagaccaggttggcctcaaattcagaaatccacctgcctctgcctcccgagtgctgggattaaaggcatgcgccactactgcctggctttaaaacaagttttaaaattatatttgtaaactttctgcacacatgcatgtgcgtgcacatacacataccacagtgcacatgtggaagttaataaacaactgggaggagtcagttctcaggtcatcagggttggtggctttaaaatctctcatatttgaagctaatggtaacctgatgatttgtaatgtaggcttatcttctgcataattaactagtgattacagctgagctaacatttatagaaaaggcagaggaagtgtggtgagcagtcgcattgttgatcctgagcaaagtcgggtccttaggcttaaacagctctcatgtctttgaacttatactcagaatcgcagaatcatacagtgattgtttcattatttaaagggactcacacacctttttatactgtgcctacaccatgttacattcttattatcaacgattgcacaaggattcttctctctccgtagcctcactgacactgaacattttctgttttgtctttgacaatccccattttaatgaatgtacagtgatattctattgtggctttgctttgcatttctccagtgactatgacggtgagaccgtttttacattttattgtttatttggacatcctctttggagaaatgtctgttagctctttaatttttaattgaattgcttacattttagttacttaggtgctattttaaagttaattaatttatttttttcatcattcattcattcaattttaaagcatctcgcacgcacttctatagagaagatattcaagttcattgagtataagcaggaaaattaaagaaacagaaaaatcattcattcatatgtgtgggccaaaggacaactttaaagaatttttctctttccaaccatggtgttaaaacctaggttgtcaggacagggtttatattaccattccacaagagcagaatggaggcatagtgacaaaatccaggaccaaagcaaaaccaaaccctaacagtataaaattctatatgatgtttgggacttgagtgtcaaaggagtagatggctcagtcccaccagctttgctgcctgtgacatacatctccctcttgggctgattccactccctatatgcaaccgtcctcggcaggtaggtatctcacagctctgacattgacaacatattggtctctccagtacagttcaggcttcactttcattgcttcacaatttgaaatttatcttgtttgctagtctctggctcactcattaactaccacaatcctaaggaggaaaagatgggtttgcccctgaaaattctgtccaggatttttctgtttctttaattttcctgcttatactcaatgaatttgaatatcttctttgtagaagtgcgagatgctttaaaaattgttcacatatctttgttttatgggcgtgtgcacttatacaaatgtctgtgcataaatatatgccatgtagtgatatatggaaaacaggacacgctgaaggagtcagcgctgtcctttcatcacgtggatccccagcactgttctcggcttgtcgtgcttggtggcacgcacctctgagtgctgagccatcttgctagcttgagatgcttttctccttgtttttgtacctgatatatggtgtatggactaagaagcaaagagaaaaatacggagccagaacttagtattctcttcaaaggcagacctagtcctgatactcagtaggcagaggcaggctgtgagattcagatcagccaggactacataattaaaatcctccctcaaaaaaaaaaaaaaaaggaaaggaaaacaaatgtccctgacatttattatttatagcattcttataatgcatggcagtctttttcatcttgagatgtcaaattagaaacagtccagacacatttcatcaatttctgcaatgaaaagaataccagcatgtagatcagttcattgtatatatctgtgtaaagttaataaagtttcattagataatgagattaaattcagtaagaataagcttaatacttactctttttgtttgtttgtttttgtttttgttttttttgagacagggtttctctgtatagccctggctgtcctggaactctctctgtagaccaggctggcctcgaactcagaaattcgcctgctctgcctcccaagtgctgagattaaagctgtgcaccaccacgcccggcaatacttattcttaatacaggtgttacatacctgtaatcccaggtctctcacagactgaagcaagcaaattctaagctaattcatgcaatttagcaactctgttttaaaatttagaaagaaattaaagggttaagtatagttaagtgagagtgtttagctagactgcacgacattcgcggttcaattactgggacagaaagagggagggatgaacgtaatgactcaggtgcaggagatctgtgaactgtggaagccattaccataaactctcaaacagtattactttcagtattactcaaaagaatttctttatccattagcatctgttccttccagtcctcggaatgactgatcttttgattgatgataatgttggaataataatccataaaatatgggaaagagtacagtatagaccaaagtctgggaagatgttagaaatattcatgttgacctgaaacctattcgtgtgctagtgagatgtaaagtcaaggtggagtagtgttcattcaaggttgtgaacgtcccagagtcagactctggcatcatttcaatcttttgtaaagcctatggtatgaatatctctgggtcttgaagacagaatggaaataaatgcctaaattnnnnnnnnnnnnnnnnnnnnnnnnnnnnnnnnnnnnnnnnnnnnnnnnnnnnnnnnnnnnnnnnnnnnnnnnnnnnnnctaagaaacttgaagaggtaagagtgtatttgccctctgtatcctgaatcacagcccgttgagggaagccaaggcaggaactcaagtgaacaagaatgtggaggcaggagctgatgcagagacacgccatgaaggagtgctgcttactggcttgttcctcatggcctgctcagcctgcttccttttatttttcccccttttattaaaaatagatttatttttcatataatctatcctgataacagtcaccccgccctctactcctcccagatcctccccactttccccctcatctgaagccactccctttctgtctctcagtagaaaacatataggcttctcaaggaataataatataataatataaaacaagaactaacacatcaaaattttaaaaaaaaaacaaaacagacagacagaaagaaaagagcccccaaaaggagaaaaaaaaaaacctaaaaattcagagacccatttattcgaacactaaacccgaagccatgatatatatgcaaaggatcagtacggtaaaaagagagaaaatataaataaaatgaaatacaaatttttaaaaattaagtggtgagggcactgttgctatagagacaaggaacttccagaaaactcagtgctattgaggtttttgttttgcttttgttttctgttgctcatctactgccaggcttgcagcatatccttaagagaagtttgtttccctcaatgaaactcccttgaaaaaacaaaattttcattttcagcctgctctttttatagcatccagtaccaagtcagggggtggcaccacctacaatgggctgggccttgtgcaggaaatattaaaaaagaactggctcgttcccgagattgtgcctgcaactctgccctgtagggctgaccagccatcccccctgggccctctctcacctccccctcctcttcttccgtccagcccggaagtctcccctacttacccagtgattttctcctttactcattaggggataggtgacaagaagtcaccagtatacaagactccattctccctggagagtggaattagcatcaaaatacaagcaacccctgggctatccaccaccgggcacttctatatctattaaggaaatgccctacaggcttgcctataatctgattttaggaaggcattttctcagttgggattccctcctctcagatgactggcttctgtcaagttgacatacagctaacaagtacagcactgaatgcagccgaagtaacttgttaaactgaactgtgagaatgaaaaaaactattgataatgtggtgaagtgatagtttgtaatctgtgctgaagaaattggtatattttcaaaatttaacattaatactttgataagggaagaatatttggaaaattcattgtttccaataattcttttttataaggctaattttatataataaccatgtttgcctaggcctcagtaataagaatatttgatttatgtaagaaagaacttgtctcccaggcatttctaaacctttaagggtaagaattgtctgccttgtctgtttttgtagtctcagcataaacgatgccagtatagagataaacaacgaatatttattgaatgaatatagactcaataaatgaagcatattgagaaaggcacccttattaattagcctcttgatatgaaaactaaacagaaagatttgaattgatttgatggtaactctctattctgttcgtgacagttctagactacgaaattgtcaaaggggaatttttccagagttcaggctccttacctcagtactttcactatattttctcctttcaaaagttgttcaggaaaaaaaaaaaaaaagttgttcagtaagataaatattcagtacaccagagtgctgtagcctttattgaaatgagattgctcttgcattctccccttcctcaggtaattcctgcggtataatttctgcttatgaaatacagatttcctagtgtggtccatatactccttgcactttccaacacattacctgacattcagtttagaaatctgtggggttccccccacccagtaccttaaaatatgttctttgttaaaaaattctctgcacacaggcctctttttaaagtttttattgtgtgttgttttatgttgtactcatgaggctggggcatgcacatgcatgtggaggtcagaagacagctttcagaagttagttctttcctttcattgtgggttctagggatcaaactcaagtttcaggcttgctcagctagcactattacctgctgagccatcttgctagcccagtaaacttcttgagaaaaaggaaatgtcatattataatccttgattctctcttgtagaggttcataaatgtttctagtactgcatctgtttgggatgttagggaacaaaagggctaaattactctaggctgaggtgatttccattgtctgaaagaactgtggatatgtatattccaatcaatgccatctctttactttcagtatcattctgttcctttagaatttggtatttaatatggtaagccattttactttatagcttttgtcaaatgggatgtttaaaagggtatactcctagtggtccagagtttcctatggttgcagggtatcaaatcaatttttacttgcttaagcagcatttgatggggaaggagataataaggaatactgccagagagcatgttgatatccaggatcatagctgttacaggagacagtgatggcatccttggtttgtgctgtccccagaggctgtctggatgtctatgatctatgctgctgctggaaactatgtgaaagtccatgcatgatctatgctgccattgactgctatgggcaaggaagcttctgcagtggtatcaatgactccagactcataactgagaatgagagatgttgaaggcttctgtgacactccctacccacccccctcccccccaaaaaagcagtccagacaaatagctattgaaaagactgcttacaaattgtgataaagatggtgaagtgtagctcatcacagttgatagcttctctcagtggggttgggaaaggactctgtcttttttaggcagctggccagcagagtttgaccatgcttcagtgagtacatgagcaacacaaattggacttggatttttctttctttcttacattcttagttagggttttattgctatgaacagataccgtgaccaaggcaactcttataaggacaacatttagttggggctggcttacaggttcagaggttcagtccattatcatcaatcaaggcaggaacatggcagcatccaggcaggcatggtgcaggagctgagagttctatgtcttcacctgaaagctgctagtagaagactgacctctaagtagttaggatgagggtcttaaaatctctctaacaaggccacacctccaaatagtgccactcactgggctaagcatattcaaaccatgacattccactccctggcccccataggcttgttcaaacacctgagtctatgggggccatatctagtcataacataattaaaaagtacatttagtccaacttccaaagtccccataatctcgagcagcatcaacaatgttaaaagttcaaagtctcttctgagatctatcaaatcacttaactgtaatccccaaatcaatacaggaaaccatctgggtaaactccaaattctgcatctctttgtctgatgtcaaagcagttttcagatctccaactcctttttcatcattgttgactgcaataaacttcttttcctgggctggttccactccctgttagcagctttcctcaggaaatatcctctagctctggggtctccaatgagcaatgttcaggtcccatgtgaatctcctttattttgtaggcctatgaagagtacaccagcaagctagatgcccttcagcaaagagaacagcagcttttggaatccctgggtaatggagcagatttttctgtttctagctctgcatcaatggacaccgttacatcctcctcctcttctagcctttcagtgctaccatcatctctttcagtttttcaaactcccacagatgcatcacggaacaaccccaagtcaccacagaaacctatcgttagagtcttcctgcccaacaaacagaggacagtggtaagtcagtatttatcatcatccttttgctttctttgtgttgaacatcatcatcactgcatattcagagccatgccaatggaattatccattttaagttagggtagaaaagacatgattattttatgtcaagtctatatacagagttcttttttttaagatgcattcattcattcatttgtttgtttgttttatgtatatgagtacactattgctctcttcagtcacaccagaaggcaccagatcccattacaaatggttgtgagccaccatgtggttgctggatattgaactcaggacctcaggaggaacagtcagtgctcttatccgctgagccacctccctaacccttctttttaatttttatttgtgtatttgtgtacatggcttcactatgtagcctcggctgtggaactcactacatagatcaggctggcctctgactaacagcgaccggcctgcctctgcctcttcaagtgatgggatgttagcatgcctaactgatcaaacttcattggcacttaaatataagtactagttaaacatcagtcaggagccaggcagtggtggcacacgcatcccagcacttgggaagaaaagtcagtcaggagactgaagaggtggctcagcagttcagagcactggctgctgctgcagaggtccttggtttggtctcctgcactcttaggttagtccacaaccatctgtaataacattttgaggaaatttggtgccctcttctggcctcaaagaataccaggcatacatatggtgaactactgaacaggcaggcaaagtacgcataagaataaaataaaaacgaatgcatctttttttaaagacgagattagaatttccagatttaagcttgtatcaggtaagattctttcctctgtgtaatctccagcctaaattacctttcagttacctttcagtgtgctagtgttttcctcttgtgtatgtaactcctaaaaattgtcacaaaattgttagaaacaatgtaccagtaagaaacatttaaagcagagaaatctcctgagtcctcaagtaaagcacatattgtcaagttcagccttcataattaacgttcctggaaaacgtaagccatagtgctttcgtgtgtgtgtgtgtgtgtgtgtgtgtgtgtgtgtgtgtgtgtgtgcacaagagtgggggtgctcacaaggccagaggagacattaggtctgcagggactggagttataggtagttagttttgagtcaccggacaagaaagatcctggggactgaactctgtcccgtagaaaagcagcccgtgttcttaaccactggtccatctctccaactctatatgattgcttcgaactttaattagaagagttgcaagtcagctaaaatcaaagtagtttctctttgtttttgctgtgagacaacagaaattcaaagtacagtgggtgttttccagtattccaaaactccttttgacttttaaaaaatgttactataaaagcattttgccctagagtctagaattcctgtgttaatgatcggattaggaactagcagagttgccaactacccacatatttttggattttgaccttacttagaaaatactgtttttggtctgggtgtagtggtgcacgcttttaatcgaagcatttgggaagcattagcaagcagaactctctgtgttcaagaccagcatggtgtaccgggacagccagagctacacaaagaaaaaaccctgtccgggaacaaacaacaaccaaaaaaaaaaaggaaagaagaaaatactgttttctaacactgttaattatcaagagtagatttttacacactttcttcctgccctttcttccaggaagagttgattgtgataaagcaaacttggaattacttaatttttgcacagaataagctcaatttctaaaacaaatccagttttgtcctcttcaaaaaccaggaatgtaatgtaaaattatttgtaaatagctattctatctctgaagcttaaaaagtgagtggacacccacccccatctctgtcttcattttgttgcctatacttgtgagaagagcgtgggccggacagatgacttggtggttagaagtactggctgcctttgcagagaagcccggttctgttctcagcacccacgtggcagcttacagctgtctgaaactccagttccaagggactgaatactgtctctgatctctgtgggcactgcatgcacgcgatgcacttgcatgtgatgacgtacatgcaggcagaacacacagagacacaagatgaaaggagtttaggggattggctacacaatagcatgaagattaaccttgagcagttcacttttaaaaataattaggataagactttgttatgtgtatactttaatacatttttaaagggacagtatggtcataatacacaaagttaaaatatctctaactaagatgacccaaccatctattttgaagtgtttttctgagcatgaaaaataatgatttgttttgttgttctatttctcataactccaagttcctaatgtccgtcaacaagtaaattgttaaattggtcctttgtttacatacctaaaacccagtggtagctcagtgtaacttcaatgccgtcctgatttgtgtatggagttctcggttagttggacttacagaaagagaccccatctcaaaagttttttgttgttgttgtttttgtttgtttttttttaaactaaaaacaaaaagtcagggatatttttgaaaaaaattgtgtagggctttggagatggctcaggagttaagagcactgtcctcttccagaagacccaggttcaattcttagcacccacctggtagctcacaactatctgtaactcctgttctaggggatccaactccctcatacatgcaggcaaaataccagtgttcacaaaataaataaattaaaaaaaaactgtggtatatctatatataaagaacatagtttgatactaaagttactgatagtcctaacacccaacatagatgaatctcaagaaaaatatgctgtagaaaagaaggtagacaaaaatagatgcatactttgtaattccatttatataaatttctaaaatgaattcttggttatatatggtggtgaatacatataatactctcacttaggagatggtggcaagagaattaggggttcagtcatctttggctacatagttaagtctttaaaaacaaaggcaaatttttctatagtgacagaaagatgtttagtatttgtctagaagaggattaaggaaggaaggaggtattacattgaagtacaaggaaacttgcagaaaattatgcatatgttcattattgtaaatattgtaattgttttagttgggatttcaatttctataatgcaacactatgaccaaagcaagttggggagaaatgagcttattctgcttacacttccacatcactgttcatcctcaaagaggtcaaggcagtaacttaaacggtaagaacctggaggcagaagctgatccacaggctatggaaggcttctgcttataggctcgctccccatgacttatttaacgtgctttattacagaactcaggttcaccagcaaggggtggcactgttcacaatttactgagtcctcctaagtcaatcactacataagaaaatgcctacagcccagtcttatggaagcatttcttaatcgaagatccctcctgtcaggtgactctagcttgtgtgacagaaaaagtagccagaacaggatatgtgtggttatgtacggtgcgtattaaactgggttctccacatcactgcagtttatcccttacctcattcttggttttcattgtgaacctttaaaaatgctgctcatcctattctgccttgtttgtttttattttctcttattttattattactattttagatgcttgtttatattctgatgagagagggggttatagatttgatttgggtaggtggagaagtgggaaggagctggaggaggggaactgaaatcagaatatattatatgaaaaaattattttcaataaaaaacaaagaatgctgttagtcatagaaatatatgaaatagattttaaggaaaacaattaaggacaaggagagatatattaaaaagcaacttcaccagacaattagaatactaagtattgtatttaaacagttctttgtcagttatccattttcatttttgatcttttaagatgaggtctgtattctgtgctgatcttgtacttaagatctttctacctctaccccatcaagggctgggatttcaggtttatcccagcatgtaaagcctagatgtcattcttaatatattacaggtaggtcctgtagacatttaaaaaaatatactttttcaggacacttaaagtctttactatatttttagcaataaggaatatccaaaaatgcaaattctctgaacatactgcaattaaaataaaatgaataccaatagaaaagcatggtttagaattgtagttactctcagcatagactaaaaaattctaagggaaattagaaagtatttttatgaataataaaaataatgcataaaattgtagaatatacaaaaagcaatataaaatttgccttttaataatttatatgagtttttgaaacacctaaatatgaatgagaaataagatcaaagtaatgttaacaatcataataaagccctaactactgtacagttatcaatttttaaaattacatgtaataaaggtctgagagagtagctcaggagataaagcatttgttgctcaagcctgagctggaggactggtggtcagagccccagaactcttaaggataacccgcattgtggctacctgtattctcattacccagaagatagaatatggacccctggtgcaagctcaccagctaaactagcaggaatcctcgtgctctctcttttgcaagttacctagcttcaaaaaatcatgtggttagcaattaagaaagagttaatgaactttgggcctctatacaaacatgagcccatgacatgaacatactcatatactgacaccatacacacacacacacacacacacacacacacacacacacacacacacacacactatgactagggctgaggcagtaactcggagggagtacttgctattatattctgggtttgatctccagtagtactagaagtaaataaaagttcataacttgaagtataaaattcagaaacaaaatggattcttgggtttgagagatatatatagctcagtgctagaacttttacctagcatgtgtgaggtcttgggtttgattcttagcaagatacatatatacatgcacacacacacacattttcaaaagcaaataaaaaaagaaatagaaaattgtaataaagtgttgaagaacatgaaggtaagagaaacatctattggggcagagattcaagggagcaagaagggaaactggtgatggtggttatcaggacatatttgtatacttgtatgaaattgtcagaaaataaatatcttttttaaagatggaagaagccttgtagctactgaaagttctctttgtttctgaaacagagatcctggaaattagactgtgacatttgcatcatgacaggcatatgttttatttgatattaacattgttatatgtatgtgaagtcataaaaagtgaaatcccagcaagtaggtagacatgagaaagtatataccattcaagaaagaatgttgtaaaactgtgtcactcaacgggtgagctttttagtggcagtaaattataaaaagataaatatgtaaggaaaattaataaaagatggtttcttctcataaagtacaagttttcctcatgtcataaagctttgagttctccaaggaacaagaacttattgtatcctatcagaatttaccctttatatcagataaagaaaactgtgatgtttctatctgactgttagatgttattgattgtctagtttcttcattttcatgagagtatatagtgtacttggagcatatttctctcacactccacttctcacctggtttgggatgtgtgggtaggtggctttatgttcctgtgtgtgcacatacacatgtaggcatgcatgtggaggcctgaggacatcctgaggtgtgtcaggagtcatttaccttgctttttgagataggctctctcactggcctcgaactcagcatgcagggtaagctggttgcccagtaagccctcaagatccacttttccctgccttcccagtacacatgctgcttcatccaacatgtttgtttgcttgattatgtagaccagactggcctaaagtcacagagatccacctgcctctgcttcctgggtgcttgggattaaaggtatgcaccactgttattcctgactcacatctaacttgcttatatgagttctcaaaattcacctcaagtcatcatgcttgtcaagtaaacactttactaactgagctctctcctcagcccttcaagttttttgaaataggatcttactatgtagtgttttattcagggcaatccttctgtctcaacctctaagtattagaattataggcatgagccaccatgcctggcagaagacttcgtcctaaatcattttgaatttgatagtttttttatggctataataaagaccatggccaaaagcaacttgagaaggaagggtacttccatgtcacagcctaagaaggtcagtgcaggagctcagggaggaacctggagggaagagctgcagcagaggccatggagaaacagtttgctgggttgctctccgtggcttcctcaatctactttcttaatctcatctaggacttgcctgatgtgtcaccacctccagtgaagtaggtcctcccacatcaagcattaatcaagaaaatgctcgcggttcaaggcattgcctcagttaatatttttttcttctcaaatagttctatatcaagttgtcaagaaatcacccagcatgctgctgccaaaaggatttctctgaactccacatgtgtacacatacatgcccactcacaacgcatcatgtgaaatcaaaatatataaataagggaatgtaatttaaaaatgaaatcatgccctacttgtatttatgaagtaagaactgtttgtggagtcgagagaaataagataaagttgttttgattttagccattttgacggtgaggaagtaatagtagaaacttaaattattaccagtacaaataagtaagtgtatgaagtaggttaagaataaaaggatattattaaataggatatattctacagccccaggaaataatcctccctctatatttttagccacagtgtattttgcttaccagttttcagtttataaaccattctcatgtgttctcatttgtccccacagcaagtttgtgagggcaagtgctgagtgcagcactgtggaaccaggacattctaggttccacggaggtgctaataagcctttccagcagtggaagggcttcttttgtccttggcacgttttttaactgattaacctattttggtttgattagcagtttagtagtaagagatacaacctttgtaaatggccctggttctttgcaagttaaattccgtttgtctaggaagtactttaattctaacgtcttcactctgaagtgtttttagggtataagaatcctcttaacaagactgtgttgtaagcatagcatatcatagttttccttaaaaacaaattggtctgacagccgagaaagatacaacttcaagattaattgtcataaaatcacaaagctatgtcttggtcaggcttactattggcgtgatgaaacaccgtgaccagaagtgacttggagagaaaagggtttatttggcttacacttccacagtagtactgctcatcattgaaggcagtcaggacaggaactcaaacagggcaggaacctggaggcaggagttgatacaaagaccatagaggggtgctgctactggcttactcttcatggtttcctctgtcagctttctgacagaacccaggaccaccaatccagggatggcatcactcacaacacactagacctcccccaacaatcactaattaagaaaatgtcttagaggtttgtctacagttcagtcttatagaaagaagcattttttttttccaataaaggttcccttctctaagatgattataccttgtgttaggttggcataaaacgagccagagctagctgtatatttaaaattgtgtccgaatctacatattggtttgcatatgagtcctatgctagtttacttaagagctgtttcgtgtttacatataccacaaacttgcttctgtaccaccaagccgaccacggtgtatgtgatctgaaatgctgggaagcaggaaggacaggagtgcagagtatgggtatgtaagtttaaggccaagctgggctatatgagatcctgtctcgaaaagaaagagaaagagagaatacaatatcacacacatactagcacaaataattcagtgtatgacattttttgatgtccaaccaaatctttttttgggtgggggaggggtttgagacagggtttctctgtatagccctggctgtcctagaactcactctgtagaccaagctggccttgaactcagaaatccacctgcctctgcctcccgagtgctgggattaaaggtgtgtgccaccatgcccagctgtccagccaaatcttaaagtgaatccttaaagttttgtaaaacattgtactatagaagattttaaacacatgcaaaggtagtgaatgacttctcatggatttttaatcaatactcatttcagggttttttaaatttttttataataaagtttgaacataactgttttgttcaagtgtgaattgccctgtggtaaatacatattcagacaaatatatatagtgttgttgactccgtaacatgaactcgtggctaacatccctgtggctgaggcctgaattaagtttccccaacacacacacacacacctccctacctcttccctgccagacacattacagtcttctctgggcttaggagctctaaactgcacttaagtactgtgctgggaaaccatctgaaacagaaagcacataggtttatgtagcagtaggtaggctgggaataggaataggatacagatttgtattctgaaagcagaaaggtaaactgttactttgttcaaccttagctcagacagtacatgaataggtttttcactgatcttcatgtatccataaacacaataaagttttttatattttccagtgagtagacaaatacacacataattcctcacaaataatgagggttgcctatatgtctagctatatcttgaatacttaaaattatgagaccctgttcccttatgacaaacttaagatagggccgcactctgttaacctggctggcctggaactcacagagctaggtcctcctgctttttgcgtcccaagtgcttggattaaaggtgtgcaccatcatacccagcaatagtttcagtgataatattaaactgtgcttatttctaaacacaggtcctacctagtagcttaaagtaattaaagtgactgtagcagtaatcttctattacctaaaacacccctccttctgacttccctaataaaagctgtactccctgtaatctttctgcttctctttagtcttgcaaatttgccaggtagatgaggcatgggaagggctaaacaataggattaaccatttgccttgccctctcctcccagtgttacttctccttatatgagctttgttctatcaatagatagtgatatcttgatattaatgttctaggaaatatgtatcaattggcacactcttaactacactaaaacaggagcatctctcaaccaatgtcatatgtcacttcaaataagactcaggtacaatttagaaggtcatatatctagtcctggacctattgctatcataaggaattagcagctgattaacatgtacatcattgaatactagaaaaagctattgatagccccaatagtaatatgagattctagagaaggtcgagttcccagatagagacactagggaagtaagtatcgaatatcagattgatgcctgtctctgtatgtgtgtgcctgcctgcctcacctgcaccctcacctgtctgtctctctctcttggatggtggtgcatatgcacatgtgtatgtctgtgagtgcatgcacttgtagagatcagagatcaatggcagttgtttttatcactgttcaacttgtttttcgagacagggtctctcttgtgaaccagttggctgaccaaatgacacagccctcccccaggtccacactggagttaaagatgtgcactgctacactcagctttttagtgggtactgaggacccaactcaaatccttatgtttgtacagcaaaagcttcacccactgagcatccatccagccttcccatatagcctaagacacacattttcttctgctatattcagagtccataaggcatctcttaataatcatcagtgtaaccaaggacttattatacagcttgcacctttggtcaaaatagatgtttacatctagacatagtagtgtgtgcttacaagagttgtgaggctgacataggaatatctagagaaccaggcaagcctaggctacaacaggcactgcctcaaaaagcagacagcaacattttttattttactttgagtgttgacctttaagtattttcagtggtggaaccatactatattggtatgtgcaatatagtggatattatgttttctattcatgtatatgtgtatgtagttttaatagaagatgtacacatctttttttttctttgtttcaagctgataaaataatagttacttggtataatttcctttgactaatgagtaaattatagacccaaggaatccatatgatattttaaagatgttataaggtaaatgactcagttttaaaaaatgatttgaaagaaaacctccttcctttacctcttgcatgtatttatgtcataggtacccgcaagatgtggtgttacagttcgagacagtctaaagaaagcactgatgatgagaggtctcatcccagaatgctgtgctgtttacagaattcaggatgggtatggtttgtatgtgttgtgtcattttctttgaaagaaaattagacataaagctctggggttcttttgtagtctttctgcaaatctctggaatggagaattaactcaaggactggagaggtagctcagaacccacatggcagctcatagccatctgtaattccaattccagggatctaaaatcttgttgtctcctcaggtatgcatgaggtgtacagacttaaatgccaggaaaacacccatacacattagaaaaagagagggtatttattactaaaagatttagaacatcaacttaaaaaattgtactaatactactcttgaagaaatcttgaagactattgataatttatttggttttgttgtttattcctatgacaaatgcctttattagagtttataatttccttaatttgtgaacaattaaaacagcagttctcaacctttcataggggttgcctaagaccactgaaaatatagataattatttacagtgtgattcattacagtagaaaattacatttatgagtagcaacataaatgtttttatggatgggggattgccacaatatgaagaactgtattagagggtcacagcattaggaaggttgagaaccactacattagaatgtgatctgtttagataatgtgcatttctatagtcttcctttttaaataccaagctcatagttccacaaaaagttaccaaaatttacattttaatattgaagtgtcttttcataaagtaatattgttccgagatggttatgttttgaatctacatcttgaggcatgttgttccttggatggtctttttctctgaattggatggtaagaccatacctgtgtgtttgtttgtttgtttgtttgtctgttttttaaaccccaggaacaatttggttttgactgttgtaggtttttctggaccgacttaaaagtaaatatatttatactgctctttgtttaaaagtaatacatttattaaagttaaacttaaaaattaagactttaatttctaatgattgaaaagtacagagccaaactttcttaatattagttcctctgtaaccatatttgtatacacacgtatatactgagatacagtaatcaagaaaggtttttgccttcctttttttcagagagaagaaaccaattggctgggacacggacatttcctggcttactggagaggagttacatgttgaagtactggagaatgtcccacttacaacacacaactttgtatgtatctattcatatttgaattgtcaaagctggtcagtttcttttgaatttttttatttagtgaatattaaatacagatgaataattttgtgattgataattggcctaaattctgttctctaaaatcttgtatttgaaaagttaatatttattctttctttataacttaaaaaacatgtactatgtctcttaaatgaacaaataaaaaccaaacaaaattagtctgatatgaaaatctgcctatgaaaatgaacttttcctagaaatcgtcatgtgtatagatgcaggtaacaggatagttctctatgtacacaactccagggcagtgagcacagcgtacttgcttttcccttcattacttcccattcctctctctctttcaggtgaaaactggggtcatgctgtgtgatcgtcttccttttaattttctcctcagtaggatttgcgggtgttaattctatttcagtacggctagctttattcttgtaatgattgcctagtagcctataagaagagaaattgaggctttttctcttatttttatttttataaaatgtaacatgtagagttagactgcctatgtcttgacatacaaattgttcgcaaagattaagggctgggtaggaagcagcagagttgggtattgagttctccttgagactttatcttgtcttttttgcctttggtaaaacctagcttaagtttgtcaccagcccgcaacagcctcctaaccaccccccactcaactaaaacatctttaaatatacttagagtctgttctaaactaagcataagttatggccagaagaaataatagatctttttggttcacctttattcacaagggtatctttatggtttgcataaaatccatctttagtactgcatacccagtaccttttacccttctgctgttctgctcccgtctctcattctcttcctctcccctgccccacccaacccctgtgtacctcgcctgcatgggcgtgtgtgtgtgtgtgtgtgtgtgtgtgtgtgtgtgtgtgtgtgtgttgtttcctgagatagtggtgcagtactaaagatgcttaatttggcaattaaatatcaaagttatttcttatttctgtataaccacaggcaactggaaaaggggaaaggtagaaacaaacatttgccttttttcacatgctttttcaagtgatgggaaaactgaagacagcacaccctgttacgtaaaagttcctgaaagtccagaatgtattatgtgccagactataattctcagtagctattgattaaataaatattttttgaagatagaaatttgagtggggcacagtggcacactgggaagcagagacacacaaatgacggggaattcaaggacagcctagcctggtctacatagtaaggccctgtctcaaaaaaagaaaaagtttgagagcagatgtggctttccatagctggaaacctctattgggaggcagaagcaagaggatggttgaaagttcaagaccaacttctgtcgcaaaaaccatttaaacagaaagagaaatgtgatttggtgttaaaatcaaatgtatcgtgaaaagcatttatacataataaaggatataaaatgctaagctatgcttgatgtaagtgctgttatgtaggttgaggtatatattaggtcataataaaagaatacatttattacttatttgattgtggttttttaaatgaaattcaagatggttgaaaatataaaaaagccatccttgccatcaacattctgaaatagcagtgttagcaggttgtgtgttgttctgcccatacttactgcagcacatacacactttatatcatttctgcctgggggagaaaacgttcccgtcatacactgcaatttctttgatccatgctgtacattaagtcactgataaacttttgatacttttgaacatttatttgttttgttatatgaaggagcttatctgaaagcatagactaaaaaataagttcacatcagacattcttccagaggtgtcctaacaatatgttaaagtctgaaggcagaagttttctttcctattagccaaatttcagacctaaactttgagaagttgctgaatttagcagtaatacatcctgtgttacaaacaattcacttcataattttgtggtcagataaaataatcccaactacaccttaataaaattacaatgtagatttcatgaagccattgataatttttaatagtttctgttttaagctcttgggtaattatttttatattactaaatatcttttgccatgacttcttgttttatcaacttgacacctcgggtggtgattgctgactccattaggagtggcttgttgccagattatagcattctttctcctctcgctgttctgtctgagaactggggttgaataagtagatctttgtgtctcgaactgtcgcactagtggtcacctcccttagcttccttccttgtgtcgggattgagtgatagctttgtttgcattcctttcacctctagctcttctttttgtacttttactttttttatgctgtcaagcttgaaatcagttactctttttaactcaatttttaaaaattttttgagaatttcatgcatgagtccctttaagtattgcttgttgtccatttgaaattgggtaacatatcagggtctcaattctttttatttgttgtatgccttgatttttgagcttttatattggatattaagatgggatagtatttcaagtcccttggttttaatattgtgttttgatgtgtgactttttatgatacaaatatataaaacggattcttgcaagtatctgaaaccctgtatgattttcactttgcaggtacggaaaacttttttcaccttagcattttgtgacttttgccgaaagctgcttttccagggtttccgttgtcaaacatgtggttataaatttcaccagcgttgtagtacagaggttccactgatgtgtgtaaattatgaccaacttgagtaagtaatccacaaagaacctctttcctattactttatagttaaattttcatactataaaattagtgtactttgaaagtcgtgagggacgttttgcccaatgcaattgctaaagaatttttaaaagaacgaatagtccacgcaactcttctccctcagatgaatgaacagtggctctggtgcacataacattttcactccatactctttctaaagtaacaagtactagcccttagaaatcacttttatgtaatttggggtggacatagactactgtttcagtcaagttaactattgtctttcaggacaatgagtctgattcagcgacctagtttaccaattatgttacttttctccctcactttccacctcacccatatctgtttgtttcatcttatccctgttccctttatttaagggaatacttatacatttaagttatttctttcgaaaatttccttttttctctattttatagtatgtctaatagatatactagatgttatcattgtacaataatctttctcgataactctttttgttgctgctgaaatggaatttgactttaaaattaattataatgatatatccaacttagcagctaccaaggaggcagaggcaggtgaatctctgtaagtccaagaccagcctggtccacacagtgagttccaaggctacacagtgaatccatctcagaaaaaaacaagaaggataatctaacttaccactagatatttttcttctagtttttaaactagatgatttctccctgtgatatatagaaactgactgacaacaattagttttagagctgagcatgcccttgaaagtataatataatttttttaaaaaaaaactttcaacaaaaatatatgtaattgaactttaacagttgtttctgaaagtaaaacttgatcccacattttctcactacttctgtgttctcgtgtattgaagcttctgggttttgcacaagttaggtttgttttgttttgttttgtttttgcctcacagtttgctgtttgtctccaagttctttgagcatcacccagtaccacaggaggaggcctccttcccagagactgcccttccatctggatcctcttccgcacccccctcagactctactgggtaggatttgattcttgctgtctaatgatatgctagctgaactgcctttctttgggtcttttgtgtaattgtaaaccttttcaacacaggaactgttaaattatagatattttcctccaataatgtattttatcactaatgtacatgattacagcattgaagcatttacgtgcatttggtacagaatgggattaaaagcctggtgttagagtaggtcacacctttaatcccagcactcaagaggctgaaacaagcagatctctgtgagtggagcctgaccggatctacacagtgagttactgtcttgaaacacacacacacaatcaatcaatgggattaaagttggtgtagaccgttataagatcaattgtgaagaaagtcaacataaaattcttatgcctagtcttttattcaccattttatcaggtaatggtatgacctctccttaaaaaatattaacatatgagttgataatttttcaaaactataaatcataatagagtatattaaactttgtgataagaacataaatattttatatttatagaatgcaaggaaataggatgtactcaagaaagcttagtagagttgtgatttaaactggtctttaaagaattgctggctgccgggcgtggtggcgcacacctttaatcccagcactcgggaggcagaggcaggtggatttctgagttcaaggccagcctggtctacagagtgagttccaggacagccagggctgttacatggagaaaccctgtctttaaaaaaaaaaaaaaaaaaaaaaaaaaagccatagacagagagagatgggggaaaggggggagggaggtggagagagagaatgagttgctggaagctcaatgaactcagggagtcagagcaagtgtccagagaagagagcaggtttcagagctagtcacaaagcttacctaagtttataagtagtatgtgagagactgatatgatgcacacgtctaaaatcccagcactctggaggctgaagcagaaaggtggtgagtctgagcctaacctttgctacagagtgagatcttaatctcaaataacaacaaaaagttggaagaagaaaagtaccatatgtgagaccatgtagtagagaatcttgacattttagctggtatttgcttgagatatgaaggtgtgggagaataaagattttcaaacaagctaccaatgtgataaaaatgatttggaagggaaaatttacttagcagtgaaatacagatggacatggaaagcctacggtgaagaagacagcaaagcctaaagttgagggaaggccgtgtgaagagaagcagggcattgacaaaggacaaaaggcaagtggtagcagtcctattcatttaggagggaaagcaaacacttactctaaaaatatctccaaggcattgcattcatagtagaaaaagagacaataatttaagctggctcttgaatgtttgaataggtctcttttgcttttcccattgggttaagtcctagaagtatgtggtttttaaaaaaaaataaaaagtttctctgggtagtggcagtgcacacctttgatcccagtactctgcagtcagaggcagatggatctctgtgagctcaaggctagcctgttctacagagctaactccaggatagcgagggctacacagagaaactcttatcttgggaagatccagtgggggaggggaaggaggtaagagatgttgccagatagcattctgacctagaatagttctggactgtttagtgccggggtatttatttcactattaccctcttcctccgattcttcacagtgtgttatttctttagaccctcaaaaacttatttatttatgattgattgattctgtgggcagtgatatgtaggtatttgtgtgtatgatataccctagtacgtgtgtacctctacacaggggacagctttcatgacgcagttctctcctttcactgtggaaccagagatcgctcaagtggtcagtcagggatcgctcaagtggtcagtcagggatcgctcaagtggtcagtcagggatcgctcaagtggtcagtcagggatcactcaagtggtcagtcagggatcgctcaagtggtcagtcagggatcgctcaagtggtcagtcagggatcgctcaagtggtcagtcagggatctctcaagtggtcagtcagggatcgctcaagtggtcagtcagggatcgctcaagtggtcagtcagggatcactcaagtggtcagtcagggatcgctcaagtggtcagtcagggatcactcaagtggtcagtcagggatcgctcaagtggtcagtctttcatgacagttgcacacactgtcatcttgctagcctttatttctttagacttaaagaaggttaacattaagttgctacttataattgacctgcaatttttattgcaggcttgcaatctagttgaaagaactcgatttccaggatcaaggagagacccttcctcagataagacagaaagcaatagagaaggctacctggtaccctcctcccccatcacacatagaattggaatgtgtgtgagatgagatgagatggcttaataggtaaaagtgcttgccataggactttgtaaatttgacaaaggctaaatgtggtacagctgtaatcccagcattcatataataggatggaagatcatcccatcaacaaaagtcgatacagcatagcagtaacaagagaccctacctcaaaaataggtaaaaatttgttttcttaccttcatgtgtgcatcatggcatgcacacacctgcaaacaagcacataataacaacaacaacaataataattatagtaatagtaataataacatatataatcatattacctttttatatcactagaaaatacaactgtattgtcagattgtaatagttatctctgatggctttgccattagttgtatgacttttttttttttgtagatgatcagatcaaaataatgtttgggattttaattaatcctttggctattgcaattctcttaacagaatctatagatctgtaatgcttttctaatgacagatgccagttctatgaacagagttacagaacataaaattagcatggcctatctgaaggatcataatggtaacagtacagattgtcttctagtgaagggttgctgtttctaagtgaagaaagcatttgcctctgccacatgtattttttcttaactagagggaaatggatctggtcttgaaaactgtgcaagattctctaaaagttaatttcccaatgcttttatgtcactgtgtaaaattacctttgtaaagttagaagccaattagtcaaggttctctagaggaacataatttatataatgaacttatagaatatgtgtatatgtattatgtattatatttttatatatgtacatataaatacacacatatgtgtagacacacacacactactagaatggtttacagattatggtctagctagtctactaatggaaagtccaacaatccagtagttgttcagtccatgaggctggatgtccctactggtcttcagtatctgccagaatcctgaagaagtaggctgactctaatgccagtaaaagaatggacttgctagtgagagtgagaacaagcaggcaaagagagcacgcttccttctccatgtcctttatctacgctgccagcagaaggtgtggccagatttaaaaagtgtatctttctacctcaaagatccagattagaatgggttttcccacttcagatagtttagttaaggggaaaaaaaagatccctcacagattcattccagacgtagtcaagttaataacaaaaagtagacacatcagttatattcaatatcacaatatttgatttgttgcttgttagtgcaattttaaaagtaatggtatttcttttttcctggctagctcgcacaaaaattaaacagactataagatttatttaatcaagctttatagcacagtatttgaacatttattaatctattttaatcctctaaactaatctggctatcttccagccaaaatccccaagacacttgtattttagtattgatgtgactttttctgctccaggtgtattcccatagttgtcccctcagctctcctcatggctgaattctcccttctcttctttcttttcccctcacctctctggaatcagaagtccagccctactctctcctctgctcagccactggctatcagcttttattgacaaataagaggataaatgagaacaatgtttacacaacattgagtcaggagatactgagaatagccatgtctgaattgcaggcagatatggggacagaaaaatcagcatttgaataatacaaggataatctttacacagtgttcagtaacttgcctacagttactagttctgacaacaactataacagtcctaagacaagtatgggcataccaagaaattttctaaaattaatacattacccagtttagaatataaagagataattactttctttttatcacttacagaaagttactgtgcttcaaaaaaattttaaatagtgtaacctaaaacttaagcctaaattatagtagttttctaaagagtgttagaattaaaattctgtttatttttaattttaaaattttttaagtttagttttaagaaggtatgtggaagggtcagtacaaatatatacctgtgggagaaagccaattaggtgatggccaagatccttcataggttagttataaattgcctacttcaaggaaagagtccacaatatgcaggtatggctttataagttttccaaatgatgacaattaggaatatactagttaagttgagcaaaatcagaacaaagaatatacatgccacctaatccagacttgtgtaggatgggcccactcttctttggaaagacagtaatgagaagcaaaattatagttagaggattgcttttgttaagcattgaattaaaacatacagatgggtacaataatgaaatattgctcagagttaccatatacttgccttcaagggtagagaagttaactttgaactcaggcataccttcaccctccagatggtattaatacatcacatggattttgtgtttcaagccctcttcttttaccagattaaatacagggttttatttctccttgtttctgaatcactgtcctctgaaaacagagtttttatttcttacccagttcatatttctgtcatagtttttactgagtacatttcaggagtagtttatttcctctctctctcaatgctaggtcacatattatattaattagactattctatacattctagttaattcaggctttcccagattttagtcctgaattaaaggcactattgtcctaagactgtgagtagcttaacagtttttatttctgaatacttattaactaataacattcttgtaatttttagctctttgaaaattccttagcaaaggaatttttgtttctatttttatttagctttataaagcaagaataaggacagctttaacaaaatttctcgataaccagatgaaacataacttccctcaaatccagttccattaattgtagttaggcttatgcccgtttcttttagagaatagtgtttgcatcctgttcattgaagcagactcgcatagtgaatatgaatgccctaaaatacatttctttccttatccttatatcacgagcttcctagcctgatgacgtgctttgtttaaaagacttttgttactcttaagctttgctctccaaatctttattctacccttttctattgctttttttattatatgtatttaatatgactgtgtgcatgtgtgtctgtgctcatgcacatgctgaggcacctttgtggaagttagaagacagctttgtggaataaggtctccttccaccacctcggctcccgggtcaatcccaggtcatcaggcttagtagcaagtaccttttgatccactgagtgaccaatctcattgtcccctcctactgtattttcttaccattcttttatgatttcccttgttatctcaacaatgtctttcttgtctaataacaaccaaatattgctggttagcttttatactatggggtaaaacgctgagcagtatgtgaagagaacttggtccatgttggactttccatggccagttgacacttaggctgagccttactgtatcctcccgaaagcagtaatcacttctctgctcctgagaatcttttctgaggcagctacaatctttttaggagtttataatctagcctctggccaggctctttaggccagaactcatagattttattatctgtatcaaaaatgttaattagtaagtcattctataacctattaaagtattttaatcaaaataattttagggctgggaagatgactcagtggctaaagtccttgtcatgcaagcttgaggacttgagtttccatcctcattgcccacctaaaaagttgggttgtgactgttgttgaaacccatgaccccagtgttgcaggatcacacttggaaccccaaaattgtgttatttactggggggaaaatttttcagttatgtatggtgtggctcaggccttagcacacacctttaatccctctggctggaatatagacatgcccttagtacacatgtttaatcccaaacaatgagataaagttagtttgtagaaggaagcactcatgtttgaaagtgatgactcggagaaggatttgacagaatagaatatgcccaacttgagacattcttgcccagagtccctgcagcttcctgcttcaactgtgcttctacagaactgggtgcccaacccctctgaccccagttggcttttctgagcctgagccctttgcaaattagttgctctgctgcaccttgccctgccactgccatgaccaatgctgctcccacgaaagtgttgccgaattaccatcaggatcaggaggctgctggcaaccatcagatcaactcggagttacatgcctcctgcctctgtctgtggcttgctgttttgaccgggatgatgcgactctgaagaactttgccaaatactttctctgccaatctctgatgaagctgtagaaccaatgaagtggctgaattttcctgccggatataaagaaaccagactgtgatacctgggagagccggctgaatgcagtcgagtgtacactgcacttggaaaggaatgtgaatcaggcacaactaggactgcacaaactgactatggacaagaatggtccccacttatgtgacttcactgaggcacattatacctgagtgagcaggtgaaatccatcaaagaacagggtgaccacgtgaccaactatgcaagatggtagcccctgaatctggcatggcagaatatctctttgacaagcacaccctgggactcagtgatgaagctaagctgacttccccaaagccatatgactttactggtcactgaggcagtgcatatatgttgggctgcctttatcttttctgtaagttgcaccaaaacatcctcttaagttctttaatttgtaccatttcttcaaataaagaattttgatacctccctcaccccaccccaccccaccccacccccaaaagaatacccaacttacaagagaaaaaacgaggaaaaagaggcttcttaagagagcagcatggccgggcgtggtggcgcacgcctttaatcccagcactcgggaggcagaggcaggcggatttctgagttcaaggccagcctggtcttcagagtgagttccaggacagccaggactgcgcagagaaaccctgtctcgaaaaaaccaaaaaaaaaaaaaaaaaaaaaaaaaggagagagagagcagcatagagagaaaaaaggagggaggtagttttactaggttacagagagagaacaaacttgatcaggtgatgagagaatgagaaagagccagaaaattagaccatgttgccaaagttagtatgagttcaagcagagcaattcaggagaggctgcgagagaagccagattcagtcagtcagcttggagaagagttttgaagcagaacacctgagttgaaccagtcagccatggttcagaaagaagaaggaaaaagtgagcttagtcagcagtaaagctcagaggctgaatacgttcaaggcctaaagtaagactgcatggaggctagaagtctccatgactaggcctagcttagccgactgaggccataagcctccgagacaatttcttccagggaataaaagatacttttacaccccagtcctgggaagacagagataagaagattttcggagtttgctggccagcagtctaataaccaattgtaaattctagcttcagtgaaaagaccccgtcttaaataagtggagataaagcaattgacaccagtttctggcttccatgagcacctcacaactacaataccccaaatttttttagttattttaaatatttgcttcagtgtttaatattttatggttcttcccccctctctctttggtctctggtgttaatgagacatgaaaaacattttgaaatatggacaataaatggcaccatattgattatcttccaagattttggagatggtatttgatattataaaaaaattcattcaatactggtattaagtagtaattctatctttagggtcctaaaatgtacaagaatattctcaaaattacttgtaactttctaactaccttcttcagatttttatttcagtaactttaaattatgaaaaatagtacataagaaaacggcatattttattcaactagtctctacctgaaacattttaattctatatataattttaaaggataattaagaacttctactgatgaaccacaggtaatttctagccatttgtagattcctctggagttttctggtctgcttttgagcaaagctttggcagtactagttgtaggtatgttttttttaaaccaatgctttttgtaaagctattactactggaatttcgtttctttaaagcttatcattttaaatacaacaatcttataactttcattttaaatattattattaatataattgctccaactcttatcttccccatgacttggtttttccaggccccaaatcctcaccagtccatctccttcaaaatccattccaattccacagcccttccgaccagcagatgaagatcatcgcaatcagtttgggcaacgagaccggtcctcctcagctcccaatgttcatataaacacaattgagcctgtgaatatcgatgtaagtacagcactgctagaactaaacaattggagtgtgtttctctggttttctgctgtacttttaatacagattggacgtaaatgccacttttcatttatcatgtaaatgttgggctcctacattatagctccaacaccctgtcacggtctctaatgacagtaagggcttcaccgttaccaagttgcacttattctcacttttttctatgacactatgtctgaaaatggttttagttaaaatgactttatcttaatttaaatttaagaatttgaatttaagaattaatagatgcccatgggaattcatgaattctctaagatttttgtgcaattaatgtgttatgaaaatgacattaagaatttatatttttttctgtcatgagtttagcattagaaccaacaaaaacaattctaaatttgtatttttaaaaaatcttacagttggaactataacttaaactttattaactttcaaagtgctttattataaattttatttaattaccaagataaatcatgaataaaagattataaaatcagactttcttcctagtttttattaggtgcccccctatattttagagagtacgttcatataagtagctttttcctagtatcctttttaactaagacctttctctctctatgtagacctgaacacacaggaagagacaagtgggaaagggagatatgggaggaaggaggttggagaataaggagtcaacggtatctgtaggttaggtgtgttcttgatgtgttcaagctcagagcttcatctttatttgaaaacaaaccgccttttaaactcttccccttttctctgcttgtgactgtcctcctggtttcttgggcttggctagttgaagagtcacttcatgccttcctcttacccttttcataactgccataactgtttttccccattatgtcttagactctgctgacttattgacaccatttgcctccacacccttcattggaacctctgaatgcatttattcccacacatttccacctcggtgctctcaccgggatacatttttatgatactttttaaaaaatatttaattggggctcacttacagtttcagaggttcagtccattttcatcatcatgaggagcatggtgacatgcaggcaggtctttacatcttgagccgcaggcagagagacagagtgtatgagtttgagtctggtgtgtgcttttggaatttcaaagccaacccctagtgacacacttcctccaacaaggctacttcctggtaactaagcattcaaatattatgaagatatggggatcattcttattggaaccaccacatagaaaactagtagaaagaagccaaccaggcattgtggtatgtgcctttagtcttggcgctgagagctaaaggcactagagaatcagaagtgagaggccagcctatgatacatggtaccctggagaaggaaggagaaaggagagagtgaatgagtttagcaattacagctgatcctacttgtgcagatgttcatagatagcaaaggtattgccagaagctctttagttggtttcttctatgatgttgagtcacagggatgacagacaagggactagaagagattagggaacagttgaaatcgttttaaaatactagagtatcctatttaatctaggttctagtagacagatgaactgggagctttaagaacacgtgagattgagaagtgtaaatgtgtgttggacctggcaggagtggaaaagccacattcggctcatctgtaggtgtggggggagtttcagagctagggtaggaaacaggaaaagggatgtaactgttctcttgtggggccatctatctagaaagccccttgtttttatacatgcctgtccattcttcacagcccgttctcaggtttcttcagctgcttcaccaatgccaaaatactagtgtcatttcttttgcactatagtcaccaattctcatagatgtggaggctggaaggccagtgtcagatggctagaacatcatagtcttaatctatgtcactaaaagccttgtcaataccactacatggtagtaaattataataaactgatgtatctctcttttattctgaaatagttacttatttttcatgtgcctacatctcactgtgtgtttgtaagctctgaaaccaaggaaaagtagtgaaaccacaaagacttttgtgtgttgaaggttctatgtagtacaccagtaaagaattcactttttattttaataagcaaaattgtgcctatttgccactaacctttttagagacatttgtggccttttaatcccttacacttaagttaagctgagtaaactaatccgtgttctgtagactaggatccaaatttcattacatatggaatttcccctcctgccaacattactgtaaaagctgcattttaaatatagagaccaatttaaacaaaatccttttttgagctattttaatctcccctcctttttaatgtttcttatacatccacatttttatggtagtattcagtgtgcttttaattttgtattttttattaaatgtaaacatgtttcatgttttaagtttcataattgcttggtaactgtgtactacttcataaattgatacaccataaccataatatgtcaaaatgcctatcataggggagtaattatttctgatttttggtgtgatggataatgctgcactaaacatctttgtgcatatcattttttcttctgaattatttccttaggaaaaattcccagaagtggaattacaggatcaaagggtatgaacatttttatggctcttaatatgtgccagtaggattttctttaaggatttgtgaagccactgagtggactgaaatggatttcagcatttgacaaggactaataatcctttcacataggtctaggttggcaagtgcttcaaacgttagtgtttgtcatgtacactagctaatttaatagtctttgctttgtgaaataattataagacaggtattgttttgaattaacccttctgcttatgcatagtagaaaatccgttgttgttgttgctgttgttattacttttttaccatgtgctttgaataaacatattttactatttgtttgtaggatttgattagagaccaggggtttcgtggtgatggaggtaagtagtgactttagggttgttgttttattttgttttgttttgttttgttttgtttttgttgttgttttaaggcaaaagtgcaattgctttgctgcttgtctcctttatggttgctttttctttttttttttttttcatgaaacagacacagagaaaaatgtgtagagaaaaccaaagggtttttggttttttgtgtgtatttttttaatcgtagttatcatttattggtagcagaatttaaaattatccatgacaaggagagaaaatgagaagacatggaagaaagtcttaaatgctccccttccaatcttaggtactccaccaaggagggtccttaattcctttgtccactttttaatttttgctgcctccaaagctggagtcactaaatgtcttttggcctacaccaaatactcacagatagagcttagaatcaggttaaatcattctatatcattctttgggattgcctgccacatcccctcaatttgtcagactttttcaagcatttcccacccactttatagatctatttggaatacatatttatttcatggaatagacccataatggaaaaatttagtcactcccttgttggtatagtaaaaaatatatacaaatgagagattatattcatagaaaaatttagttatccccttattggtataataaggaaaatatacaaatgagagattatattaagattcttacagaatttccatctagctttccctctagtaaagataatattgttttaagaaaatgctttttgagccaaatgtgatagcatatgcctgtgatccgagctgaggcaggaagaacgtaagtttgaggctagcccagtatacatagtatggctctctcaaaaaaaaacaaaacaagcaaactctgtaataatgtaccacgtatgttttctaaaagattgcatttgagactgtcttcacattttcttgcaagagctcctctgtgctttccttctcagctgccttctgtcttacaaggaagactgtaggagctgtacaccatgcctagagctgggttcttcactgtgaccttctatatctgcaaaataggtccaagcccagactcgatatttttatactgaaagtaaacattgtaagccatattttgttatggttctgtactctgtgaagnnnnnnnnnnnnnnnnnnnntaacgagcctaaattatgtacttaatattgactttatcacatattcaagagtttgtgttgtttgttattccatgagcctgccaattaatgttgctgccagtttgactttcatatgtcttagtaactgtggctgctgataattttgcccaatacatccagcatttaaatgtttccatcgtgttagcatcacagttaacttagtagtaaacagcctgcttagtacctaaagtcaagtggcatttcttatttttgttatgagtcactttgaaaaaattaattggggtttttgtgaaaatataagcagatttttaaaatatcatccagaattattttgtgaagcaggcttcagttcatctaatttattccccatgacttctttcatttcttctgtgtgtctgtcttcctgtgtttgcctgcccctctctttctcttctaacagcccccttgaaccaactgatgcgctgtcttcggaaataccaatcccggactcccagccccctcctccattctgtccccagtgaaatagtgtttgattttgagcctggcccagtgttcagaggtagttgggctcttctttcttgttctcacccaagcaaactaaatataagatacagactctgtttgtgcctccctcacagcgtgtgtttgtaagtgtgagagttaagtactaagtttctgcttggcctggctggagtgctctgaatgtgcttctcacaccctcactaccgcaagcctcctgtgtgctgtctagtacaaagtttggaaagcaagagatttcggagttaacatttccatcttgcttaatgttgtcttatttctacttggtcttgataacttcttaaattctgggagacacaggcaggattctttttattttagtgcattggatgataattttcaattaagtaatattaatttgtttaagaaaataaaaatgtatatggaaacccctatgaaaaagggtgttttatattgggcgtatggctcacatctgaaacttcagcacttgagatgcagagacaagaggaaaatcactgcaggtttgaggccaaagtattcttatgagacttttgatagtgttttgaaatttagtaatattaatcattttttgttctattttccccttatatatgatatatattttagttaatctataaacatgagttcaaaaacactgaatttatatattgacttatgcccctcacataaggaaagttaataactgtccagtattttaccatgtcaatttactttaaaattgacttaaattttaagatgaaattggatatctttttaaaatatgtctacagttatctttattgctttgatacactgagtgacttatatttagtataatgtggtgctttagagatttccatcaacccagctacttttcagataaaccataatatagtggaagtcattcagtacttagtgatgtaattaaactaaataatccagtgataagaactgtgcctgaggactgggcaagttgttactgctccataaagtggaaagttatcagtgaccagtgtaaaatgtattgtgctctagttcaaagaaattccagacaccattctcttttagaaatttgcatatacaatcatagaattttcatatggtgctataacataatatagtggctacctagaaaattctacctagaaatctcaggtctattcactgtacactctggagagtctttgctcaaaattcctgtcccagatactatacatattgctactgagttaactggaagtttacatatttaaaaaagttccatttctgctgctcagagcctacttacaaggttcactttgcatataaaatagtagaatatatgtgaaatatggatgatatgccataacctttacttgttcacttttataataccaaggtttcagaaagtcttaaagcctctttagtgggactggggtggtagctcatcagtttataagcactggctgtttctccataggacgcggttcccttcccagctccactgtttgtaactctggcttcaggagctctgataccttcacacagatggcacatacaggcgaagcaccagtgcacataagataaaaataaataatttttcaaaaagaaagcttccttagctttgttcatattaactttgcacaaaaggtaacaaagagtctccgtctaatagaaaaacctcaccaaccagtgacactgctcaccgtctgtctcttaaataatagaacatgtagtctgctatcctagataaatgtatggctaataggaaagaaatacttaacaggaaggccattaaaatgtttcagttttaatgtttacatgtttttgaaatattgaggctactgaaataaaaaataagtttgttttgtagaaataagcattgattttgtttttgggttcttgttagttttttctgttttatcacacagggtctttgtattatgtggctctggctatcctagaattctttctgtagaccaggctggcctcaaatgcagagatttacctacatctgcctcccaagtactaggattaaaggtgtgtggcaccatgcctgtgcatttgttatgatgttttaattatttatcaaaggcacaggaacttgggagtgaattttagaaattgtgtcttggcttagagattgtgtttttctaaacttgtttattattatttattttaagggtctttagattggcccaaaaaacaaaacaaaaaaattactgtacaaattacatattatgtttcttttggcctaccctttgttaagggccaatatttaaatatgcactccatttttaaagtctagatctccccactttctgcccctgttgtgtggacatatttgttcctccttaatgcttactcctccctaatgtggataatttcccctttttctaatttagggtcaaccacaggcttgtccgccaccccgcctgcctcattacctggctcactcactaacgtgaaagccttacagaaatctccaggtcctcagcgggaaaggaagtcatcttcttcctcatcctcggaggacagaagtcggatggtaagcatctgtgctgtgctcctctaactgtgacgccgggttcccatcacatggaatattgcatagcgcatatgctcacaaaactgacttttgctctggtttctaatatagtttttgagggcattttgaaagggaaataatggtgttctgtttctaaaatgaggagaatgagactaagcaagtatttagaaggcatgattaggcatataaagcatatgtgctctaaaagctggtgcagaattcaagtgtctaccaaatggcatccttccatatttgaaaaataactttcttctacttctaccttatccaaagaattggtatattggtttatttatttattcctttatttatttatgtttgatggccaaatcagttaagacatgtaaggaaatccagcagcactagttagagcatggtaacttgaattgttgggacttgaagccaaaactagcctcgaatgtatagtttgtatcatgcctctgtagttctccacatagttaaaaagccagtttattttaagaataacaaatgtatttctacacatactaaatcatttctactttgaactttttaattagtattcttttgtgtgactgtgtgtataagtccagcatgtacatgcccagtggtgaaggaggtcaggggagtgtaacatatctcctggaactagagtaagaatgtgagctgctagctgagtgctgggactcgaacctgggtcctctggaagaaaagccactgcttctaacttctgaactatctctccagcaccaattatttctaattttaagtaattattccatcctcatattggctcattttaaatgtaactttatattttgagtcacaaatataactattacttcctcaacatggatattttatgttttctttcttcttcttttttttagaagaccttgctctgttcctaacttcctgtcaggcaggtcaatatagttagcatgaaacaaggtttttctcttttgtttgccttggcttgacttttgtactctatttttcgagaaaacacttggtagaagagattcaagtgatgactgggagattcctgatggacagattacagtgggacagagaattggatctgggtcatttggaactgtctacaagggaaagtggcatggtatgtatgtaacatggtgccattggcacaagtgggacatggtatgtataacacgatgccattggcacaagtgggatatattaagaaatgtttattaaaaagaagaagcagcagccaaagctgggtgtgatagcacacatccttaaacccagcactcaagaggcagaggcaagtagatctgagttcaaggccagcctggttcacagagaaagttacagtacagacagggctacacagatctgtcttgggaaggaacaacagtcatgatgacatacactccgatattccccacacttaggaggtataagcgtgaggattaggaattcaaggacatccttagctatggagaaagttcaaggtcaacttaagtaacaagagattgtctcaaaaacaaatatgaagtaaaaatattcactgtttacaccattaaactgttttcatcaaatgcaggagtcctccaaaggtttctaacaaaaatggtggaccataaaaactggcttcagagtaactaagattgctgttatactttatattaatgattcataaagatgaaggtcttctagctatcagtcccaaaggaagttcgtttttcttttagaagtattccttttgatgattttatgggtattataaatcaaaagttaacataaaaagtgttcagcctcactagttttctaagaattacaaactcagaagacagacgtcatgactttctttgaacatagattttttttttaattgatcatgtgaagattgtgattataatcctgtttattttgtagaaatatgaaaagttggcgataggtacactgagcctaagcacgtaattgaacagcaatgaataggttgatggttggggaagtatactcactagcggtataataataatagaaaatgaaaataatgtgagtactcactagtagaagattcagttagcacattgacacatccatatattgttatataagaatcaaaattatataatagttacattgatatggaaaggttttaatatattgatttgtttgaaacagcatgtataatgcctttatataaagatctatataaaatgcatttaacagtataaaaatgctatctgaatctctcaagtttattatttcgtatacattcataagttttatactgtatgcatatataagcatgtatatatgcataaatatatatacacacatatatatgtatggtatatataagttttaattctgagtgccatagttaggagaattttttttaatgatttactcatgattatgagtgctctatttgcatgtacacctacatgacaaaagatagcatcagatcccattatagatggttgtgttccatcatgtgtttgctgtgaattgaaatcaagacctggaagagcagccagttctcttaactaagccatctcaccatctcctatggaacatttatgttttcctaaaacatttaagtaataagcactgttaggtagtatccaataaaatgaatactatagaactttggtagttaagaaaaatcaagatttatagtgattatgtttaaatgtattaaaatgtctacaagtgtttaggtaattgaagctcaccaagtgaataaatacatttgtgattaataaatgtaatattattagccttctagaaggtctccacatgccttcttcattcactcaccctgcaaagacaacaaacatcctaaccacaatagaatatattgtgtaatctttctctcaaatattttatggtccatcaatgttgttgggtatgtttgtgttttatttgtcccctgaatagcattccattgtgtgagtgaaatgtgattccttccatctattggataataagcatttgggtacttcccactttggtgcaattctgaatgatgttgctgtgtatatttttaggatatgtcttttaaagaacatatgtgtattttttactggctatatgcctaggagagaattttaaaactacaccatatgcatacttgcaattttatatatactcccatcggtgctgctaagtaattataccagtttatatacccaacaaaagtgtataaaacactagaagtatttaaactacgattataattttaataatttttccagtccacataagtaagccataacgtttggaaaaaaaattggcaggtttttactttaagccaagttgcactggacctgttttgttgtccatggttcgagcactcactgaccaggtaacattttagtcaacatcggtaactcattaggagaactctccaagtacttagttacctaagtgtattcccagggtgaggaagttcactatattttagcatatattttcaaacaatagtataggaatatcattgttagttgctttgtgtgggattgaaggatgtgcgtgccccatagtatgtgttaaaaagaagaaaagtagtttattactaggtagttaaatataatttatttacagtttaatagggatatgaatttaaaactgacaattagcaaaaaacccaagaataaatatttcacatttcacaatttgaaatcttgggtaacaattttctttcaggtgatgtggcagtgaaaatgttgaatgtgacagcacccacacctcaacagctacaggccttcaaaaatgaagtaggagtgctcaggtgagcgagtggccacagctttccagtgcagtgacctaaagaaacaaagtgtggctgcttagacttcacgttcccattgttgtccaccgtttgctcctgcatctagaaaactgaattaatggaaataagaaatgtctgattgtgtctaatagtagttccttttaggaaagtaatactctaaatgtcctaaatgtatcaaaacacgtttaaaattgtatttagtcctaggccctaggacatgaggaacattgacaaatgagagagagtaaatccatgataagaaaacttaggaaagattctgtggttaaaatcttatgtgaggggagtgttcaaccaaactgaggttttaatccagagaagtgtcttgtattcaagaaggtacacagttactctgctattgtaaagaacagaacgaggaagctagctgtggtggttagaggaaaatgggtttacgtccacatagaaaacctcctaataaatttggaacaacttaaacaaatgaaagcaacctcagctcctagcttcctcattcgatatgtttctgtatttctgagtggagctggaggttaaactcagtaattagagctcaaccttgctgtgtttctggtactttttccttgagcaccgtattgatttgactctctttaaagaattgttactcattgtcacgtttctttttggcaggaaaactcgacatgtgaatatcctccttttcatgggctattctacaaagccacaactggcaattgttacacagtggtgtgagggctccagcttatatcaccatctccacatcattgagaccaaatttgagatgatcaaacttatagatattgctcggcagactgcacagggcatggagtaagttcagtgctgttaaatcttcatatatggcttttgaaacccacttaaggatacactaaaggtcctgatgataacctcttatgggttgcagaggtactaactactagataacacttacataatcaaaattgctatttctctagttcagcctttaacatatataaggaagaagtaaggtatttgatgagaagtttataattgcaaatgatgattagcactaagtgatttatataaacagtggaagtacagaaaagcaggagccctcaaaaaaaaagaaaaaaaaaacccactaccactaaaaaaaaaaaaaaaagccattaaagttaataggaaatatgtgactattattttaaatgaatgtctatattttgatccttgttgagaacttcaagttgtaacaggtatatctactgaattttactttgtaattcaaaagatacgttattttatgatttatactgattaaaatgaaccaggggtaggtgtggtggtgtaca

SEQ ID NO: 1452 - DNA, 2164 bp, Mus musculus
  misc_feature (1)..(1): "n" at position 1 can be any base
ncggcgctggcgccgcggcctcttcggctgccgacccggccattcctgaagaggtatggaatatcaagcaaatgattaagttgacacaggaacatatagaggccctattggacaaatttggtggagagcataacccaccatcaatatacctggaggcctatgaagagtacaccagcaagctagatgcccttcagcaaagagaacagcagcttttggaatccctgggtaatggagcagatttttctgtttctagctctgcatcaatggacaccgttacatcctcctcctcttctagcctttcagtgctaccatcatctctttcagtttttcaaactcccacagatgcatcacggaacaaccccaagtcaccacagaaacctatcgttagagtcttcctgcccaacaaacagaggacagtggtacggaaaacttttttcaccttagcattttgtgacttttgccgaaagctgcttttccagggtttccgttgtcaaacatgtggttataaatttcaccagcgttgtagtacagaggttccactgatgtgtgtaaattatgaccaacttgagccccaaatcctcaccagtccatctccttcaaaatccattccaattccacagcccttccgaccagcagatgaagatcatcgcaatcagtttgggcaacgagaccggtcctcctcagctcccaatgttcatataaacacaattgagcctgtgaatatcgatgatttgattagagaccaggggtttcgtggtgatggagggtcaaccacaggcttgtccgccaccccgcctgcctcattacctggctcactcactaacgtgaaagccttacagaaatctccaggtcctcagcgggaaaggaagtcatcttcttcctcatcctcggaggacagaagtcggatgaaaacacttggtagaagagattcaagtgatgactgggagattcctgatggacagattacagtgggacagagaattggatctgggtcatttggaactgtctacaagggaaagtggcatggtgatgtggcagtgaaaatgttgaatgtgacagcacccacacctcaacagctacaggccttcaaaaatgaagtaggagtgctcaggaaaactcgacatgtgaatatcctccttttcatgggctattctacaaagccacaactggcaattgttacacagtggtgtgagggctccagcttatatcaccatctccacatcattgagaccaaatttgagatgatcaaacttatagatattgctcggcagactgcacagggcatggattacttacacgccaagtcaatcatccacagagacctcaagagtaatagtatccttcctgaaattgatatatttcttcatgaagacctcacggtaaaaataggtgactttggtctagccacagtgaaatctcggtggagtgggtcccatcagtttgaacagttgtctggatctattttgtggatggcaccagaagtaatcagaatgcaagataaaaacccgtatagctttcagtcagacgtgtatgcgtttgggattgttctgtacgaactgatgaccggccagctaccttattcaaacatcaacaacagggatcagataatttttatggtgggacgaggatacctatctccagatctcagtaaggtacggagtaactgtccaaaagccatgaagagattaatggcagagtgcctcaaaaagaaaagagacgagagaccactctttccccaaattctcgcctccattgagctgctggcccgctcattgccaaaaattcaccgcagtgcatcagaaccttccttgaatcgggctggtttccaaacagaagattttagtctgtatgcttgtgcttctccgaaaacacccatccaagcagggggatatggagaatttgcagccttcaagtagccagtccatcatggcagcatctactctttatttcttaagtcttgtgttcatacagtttgttaacatcaaaacacagttctgttcctcaaaaaattttttaaagatacaaaattttcaatgcataagttcatgtggaacagaatggaatttcctattcaacaaaagagggaagaatgttttaggaaccagaattctctgctgcccgtgtttcttcttcaacataactatcacgtgcatacaagtctgcc

SEQ ID NO: 1453 - DNA, 1845 bp, Mus musculus
atgattaagttgacacaggaacatatagaggccctattggacaaatttggtggagagcataacccaccatcaatatacctggaggcctatgaagagtacaccagcaagctagatgcccttcagcaaagagaacagcagcttttggaatccctgggtaatggagcagatttttctgtttctagctctgcatcaatggacaccgttacatcctcctcctcttctagcctttcagtgctaccatcatctctttcagtttttcaaactcccacagatgcatcacggaacaaccccaagtcaccacagaaacctatcgttagagtcttcctgcccaacaaacagaggacagtggtacggaaaacttttttcaccttagcattttgtgacttttgccgaaagctgcttttccagggtttccgttgtcaaacatgtggttataaatttcaccagcgttgtagtacagaggttccactgatgtgtgtaaattatgaccaacttgagccccaaatcctcaccagtccatctccttcaaaatccattccaattccacagcccttccgaccagcagatgaagatcatcgcaatcagtttgggcaacgagaccggtcctcctcagctcccaatgttcatataaacacaattgagcctgtgaatatcgatgatttgattagagaccaggggtttcgtggtgatggagggtcaaccacaggcttgtccgccaccccgcctgcctcattacctggctcactcactaacgtgaaagccttacagaaatctccaggtcctcagcgggaaaggaagtcatcttcttcctcatcctcggaggacagaagtcggatgaaaacacttggtagaagagattcaagtgatgactgggagattcctgatggacagattacagtgggacagagaattggatctgggtcatttggaactgtctacaagggaaagtggcatggtgatgtggcagtgaaaatgttgaatgtgacagcacccacacctcaacagctacaggccttcaaaaatgaagtaggagtgctcaggaaaactcgacatgtgaatatcctccttttcatgggctattctacaaagccacaactggcaattgttacacagtggtgtgagggctccagcttatatcaccatctccacatcattgagaccaaatttgagatgatcaaacttatagatattgctcggcagactgcacagggcatggattacttacacgccaagtcaatcatccacagagacctcaagagtaatagtatccttcctgaaattgatatatttcttcatgaagacctcacggtaaaaataggtgactttggtctagccacagtgaaatctcggtggagtgggtcccatcagtttgaacagttgtctggatctattttgtggatggcaccagaagtaatcagaatgcaagataaaaacccgtatagctttcagtcagacgtgtatgcgtttgggattgttctgtacgaactgatgaccggccagctaccttattcaaacatcaacaacagggatcagataatttttatggtgggacgaggatacctatctccagatctcagtaaggtacggagtaactgtccaaaagccatgaagagattaatggcagagtgcctcaaaaagaaaagagacgagagaccactctttccccaaattctcgcctccattgagctgctggcccgctcattgccaaaaattcaccgcagtgcatcagaaccttccttgaatcgggctggtttccaaacagaagattttagtctgtatgcttgtgcttctccgaaaacacccatccaagcagggggatatggagaatttgcagccttcaagtag

SEQ ID NO: 1454 - DNA, 96595 bp, Homo sapiens
tgccaccacagccctgctcccactgagaagtctcctgcttataaattttaaaggcagttttagccacatcttctcttcaacatttcaaaaatctttgggcctggtctcatccaaaacaatccactgcacttatgtccaaaatgtattatataacatgaaatgtaaaacgataaaatagtcaatcttctccttaaagtaacagggctcctcctggcttctgaatttcctaacctccaacttcttctattattttagtcactaataacttttcctagagagtgaatgattgtcctgtacaaaatcaggcatgacatgtttatattcatgaaaacaaattcttttttttttttttgagatagagtcttgctctgtcgcccaggctacagtgcagtggcccgatctcagctcactgcaaactctgcctcccaggttcaagccattctcctgcctcagtctcccgagtagctgggactacaggtgccaaccacacccagctaattttttgtatttttagtagagatggggtttcaccatgttggccaggatggtctcaaactcttaacctacactgatcctcccatctcggcctcccaaagtgctgggattacagacttgagccaccacacccagcctatatttatgaagagaaattcttatatgaaaagtgccatctacaaaaccacactaattctgaataatgtaagagagatacatatatatatatatatatatatatatatatatatatatatatatgcatctctgagtaattagaatatttgcctcccaagccattaggttactttaatgtataaaatatataaactgtgattgacatatatactagcaatctaaatcagatatagctataaaatgttaaattaatatttggcctatattatctaataatgagctattaaaagcataaggaaatgattaaggcagatgctgaaaccagaacttcaaacccaggagcaactgagatggccagagaagtatcaaagtaataaataaaagagttttaaaagggaaatattcatattttccttcagtagaggacacctaatgtggaaagatgtgaaagtgaagacatatacatttaccaaagtgctgttgaaaaacttctgaagtagctgaactcaattactgaaaatgattacagggattcaatgaaagagatttatgttatatctgcaacagagaataaaggatagaattagtatttgtctttaaataataaagttaaaaggtggtaactaactgagatttttaaaaattacaggttgaatagctgatgaagcagaaagtgggaattgtagagctcagcttgggacttgccagtttggcagtgtttgtgatatattcaggtgcagacatctagtaagtagttggatacaacaggttgaggccagggaaaacattattgtaaataaaaccaatggaatgggtaagagggtagaaggagttctgcaacagaccagatgtttgtgttcccccccaacaagttcatacgttaacgtcataacctccaatatcaggaggtaagggctttgggagggtcatgaggatgaagccctcatgaatgggattagtgaccttataaaaaggggccccagagagctctcatgtcctctttctgccacatgagaacacaacgagaagacagcagagtgtaacacagaagagggccctcaccagaacctggctatgcaggcaccaggatctcagactttagcctcaagaactctgagagatcatttctgttgttttaaagccacccagcctgtagtactttgccatagcagcctgaactgactgagacaagttctgtaagaaaagaaataggcaaagaatggagccccgtgttataccaacagttaaactgcagatggtcaaaactgaccccattaaggaaaccgagaaagaactggccttcaagaaaagaagcaggagtatgtagcatcatgacatctaaagcaacagatattttcaagaaaaaggaaacagccaaaagtatcaaatgcaaaaagaggagcaacacttcatattgtgaggcagaaaaggaggtaagaatgaacaaaaatgcatagaagtttatagttgtaatttgaagctacagagttcatatcttacagcctatattttctctgtggagtgggaagcaagatctcataaaaacatatctatacctaaggatcaaacacaagagcaaagcacagatttgaaaatcggcatcagagatattaaacacacaaaaacaggccaggcacagtggctcacgcctgtaatcccagcattttgggaggctgaagcaggctgatcacacggtcaggagttcaagaccagcctgaccaacatggtgaaaccccatctctactcaaaacatgaaaatcagccagacatggtggcgtgcgcctgtaatcccagctactcaggaggctgaggcaggagaattgcttgaacccgggaggcagaggttgcagtaagctgagatcgtgccactgcactccagccttggcgacagagggagactccgtctcaaaacaaaaacaaaaacaaaaaacacacacagaaagagaagttctggtatctgtaaaagtgggggtactattagatatgtactctttaacagtgtactgtatttaaagctctcctacagtaatgataaatgttaaaacaaacaaaaaaaatctaagactgtcattgttcagattatataaacagcctagcacagtagctggcacacagcacacagtagctatgcgataaatatttgttgaataattgaggaaataaaaaaatggaactaggggacaccataaaaatattttaagaagaaaccaggaaaggttttgctgtaaatgtttataattaaaaaagcgtattccatataaacacttagaataatatacctatatttaatatatgggaaaattcctacttgataggtagagatacattacaaggtcttattaaaacttgatcaaaacccataaaaaatgttgtcttggctgggcatggtggctcacacctgtaatcccagcactttgggaggctgaggcaggcggatcacctgaggtcgggagttcaagaccagcctgaccaacatggagaaaccccatcgctactaaaaatacaaaattagcctggtgtggtggtgcatgcctgtaatcccagctacttgggaggctgaggcaggagaatcgcttgaacctgggaggcagaggttgcagttagctgagatagcaccattgcactccagcctgggcaacaagagtgaaactccgtctcaaaaaaaaaaaaaatattgtcttgcagactcttattgtctatgaatcatgatgcaacacggtttaattccaaagtatcagaaaacaaaaagcatttacaaagtagatttatcaggaatagagtttaggcagataatgcaagaaaaaggtaacaatacaatagtaacagtaatagatacctaacacgttgttaattgtctgtaagaaacattcctttagaaactcaatacaacattttaataccataaatgtatattatttttatattacaaaagaaaaatttctttcagatttttttgagaaaatttcaaatatacagaaaacttaaaacatagtattacagggccagatgtagtggctcgtgcctataatcctagcacattaggaggctgaggcagggggattgcttgaggccaggagtttaagacaagctagggcaacacagtgaaagcctgtctctacaaaacattttacaaaatttaaaaaagaatagcattacaaacaattactatatccttcatctagattctccagtcgtttttcttccccaattgttaatatttatcacattttctttatttctctgtctctttttctgaactacttaaaaattgaagacatgatatttcatccctaaacactacttcctcataaaataaagaacattaattaaattaattaccattaactcaaaatgataacttggtatacagcccatatttaaatttccccaattgtcccaaaaatatccttgtagtttattttcttattcaggattcagttgtttcatgcattgtatctggttcttacatctccttaatctcttttaatctagaataatcccctctgcttgacttttttgttcctcataatactgaatttttaaagagttagagtgatttgtcttgtcccacattctggatttgactatttccttattatattcaggttaagcatctttttggcccaaatacctgcactacataggtgatgctttgcacaagcacttacgtaatgttcaactgtatccctgtttgtgatgctaaatttgttagcttgaggtgactgccacatctctccattttaaaggtagcatctccctttgtaattgataaggtctgtgtgatggtactatgaagccatgggactgtcctatacctcaaaaatctttcacccaataatacttttagcaactcttgatggttctgatctggagtagtttttatattggcggtcgcaaaatagtcatttttctaaatccgtcattcattttttctatagtaactagaattcatccttaaaagaaacttcacttcttacctttctttcaacacttttctttcacacgatctctttctctctctcattactatggacttacggatttaaaataattaaatatattgcaacccattcctgtcattattatttcttatctttctattgtcccattttggaccaatgggggtcttgtagttggctccttttgacatgacctagtagtctttaataaagtccttgctctcaagtataccaaggctcatcatatgcaagctcaatttataaatttcctgccccagatctggcatcagccatttctcaaaggagccctggttacttttagtggagaatggcatttcaaaatcaagatgcaggtaccaggtatacttattgttactcctaagcacccctttcaatgggcagagctaagaatacatgaatacacacacacacacacactcctatgttcatattgctacctcaaattcaaatacaacaccaaagcattcttcttcaatttcccttgttctatatttgtttctcactttttccacagtaaaaaccctgattcccaactttaacatatgtactcattcagttctattccacaataaacacaaaattgtttcagaattacaaaaccaatattgctatcaataacaaaccttctaaataaagttaaagatttacttgtagtttgttttgtccaaatttggttgcaagaaaccaaatttgcaaggaccaaatttggaacggtattcaatttataggtctatgttttaagaggaacactgaaaagagtatacagcaagaagagaaaatgctcgggagagaaaatgctaaagcaaacagtttccttcaaacacttaaaagcagttacacagaataagaaataggcttatcctgtgttcctctagaaggcaaaactcagaccagaatatagatgtcataaagaggaggatttcaattcaacttcagaaactgttagagttggatgtactatattagtaaggtccccatcattaaagtatttagacagagtctggaattccacaaaggggtttctgagcatttctcagtgggagagttgtgctgaatcagctctataattctattttctgttcgcacccaaatagcttctggaagcagccctccattaaacaatacaggaggtgttgttattcataataatgaccttgattcatatagaaaatattgaactatgatcagttatacatcattgaatctggttggcactgcagaagcttcctagaggctgcttgcttgttttccagtagttgatcatatcagtgtgggatcagacctggctgggcaggcctggctggctggtgggactctccagcatccattaaaatagaatgcaagattcgagatagaaatgctggtaggaaataaacttgtgtccggggaagaaagggtcagacctggcagtaaagctctgaatagtgtctcagtcatcaactgaagcaatgcttgagcagtacctctcacctagatttgttttccaacttcctgtgaatacatgaatgccttagggcgaaaggggattttgaagaaaacctaaaagagctgtgttgattaaaatgtctctaagactttagaatgcaagataatgctgctttgatgcccatatggcacattacaacacaaaagggaggtgttcagttttggctcagactacacaccagcttagctcattatgggctatgggctgcagggacactgttttgtgtagagggtttcagcacatcaacactgcctatggcagcactgggggtttgggggaggtgctcagaagacaggctgtgtccaatggcaaaggacttgtatctatttatgcatgcagtggaggcctcagaagctgaaaaaagaaggtaagggcttgttcattagcatactgtattagtccattttcacactgctgataaagacatacccgagactgggcaatttataaaagaggtttaattagacttacagttccacatggctgtggctggggaagcctcacaatcatggcagaaggcaaggaggagcaagtcaacgtattacacggatggtagcaggcaaagggagagtttgtgcagggaaactcccgtttttaaaaccatcagatcttgtgagactcattcactatcatgagaacagtgcagggaagatctactcccataattcaatcagctcccatggggtccctcccacaacacatgggaattcaagatgagatttgagtggggacacagccaaatactgagatgtgtcttggtgattactagtaataaagaggagagaaagttgactggtgtagaacgctttggaagaaggtttgtgtgcggctgcagatagccagtttattattttaaacatgacgtggtggttttaaaacatggctgtaaattctttgacacttcattgagaagtgggctcaatatcccctctccttgaatttgagcccgacttactgacttgctcataatataaaatgatgcagcagaagtcatgctgtgtggctttggaggctagatcataaaatgcaattcagctttaaccttgtttactgaaacactagcatttgaagccctgagctgcttcgtaagaagtctgactactctgaggcagccatgctaggaggaagctcaggccacatgaagagtagatttaggtattctggctgactgccctatctgaggtcccagcttcaaccaccagccatgtcagaaaatatgcctccaaaggatttcagtcttcaaccattgagacacccccaggcactgagtcttcccagctgaagccccagacatcatggagcagagataagccatctttgctatgccttgtctgaattctgactgagagggtaattttatatttttcaaagggtgaaagtataatgtttgatcctcacaatgatagtttggcaggttgggctagcattattataaccttcattttatagattaaaaaacaaaacaacaaacagggatttaagcttacctgctttgagattgtatagctaaggtgtggagtgctgacgctaaaatcctgatctttggactccaaagcttatgctttctctcgtttctcatctggatactgtaggactttagaatggcctaaggaagtaaaacaggatatatccagaattttaaggcaaggtcagaaaatgtcaaatgagtagaacgctaagaagaatcaatattaaatggatgagaccagtcatcctgtggagaaataatcatggaagatctgaactacagactgatactgacaaataaggctagaattcaaaatggaaccaatgtgaggataaaagcctttaaaacttttaatgttataaggaagtgttataatgatataacatttttagcagctaattttttaaaaatgaaataggacagttagagaattaacaaaaatcttgccagttgtgtttctgatgaaagggtgatgaaaggggaaaaggtgccatgactggctaatggtgctatttcagtctgcttctaagtatgtccttatagtaaagggtgcttcagattagtttagcttgatgacatcatcccttgtgatcatttactctacatttgccaagccactttttgatttaaatttatttcctcatagaaactttcctacttggaggagaatgtacaatgaagttaacaaagcataccatgttcatgtttttttttttttggagacagagtctggctctgttgcccaggctggagttcagtggtgcaatctcggctcactgcaacctctgcctcccaggttcaaatgattctcctgcctcaggctcctgagtagctgggattacaagtgtgcaccaccacaccaggctaattttttgtacttttaatagagatgaggtttcactacgttggccaggctggtctcaaactcctggcctcaggtgatccatccgcctcagactcccaaagtgttgggattacaggcgtgagccactgcgcccggcctacaatgttcatcttataggttatattttttcaatgcagaagaatgttagtattctcattcatcaagcagcctcacacagcatcctttacctgagagtaagcatcagctcccaggcttacggtgaccctaatcaatatgaagacaccctgtttcagaagtcagtaggacacctttctatttcttgaatcatccaaaatacagtaaggaggtcgctggtgacttcccccatgatgggaagtactaaaaggcagaatccacttagtttttcatgacttcatgtttaggttactttggtgattcactccaggccattgggagcccacagtaattgtttctcattcccgtttctctcttccttaaacttttcttttccaattatttattctttattagatccatgtatttttaataatgaattgaatttcattctgtaattgggcttctcaaagataattgacctcttctctcccaattgttttcatgcgtattttgcagagaatgcttggaatattctgttcatgaaaggcacaaagtacataaaatattttgagtgattttcttcaaaataaaaatgattagttttgatgcttcagatgtctagaatgctatgtgccttgtacaggccctacggcatggaaagtgctcaactgatatttgttaaatgaatgaatctggaaaacgaaaaatacacgaaatattttattcctcaacaatgaagaaaaagctttcagacttccatttagactcgttttaactggctgaattcttcaatgaaaagaaaacacgcgtcgcactgctaatttagctgttcctaaatatatttccatcaaattctgcttggctgtttcaaccttggggttgaagttcttattttgatgacacagagacgttcattgcagtggaaatagcaagtagtattggcttccccgccttcctccctctaggatttcaacttctcctcctcgaacaccagccctgctcttctagtaaatcccacattacagaacaggctgaggacggaggagacaagaggaaagtaggaaaccggagccatggaaacggcggagcggaggcaaagtgtgagagcgcgggtggttagaagggaaaaaaccctccccggacgacggcgcgaaggcgcgcctcagattacgtcacgcaccggggtgacgtcacgaccgtgacacgcgggtgacgccgttgccgcggcgacttctcgtcgtctccgcccccttcccccgctcccccccgcacccccgcctagcgtccttcccccaatcccctcaggctcggctgcgcccggggccgcgggccggtacctgaggtggcccaggcgccctccgcccgcggcgccgcccgggccgctcctccccgcgccccccgcgccccccgctcctccgcctccgcctccgcctccgcctcccccagctctccgcctcccttccccctccccgcccgacagcggccgctcgggccccggctctcggttataagatggcggcgctgagcggtggcggtggtggcggcgcggagccgggccaggctctgttcaacggggacatggagcccgaggccggcgccggcgccggcgccgcggcctcttcggctgcggaccctgccattccggaggaggtgagtgctggcgccaccctgccgccctcccgactccgggctcggcggctggctggtgtttattttggaaagaggcggcggtgggggcttgatgccctcagccaccttctcgggccagctccgcgggctgggaggtgggcatcgcccccgtgtccctctccgtcatgcagcgccttcctacgtaaacacacacaatggcccggggggtttccctggcccccaccccagatgtggggattggggcagcggtggttgagcgggaggctatcaatagggggcgaaactcagggttggtccgagaaggtcacgattggctgaagtatccagctctgcatctctgtggggtgggggcggcggcggcctcgacgtggaggatataggttagttgctggggctgagacaacagcccgagttactgtcgcgtgtaattcttacatggtcgtggggatgatggggctcatcatttcctctctcctctcccggactgccccccttctcagtccgctgccctttttcacttttctatttggggatttctcttcacctgttttacccagcaaattattttgatttagtctttactttttcaatcctaaatcgcagtttccgatgccttttctggtctctggtcctctgttcctaatgtttgtcagcgctctgtcgctgattggtaacccccattctattcccatctaccgcccgctcattttccagttgtcggacctgcctgccttctaaccccagctcccacttaagagcatttttgcacttctcttaccctggtcctcttgaggctctgtacttgatctcaccactccctaacattgttgtctgttgttatcttcacaaatcctcctggacactttggagctacttgttttctgagcccagaagctgtcaagattccatcaggtttcacttggctcttttcgcgcttgcactactggcactttttggctagtcgtccattgtgcattcacacctctttattcctacccatttttataggtctgattgatttcttagtgttgtcctcctttttgtcctatttttttccttttcctttttcctctccagtccttgcttctctcagcctgtttttgcattagtcagcctcttagcactgtgtcaaattatttacgtttttttattacataaaatttattacaaatatttggtattttattacagaaaataatactttattatgctttacaaataagatatggtataataattgtggtttacagttattgattaggtaatgtgacttactctgttgactttgctcgaagttctctttgctacttactattaacatctaatttctcaattctcataacatctcattctctctgcaattttttttttgcatcatcatctttggaaattcatccaatatgcttgctttattcagcatcagcttgtttatgataatgtttgttttctactctttatatcatctttgttacatgcccaaaatgtgttctgtaccatcatttgatctgttctaaaatttctcatttttaagtttcttaaaatcattccacttttcagtatgcatttttgcttagatcagtttcctctcatatctgttcctttcccccagcttcttgatttctaaggagaaagctcttctctacttcaatttcctagtttattctgtttcccttgtttccagttaccattcattttgccttgtttcctggcttttggtacttaactttctgaagcttcctcttttcttctccacacctccacgttccttcttatttataaacatctttgtttcctttgacatggaaatttatttttaggatacattgtttttaatggataaatactaggggtcacatctgctgtctgttttctccaggaatcggatatgcctttgtcttaaccaggcacaggtgcctctggattttattttactctgtaatagatgtgtagttttgttgaattgtatcttgtttgaagactactacagagtggaacaatgagtgaagtaataagtaggggttatgaaattgtaattctctgattataaaattgtttatcttgggaactttgctgcagagttattagaaccgtttgcaattctgtaaagaaggcttttgtgaagtaaaatctctacccttctattttatttgaaagggccagattgtttggaactgtaccccctgaagagtctgatttagtaagtgagagcgagggccatggatttctgtatttggcacatgtcttgagcagttcccatgtaccaatccttgagaacctctaggctagctgaatttaagtataaattgccagtaattggaaagcatattcatatcttctgaaactataaggatactctcattttacttggttaaaaaacaagtgtttcctactgtcctctttacccaggttttaatgtttagtggtgaacagtagttttccctctacatttttttctgaactgataataaatgtatttggctgggagggtgacattgattaaaaaatgtatctcttgaatgtaaatatcagtattacagatgataaaataaattcctccaagaaataattttaaatttgaagttgatattcagtggaaactgaaatgtgctgtggtcttttatttgaagtcttccttacattcacttaaagggatcttttactgcaaattacatggaaagaatgaaaaggtttgcttgtgtgtaatgacacattttattctgaagatttattttacctaacagtaaaatgtaggttttttttttttaaataaaagtttcccagagggaaatttcatctaaaaaaaaagtctgatttcaaagggaaagcaagtcattatcaaaaattagaaaactataagtacaaaaagtaaaaaatcatcagtaattttgccactaagatattattactatagacattttggtgtattccatctgttcttttttaatgcttttataacactatgtagttttgtattttaaaaaacttaaagcaaaaatttctacgtattattagacatactgtgatttatttaactaatcatttttttggggtgttaggttgtttttaattttttactgccatcaaacatcttgaacataggatgtagattttagtctttaaaatatgttggggaatgaacaaatttcacatcctgtatttgtagtattaatactttgtaggtgctcaaaatagaatattctggtaaatgattagtgcttattaaatatttatcaaatgaatgtacttgtacttttggcattaaacattaacatctgaccatttatatttacctgattttttttctatggccatatggtatgaaatagtgtatggtataaattaaccatatggtataataaatacatttttttaagtgtgataccagagtgatatttattaactgttcttcctgtgctgtttctgtagaagggagcttctcacaattgcattagaattacaattttattatgttctgttttcaagatctctgatcgtcagtcttaaactgtttaattataataatgtattgactagggaatattctgggatataatctcctttataatgaggtccactgtattaaaatacatctttgcaagccacaccaggttggattgcatcataaccctgaaaagtggtattctcattaatgcaggtgcttgtgcagttttggctattgctgttaatacttatacagatatattcacaggtgcccttgtggcaaaaatcataaaatagttgtttgtctttggtatttctagtgttcactttctatattcttttctctctccttatttactgaactcccttctttaggcatccactcactcctttttctgtttagaatattatctgtcagtcattttatatgttggccattaaaggaataaactgtcagtaaacagctaagaaaggaatgttggactgggtgcttgaatccttgaatgtagtaaatgtgagtgcaaacttgatttaattgtacatgtatttggataataggccagaaaaattacattagggtaacaggctagaacagtctgacttttcttgtttttctatcccttgctttcttgattagaatgaataggaggtgggtctggatatagcagctggaaacctgtgttccatgagtgatggggaagagagggagggaataggttcctctgatttttggcattttctaagacctgatgcccaccttgtcagagaatgcgatgactacttttgtgttcttccttttccctttttctcccaattataaaattgttttctctttcagaactgcagaagtgcattttgtttctttgacactttgatgttgttaatttagctgaatacctagtgaacattttgtgtcataatccccttgttttatgaaatccagtatggtctagtcaccttacatttctgcctcatattgtccttaagcctttttttgtcagtagctcttactagattttgtcttcatcagaagttaaagtgttttaagtcctttactcattctgtttctctattttaacttacattggttattctgtaaagtcagatgtggcagtagggctggtcgtggtggctcacacctgtagtcccagctacttgggaagctgagatgggagcatcacttgagccctgaagttcgaggctgcagtgagccatgatcgcaccactgcactctagcctggcaacagagtgagaccctgcctcaaaacaaacaaacaaacaaacaaaaaaaaaacaaaaaaacttgcttgtagaacttctgaattcaaaataggtgggcctatttgggagcttttctgtttttaaggtgtcaagtactgctttttaaaatcataaggttatggataacttcatgttagtgtaagaagaaaaatatagcctcatttgttccatttctttcttaaattttttgttttcattgccatgtttttatttttcgatttcaatttttccagcctaaatcactaacatacttaattagcatggtaatcagaagatactctttaatacagtctccaccctaacattaagcaattatttttcccccctaccctctgagattatttttgtgtccatgttttctcttgggcttaaaaaaaaaaactattattctaattccttcctgtatcaagactatgcatatagagggaactcaatgcccagtaacttctttttctgggccctggtgatgtagaatataaaaattgctttgaactcaattaactttatatcttctggaagctctgtaacatcggataaagcgtcgttttcattcttgtaatgtagctgcagttcctgacagcacgtttgggacaaatgtactgtgggacggtggttttcaaagtacgccagagctctaggagaatttttcgaaaacattctatcattgtaaataataattttttttttttttttttttgagacggagtctcgctctgtctcgcagactggagtgcagtggcgcgatctcagctcactgcaagctctgcctcccgggttcacgcctttctgcctttctcctgcctcagcctccccagtagctgggactacaggcgcctgccaccacgcccagctaattttttgtatttttagtagagacggggtttcaccgtgttggccaggatggtctcaatctcctgacctcgtgatctgcccgcctcagcctcccaaagtgctgggattacaggcgtgagccaccacacctggccagaataaaaattccaaattgcactaatgcatatgtgaaactgtttttgtctgttttgtagttttaaaatcttcatctataatagtacctggcacataggtactaaaatatttggtgaaagaattagtgaataaaaccttactggatatgaggtgatctgattttctgtaacattctattctttttttctgccggtcacaaaatcaccttatgaaattgacagccaaattggctgcaacaggcagtttgaaaaacactgttttggggtttcaaggaccttcttcagaggttaccccagggctctgtttagtgcctctataccaggggcccccaacccctgggccacagcctcgtatctaccagtccgtgacctgttaggaacctgactacaccgcaggaggtgagtggcaggcaagtgagcattaccgccaaagctccacctcctgtcagatcagcggcaggagcgtgaaccctatcagaaactgtgcatgtgagggatctagattgtgtgcttcttgtgagaatctaatgcctgatgatctgaggtggaacaatttcatcctgaaaccccctctacccctgtccatggaaaaattgtcttccatgaaattggtcactggtcccaaaaaggttggggagtgctgccctataccataactattgaagttcttcatttatctgctttacatgttagtttccttgaaaaaagggttttatggctgtaaaaattttagagctactatgtatggaagagaggtttgtgctggcataaatcttctcaggtatcatctgtgtagaaaatttcaacaacttgtgtcttaaggcagaggtcagcaatcttaagggtcagatggcaaatattttaggcattgtgggacatacagttcctctcacaattcctcaacaatactgtagtagctcagaagtagctaatagacaatatttaaacaaatgagtttgactctgttccagtagtcattttcaggacactgaaatttgaatttcatatcattttcatgtgtcatgaaaatcttcttttgattttttttctaccacttaaacatgtaaaaagtattcttagcttgtgagctatacaaaagcagatagtgggccagttcatgggctgaactgttctgactcctggtctaagggagactatatatgttatatttgaggttctcaaagtaagatgtaggttagaggtctatagaaagttcataattgcttttgtaaaaactagattgatttatttgagagggagagagaggtggagtttcactgtattgcccaggctggacttgaactctgggctcaagcaatcttccagcctcagcctcccaagtagctaggactacaggcatgcaccaagcccagctcctagttcctctttgcactcagtttcatcttctaccctcagcccctggcaaacactggtctgatctctgtgccctttccagaaagtcatataaatggagtcatataaaagtcatatcagtggggccgggcatggtggctcacacctgtaatttcagcactttgggaggctgaggagggcagatcacctgaggtcaggagtttgagactggcctggccaacatggtgaaaccccctctctactaaaaatacaaaaattagccgagcatggtggtgggcacctgcaatcccagctacctgggaggctgaggcaggagaaacacttgaacccgggagagggaggttgtagtgagccgagatcgcgtcattgcactccagcaattgtgaagcagtggttaaggttcattcattattttacatatggatgtccagttgtttcacatttatcaaatttcttttgaatcaccttggcacttttattgaaatcaattgcttatgtttgtgagttttggattctactgttttattgatctgtgtgtgttttcttaggctaataccccactaccttagttatgatagctttatagttaaatttaaaatcaggtaggtccagttgagaagatttttagaactttgactttttaatttcttgttaccatacttttggaaggagaagactcataattttattcaggttttcaaaggtgtcttctacccccaaatacttaagacttcagtatatagttaatatatctctgtcttgaattatgtggtggtgaggttcatgaaaagtgacaggtaaaagttgcaaccaaaattaatttccttataagaaaggacatattttagtaggttgcacagaaaagtcaatcacgtcctttttaccgtgttgcattatgaggtgtaatcaaaatgtgtataggggaaaatgaatatgttaagatgtttattcaccaaaaaaagtcaccgaaagtgtcaattaggttgtgaaagatactagtttacaatgtgttattctccatcttcattagaagagttcttccatttgaaacctatgtcatgttctgtgatatttcagagttagtatctttatgaatcttaggggcatcattaaatcattatgtttcttctaaggaaaggcatatggtagtagttggtcatatttctacctttttcagtggggcctatagggcccctttactttgttttaaactgcactgatagctttttactggttagcccagggaattatccctacagtgtaaaatgatgtttctcatcatgattttcatttaataatttaaaaacaaaataacaggaaacacatgtttctagagaggaagtgtggaatacctgactagtagagggtcaggtgacaattgcgaaggtagaaactgactaagttttgaccatgttgcaaggagtatcgttccagttttgttgggtcaccttgcagagtttttaaaaaaaatccttgggttttttttgtttgtttgtttgtttgttttggtagagatgctgtgttgctcaggctagtctcgaaatcctgggctcaagcagtccttcccagagtgctgggattacaggcatgagccaccgcacccagcatcaccttgccgattttgaaactacacttccagggagagagtaatacaatatcttggcagactatttttaactattgttccaaaattaatctgtttttaaaaagtaaagaagtgtggatatctttaaaagatactttaattaggcatgcaccaagcccagctcctagttcctctttgcactcagtttcatcttctaccctcagcccctggcaaacactggtctgatctctgtgccctttccagaaagtcaataagtggagtcatataaaagtcatatcagtggggccgggcatggtggctcatgcctgtaatcccagcactttgggaggccaggatgggtggatcacctgaggtcaggagttcgagaccaacctgaccaacatggagacactccgtctctactaaaaatgcaaaaaattagccgggcatggtggcgcatgtctgtaatcccagctacttgggaggctgaggcaggagaattgcttgaacctgggaggcggaggttgcagtgagccgatattgcgccattgcactccagcctgggcaacaagagtgagggaaactccgtgtcaaaaaaaaaaaaaaagatactttaattatatttaagttggggaatacttttgttttatattttttcttgcactaaatatgtaacctttaagttaataacaccagaaaatttttactttatagttttagaactgcttaattgaaataaaatgttaggatactttgaattagtcacttattttggcatattttaaacagtttaatgtactgcttggggttgtttctcaattgacttgatatttttaaactgtattttttaccttgtaccatttattttgcaaaataaatttctattttggcttatagatgtatttttaatattaaaggggattattggtgtcagccataaaattgtaattaagtcttaagtaggtatggtttttttttttttttttttttggagacggagtctcgctctatcatccatgctggagtgcagtggtgtgatctcggctcattgcaacctccgcccccccccccccccgggttcaagtgattctcctgcctcagcctccagagtagctggcactacaggcgcatgccaccatgcccggctaatttttttgtatttttggtagagatgggatttcaccatgttagctaggatggtctcgatctcctgacctcatgatccgtccgcctcagcctcccaaagtgctgggattacaggcatgagccaccgtgcctggctgattatttttatagagctcttgttagcgtaatttctggtaatgttttatggaggtgacttaattcccatcataaaaatatcccatcttttctgtgactagcaagcagttattgcctttataacttttttttaccataaaaagataaagtactattgataattactcctaattaactcagaacttttttgttttacacacattaatatatacttccatgggaatagtgtcagagaacatcaaatagggaagagattatgattcagagtggtctttatattcctattctagagccacagaaaatgttcatctccctttagtttttgcaggattgcctctaacactgatgatattccactcatattcttcctgcacatgccttctcatactaacagtaagtcacacaatctcaaataagtttcattatacatgagaactcagttgaatgcttgcctttcactggcatctcttgatcctcctccccctccttatggtatgcactgaacttctagtaggccatatgtgttaagtagatcataggagtgctatgaaaataaagtgaaatgatgaatatgtaaaagccttcacaaaattatagtagtgttttctgttgatttttaagacaaaagataaatactatgtatgtaaaaatttcctttcagaaatctttgttcttttttttgttttgaatgttcaatatgcttagcacagggctctagttaacacttttggcagttcttaatgtgggactgactgatgattgtcctagaactgtttcagtgttaactacattctattaatgttactttaaaacattatttaattaaagaaacatgaagtggcaacatactgattcatgtgttcagtaagcaattcatgggaaagaggtaagctttcttaataacagtagaaagactgttccatttataggaaaactggtaattatgacttgtgttttggtatttaaaagctgtggttggccgggcgcagtggctcacgcctgtaatcccagcactttgaaaggccctggcgggtggatcatgaggtcaggagattgagaccatcctggccaacatggtgaaaccccgtctctactaaatatacaaaaaattagctgggcctggtggcatgtgcctgtaatcccagctactctggaggctgaggcaagagaatcgcttcaatcagggagtcggaggttgcagtgagccaagatcgcgccactgcactccagcctggctacagagcgagactctgtctcacaaaaaaaaaaaaaaaaaaaaaaaaaaaaaagctgtgattaacatttgctttgtcattcatccaaaactacattggtgacttttgtattgagtcatttcttagggcaacaggtattcatgtattcagtaaatatttgagtgcctactatatgccaggtagtgatctaggtgcttagtagtacacttgaaaacaaaacaaaggtctctacccttatgtagctgctgtccagtggaggggtgtgtgtgtattgggggatggggctgagaaaccttagacatacagaaaggaaattatgtagtatgttcaaaggtaataagtgctgtggagcaatgaaagttaaacagtttagggctgggatgggggtaggtagcaatttaaatagggaggtcagggtaggcctcacttgagaagggggtatttgaacaaaaatttgagaaaggaggaggaggcatttcagataaaccaattagttcaaagattctgtgtcgggaatgtgccttgcctatttaagaaacagcaggaggccaaagttgctggggcaaggtagagactaggggattagggaaggatctctttcagttatctaggccatattggtgatagcagaaatactgagaagtagtcagattttggatgttttgaaagtagattcatcggggcttggtggctcacgcctgtaatcccagcactttgggaggccgaggcgggcagatcacccgaggtgaggagttcgagaccagcctgaccaacatggtgaaaccctgtctctactaaaaatacaaaaattaggtgaaatattgaaggagatgttttgattgaagtgattttaagagagaagaggaggggaagtaaagatggtgaggaattatcctgtaaaggggaacagagaaatggggccagagctagtgaggaaagtggggtcaataaatttttaatgataagaaaaagaagagcgtatgatgataggaatgagccattagagagtaaaacgtttcaggagggagagagaagaattgctgaagcactgtcttagaagaggtaagagggaaagggatttagtgtataaataggaaggattggctttctataggagcatctatactttatgataataggccattaagcagagtatgtggttagaaatgctgctaggaaggtcgacgtgattggtggagtctgtacacgttctgttgcagttgctttggtttttttcagtgaagtaagacttgaggttatcagccgagaatgaggattggggatatgtgaaagtagctccgcagcagtatgggagcataaatgaactggagacaaatagtaaaattaatgggcaattttttttcctttaagagatgggggtctcactctgctacccaggctggggtgcagtggcacagtcatagctcactgcagcctccaactcctgggctcaagtgattttctcacctcagcttcccgagtagccaggactataggctaatggcaatattaagttattttatgagttgtctagacagcattatgagtctcctaactttttggtactgatcttcagatcagagttaaatgtaacttgcccaggcaatttaaacactcaatatgagtcattttcatttggactcaaacatggaatcattgggaaatagaacatgaatttattactccttaatgaagtacctgccactatcctgccatgaatgtaggctaaatttggagtggtctggtaactgcttttcttttaaaaaaattttcttcatcttttctgtatcaaatacttactggtttttctatgtagaataacataatctcatcattactttctttcaaacactctccaaatttgacttgtctttgctcatgtttttcctaccacctgaaatacagatttcctcccccatcccaccctccaaaccttccagacttacctcacctaccgtttattgtaggaagcttttcttaacctctttccaagtcctagtttgatgcctctgctttgtgcttttgtagaatcccagagtttaccttgttttactcactatatcgtattgtggggtttttttgttaataggtatttctttttcctctagacctgcactgttcagtcatactttctgtgatgatggaaatgttcagtgtcgtcttaatatggtagacagtagccgtatctatgtggctactgtgcacttcaaatttgcatagcaggactgaggaactaaattttatttcattttaattaatttaaaaataactagcctgatggctagtggctgctttaatcagtgcagttctagaccccttcaaagtcaagagtgtgtgggattcatacttattctctcgttgcttaacaataatactgtctaatacttaaatgactgaattctttttcggtactcttagtctgcatagttataactcacctagaatatggcagttttgttctctagatttctgtctttaaccatggcttttcagtttgttttcaagattatgttgatttacacagcactgagttcttcagtcctgcgaagttagcgttttggttggatgtggtggctggcatctgtaatcccagcaatatgggaggctgaggcgggacgactgcttgaagccaggactttgagatcagcctgggcaacatagcgagcccctgtctctacaaaaaattagctgagtgtggtggcatccacatgtagtcccagctacttgggaggctgagggcgggaggattgcttgaacccagttcacggctgcagtgagctatgatcacaccactgcactcctgcctgggtgacagagcaggagtcaccctctcaaaaaaaaagtgtattttttcccctttaggactgaaaaaattgggtgttacaagattacctcaaggactggtctgagaactggggatggtaaggaagaaactcaagtggccagcctctggtttgtgggggtaggtgggcaatttctgtttcaaccaaagcagttctacttcataaattaatatattggaattgtgcttgggatttcatttggaggggaaaaaagtcttctaaacaataacactgttaattgaagagacaaagcatgcatatggcagcacgtgattaaccaccaaagtggataacagatcaagaagacatgggaagttgttatgggctagtgaggtcttgatggaagttaaggtttaatttaggtaggtagaaggaagacaaaaggatgtaataggcagtgggaatagaatttgcaaagaattggagttggaaatacatatgttagttttggttaagaaacaatgagctgattatagttgagcaaattgtatgaaataaaatttgacaaaattagatgggactggattgtaggaaaaagtgataggctgacaaaaagtgcactttatattgcatgcaatgagatgaaatactcggaggtattttggttgttacaaagatggaggaagaggacactattagcatttaatgagaaaggatcagggaagtcagccatcccacaatgttcaggacagtttgcacatttaagaattgttccaaatcaccacatgacctagaatgacttgctggactttgatgatgtaggttaaaaaaaaaaagtgatcataatgatgtgagcatagacagtaactccattttgtgtatgaggcacttttttgttgttgttgttgttgttgttgttgttgttgttgttttgagacggagtttcgctcttgttgcccaggctgaaatgcagtggcaccatctaggctcactgtaactgaggcacctttaatatacactaagattttcaggaattcagttaccacaatattggaggaatgttaaagtttttgttcagaactttatcaggagtactccacccctttagaaaatcacgtaattgatggcagtgtcacttgtgctgtattggtgacgcaaatactcttcagtctgcagttgtaactgccacagtcacagtgcttgttgtatatatgtacaaagtaccatcagtgtgttatttattatagtaatagcctaaatattataaaattgcactaaggtagattatctctgaattacatttattttttatttttatttttgtgacggagttttgctcttattgcccagggtggagtacaatggcgtgctcaccaaaaccttcgcctcccgggttcaagcgattctcctgcctcagcctcccaagtagctgggattacaggcatgtgccaccatgcccggctaattttgtatttttattagagacgggggttttccatgttggtcaggcttgtcttgaactcccgacctcaggtgatctgcccgcctcggcctcccaaagtgctgggattacaggcatgaaccactgtgcccagcctctgaattacatttaagggtagtatagagaatgtacaaaatagttgttgtaaaaaggagaaattgatttctgttttcagtattggaagactgggttattcagatgaaaacaattaaaattcttggaaacagtattaaaaaaaaaaaaaaaaaaagaaaacgtagagcagttgcagagctgaaaagatagtggggagctgccaggccaaattctaggaataaacaagaatccaaataaataagtggatgaagtagcttttgccctaaaggcagttgccaatctgtacaagttgggctttggttttggtggaccattggggtgaagaggacagaaatcaagtcctagagttcatctaaagtgacagtcaaaaagaataacctcagttttagatgggaccccagtgactctatcgttaggttaagggtgaaacaactgaactgtctacacactcccatatccatgtgattgcagggaaggttgaatggagcaggaggaggaaaaggaaattaagaaaaataaacctttcaagttgtgaccacagttttagccttcacagtgatttgccttgagggtttgctctgtctgggtggtccagggaccctccatgataaatgaccctccagccatttatcatggttactggtttcagactagtattacttccatggcctggcagatggaaaggcaaatcacgtgtggagaaaggcctttcattctagggaattgcttccagtaatttttcaaggacaatgaacagtacattgtcacaagtaatcaaacatagtaaaaataaaaaaattagcaagcaaaattacctgagagatatataatatgtaatatatatgtagaattctttcagcaatgtaattaaaatttgtgtgggtttctttatgtatatatacctaaaattacgtttttacagaggaaaaataataaccaagcatgcatccaattggcactgtgaataagaagagagcagaaacagatctataaaatcttcaaatgttgcaaatatcagatggatttaaaacaatcactgttaaatttaaagaattggagacaaacttgaagaacaaaagactcttataaagtgacttagggccaggcacggtggctcacgcctgtaatcccagcactttgggaggccaaggcaggcggatcacctgaggtcaggagttcaagaccagcctggccaacatggtgaaactttgtctctactaaaaatacaaagattagccacgtgtggtgaggtgcacctgtaatcccagctgctcaggaggctgaggtgggagaatcacttgaacctgggaggtggagattgtagtgagccgagatggcaccactgcactccagcctggcctataagagtgaaactgtgtctcaaaaaaaaaaaaaagttactttggttcatgcctgtaatcccaatactttgggagactgaggtgggagggtcacttgaggccaggaatttgggacccgcttgagcccaggagtttgaggctgcagtgatgtatgattgtgccacactgcactccagcctaggcaacagaatgagaaactgtctcaaataaaggaaaaaaaatggctgggcacggtggcttatgcctgtaatcccagcactttgggaggctgaggccgacagatcacgaggtcaggagattgagaccatcctggctaacacagtgaaaccccacctctactaaaagtacaaaaaattagctgggcatggtggcaggcacctgtagtcccagctattcgggaggctgaggcaggagaatggcgtgaaactgggaggtggagcttgcagtgagctgagatcgcaccactgcactccagcctgggtggcagtgcaagactctgtctcaaaaaagaaaagggggggaaaaacccaacttaatagatttgcaaaaaaccaaatagaaattccagaagtgaacactttaccaaatatacctaagagattatgcctagctgaagaaagagttcattgcctgggagacaaggcagaagaaactgtttagagtgtagcacagaataaaaaagaaaatattgaagagaggtaaagagacatggaagacagaataagatctaatttctttaatcagagctctggaaagagaggagaaagaatggtacagaagtaatatttcaaaagatatttctggctgaaaattttatagatccaatgagaaaccagttgattgatttaagaaggttaatgaatttctagcaatataaatagaaatctacacccagacaaatcataggaaaactgcataaacccagatacaaggagaaaagtcttgaaagtagccagagagaaaaaaagatgtttttcaaagaagcaactatggactgatggttgacttttcaatagaaaattacatatattctcaaaataactgccaatctagaattctgtaattagcaaagaattatccctctacaatgagggtaaaatacttagttgaacaaactccatcagctctttctaaaggaaattatgaagtatacattaatacttaaggcagaaagattctagataaaagtctgaggtgcaaaatggaataaagagcaaagagagtggcaaatatgtggatgtattaaaagaaacgttgactgtataaagtactagtaagaccttaattaaaatatgtgacaagaagctgggcatggtactttgagaggctgaggcgggcagattgcctgagcccaggaatttgagaccagcctgggcaacatagtgaaatcccgtctctacaaataatataaaaattagctgggtgtggtggtgcatgcccatagccccagctactcaggtggctgaggtgagaggatcgcttgagcccaggaggttgaggctgcagtgatccttggtcgtgccactgcacaccagcctgggcaacagactgagaccctgtctcaaaaaaaatatatgacaggcgaaggccgggttctaagacctttgtattgtcagagagaaaggtagaaagtattaattgacttgaccttgataaattatatgttttaatttctttttttttttttttttttttgagacggagtctcgctctgttgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctatgttttaatttctaagttatcttctaaaaatgtagaaaccagacttttaacttctcaaccaacagaagataacaaatgattaataaaaattaatcctgaagaagtgaagaaaagaaagaaccagtaggacaagtagcacaaagatgggtagatttaaatctaaacatatcaccagctacattaaatacaaaatggattaaattattcagttaaaagccaaagattgttacactgaatttccaaaaaaattcagttatatggggtttataaggaacatatctgaaacctaagaataaagaagatcaaaagtaatcatcacaataagacataccatgcatattctagcagacagtatggtacagttaatatcaaaggtggacagtaaggcagaaagcattattggcagaagagtcacctcaaatgataaaatgaccaattcactgtgaagatttaatagccttagtaatatagtataacctgaaatatagctttagaatatttatagcaaaagttaaacaaaactacaagaaatagacagatttctcagtcttaatggggtatttttaaacagctctttaagtaactggtataagaagcagacaggttagttaggatataaaatatttgtataacacaatgaacaagtttaacccagtgggtgtatagaacccattctacccaacagtggcaggctacacattcttttcaagcatgtaggattttggggggaaaattgactgagtaataatgttgtaaaacaagtttcaacaaatttcaaaggattgaaaccaaaaaagcatttttttctgtccattttcattaaagatctctatcaatagggtaatttttaaagcttcatgttagaaattgagcaactattaatacttggaaataatctggtcaggcgcagtggctcacacctgtaatcccagcactttgggaggccgaggcaggcggatcacgagggctggagttcgagaccagcctggccaacatggtgaaaccccgtctctactaaaaatataaaaattagctgggcgtggtggtgcatgcctgtagtcccagctacttgggaggctgagacagaagaattgcttgaacccaggaggcagaggttgcagtgagccgagatcgtgccattgcactccagtctgagagagcgagactccctctaaaaaaaataataatccatgcatcaaagaagaaatcacaatggaagttagaaaataccttgaactagatgattaaaaatttttgattgatcaaattccacaacttgatatatcttagaccattgaaagtgagagaatcaaatgttatgtctttagatacgaagtttcttgacacccctccctgcctcccccaaaaaagaaatacctaccacctatgaaagattcttgattggaaaaaaaaaaaataactgagctggagtttcattaaacttctagatctactgggaaattcacagtcatttgatctttcaatgagtcataattgttttgctgtggatggtcttgcctcgatgttgatggctgctggttcatccctggtggttactgaaggataggatggctatgccagtttcttaagacaacagtgaggtttgcgacatcagttgacttcttttcacaaaagatttctctgtaccaggcgatgctttctggtagcatttgaaccacagtagaactgcttttaaaattagagtcagtcctctcagatctgccagtgcttcatcaactaattctatgtaatattctaaatcctttgctgtcattttaacagtgtttgctcacagcatcttcagcaagagtagagttcatgtcaagaaaccactttttttactcatccataagaagtaacttcccatttgttcaaatttcatcatgatattgtagcaattcagtcacatctttaggttccactcctaaatgtagttcttctgctgcttctactacacctacagttccttcctccattgaagttttgaactcaaagtcatccatgagggttagaatcaacttcttccaaactcctgttaatgttgccagttttacctcctcccatgaattacaaatgttctttatggcatcgagaaaggtgaattctttgcagaaggctttcaattaatgttgcccagatccatcagagtaataacgatatctatggcggctatagcccaatgaaaggtacttcttaaataaggaatgttgaaagtcacaattacttcttgatccatgggttgcaagatttatgtgttagcaggtgagaaaacgttcatcttcttgtagctctccatcagagctcttgggtgaccaggcacattgtcaatgagtagtaatgtgttagaaggaatctttttttctgagcggtgggtctcaacagtgggcttaaaatattcagcaaactatgttgtaaaagaatatgctgtcatccaggcttcattgttccatttacagagcacagacagtaaattttgcagaattccaaaggccctaggatttttggaatgataaatgagcattggcttcaacttaaagtcaccagctgcattagcctctaataagagtcatcgtgtcctaggccaggcgtggtggctcatgcctgtaatcccagcactttgggaggccgaggtgggcggatcacctgaggccgggagttcaagaccagcctggccaacatggagaaaccctgtctctactaaaaaaatacaaaattagccaggcatggtggcacatgcctgtaatcccaggtactcaggaggctgaggcaggagaatcgcttgaacccgggaggcagaggttgcggtgagccgagatcatgccattgtactccagcctaggcaaaaagagcgaaactccatctcaaaaaaaaaaaaaaaaaaaaagtcatcctgtcctttgaagctttgaagccaaccattgacttagggaaatgttgtggctggtttgatcttctatccagatcactaaaactttctttatatcagcaactaggttgttttgcttgcttgcttttcttaaactatttttcttttaattcttagagggtctcactgtgttggctaggctggtctcaaactcctggcctcaaagcaatcctcccaccttggcctctgaaaatgctgggattataggcatgagccgtagtgcccggcctgttttgctttcttatcattcatgtattcactggagtagtgcttgtagtttccttcaaaaactctgcctttgcatttacaatctggctgtttggtacaagaggcctgcctttcaacatgccttcttcactaagcttaatcatttctagcttttgatttcaagagagagacatgtgactcttggtttcacttgaacacttagaagtcattgtagggtttttaattggcctaatttcaatattgaaatctcagggaataggaggcccaagaaggggttagggcagtagctggtcagtggagcagtgagaacacacacaacatttactgaagaagttcactgccttatatgggtgtggttcgtggcaccccaaaagaattacaatagtaacatcgaagatcatagaacactaaaatagacagcataataatgcagaagtttgaaatactatgagaattactgaaatgtgacagagacatgaagtgagcatatgctgttggaaaaatggtgccaacagatttgctcgatgctgggttgccaccaaccttcagtttgtaaaaaacaaacaaaaaccattatccgctaagagcagtaaagcaaagcacaatatgatgaagcatgcctgtacagtttatacttcacagtcattggttaaatttactcattcctttaagcataaaaaataaatatttagcacctttgtgctgagttgtatgctaggcactgggatatagaaatgaatgatagtttgtcttcaaggagcttacagttaagtggtagaagtagataaataaagaattaaggacagtgtactgtgatgaaagtgtgccccagatgcagaagaatcacagaaaaggagcacaattcaatatgcttttaggggatggaagacagatttcctaggaaaggagatacttaaactgaattttaaatacttcagatatacaaaatctttataaagaagagtaattaaaccttatttagagacagaccacctaaataaatggtacataccctgtactgagtgtggattggaagactgagtatgttaaaaatgttagtatttctcaaattgatagtggatttattgaaatccaaatgcaaattcctgtaggtttttctatggaacctaacaacctgattcaacaatttctgtggaagctttaaagaggcaagaatagccaaaatatactttaaaaacaataaggtaggaagacttctttaattcctttttccactcggcaaatttttaatgctctatggtaggcactgctcatcctggttattacctttgtgaatgtgagatctggctcccacccaaagctcacattcagatccacttgtagtggtatctagggttttgaatagaacacttcctgaaatacaggttaagtactgggactaccaacaaacaaacttacaacactaattttattatctcatatttgtatttacaatttttcttgatcatattttttcatacaaactttaattagtttctattaatttcttttaacataggaagcttagaaatagacacactttgcttataatagatctttaatattatgtcagttggactatggctttgttagaaaaggagaggagaatctactgctgagtgctgtccaaagagcagttacccaactgagcagagagggaggatgaccttgagggtctcacaggcatgggtttttaggcccagcctgtggagcgtctgagggacttataaaaggaaaagggacccaggtgcagtggctcatggctgtaatctcagcactttgggaggccaaggcggttggatcacttgaggccaggagttcgagaccagcctggccaacatggtgaaaccccgtctctactaaaaataccaaaattagctggctgtgatggtgcacgcctgtaatcccaggtactcgggaggttgaggcccaagaatcacttgaatccgggaggtgaaggttgtggtgagctgagattgtgccattgcattctagcctgggcaacagagcaagactcagtcttaaaaacaaacaaacaagcaaacagaaaacaacagaaagaggagatgaataacaaaatggcaggtaatactaaataatatggatgaattttatattcttacatatgggtaggtggagggacacctgctcttgtggcagattagttgggaaaggatacacttgctggaacaatgcctaccatattaaataaatgaagctagacttccccatctgttatgcataaaaatcaatttcttgtaggttaaagattcaatacaaaaggggaaaccctgaaagcttttagaaaaataaagggacattatttaaggcagagaagaatttcttaagactcaaaaaactagccataaaaaatggacaaatttgactacattgaaaatagaaacttttttcattaagccccattaagacactcaaaaggcaaggcaaggaatagaagatacttataacacacactattagttatctattgttgtgtaattaccgaagacttagcagtttgaaataacatttctctcacagttctgtgggtcaggaaactgagagtggcttaattggatgtttctggcttagggccttgaggctgtaatcagtcaatggctgcagtcatttgaaggcttgactgctttgtgctccctcatgtggatgtagcaggcctcagagctggctttctagaagggagtaagagaaaacacccaagatggaaaccacagtattttagtcttggaagtggcaccccatcacttctgccatattctttttgttagaagcaaggcaataactccagcttacattcaaggggagtttgtacaaggcaccaccaggagggtgaggatcattgggagccagtttagaggctacctactacaacatgtaaagaatgaactggtatgaaaaatatacataaaaaattcctatagatttctaagacaaagacagaacaccaaattggaaaaagggcaaaaaatcctgagcaggcatttgaattaaaaaaaaatttaaatgattaataaacatatgaaatgacccttaatctagttaacaattagggaaatagaaattaaaaccacaatgagagaccatttcatatagattggcagaaatgaaaaaatctgacaatattaaatgttggtgaggctatgaagcagtctgaactgtcttccactgatggatgggaatgtaaattggggggaaaaatcctttggaaaataataggatatcctataaccagcaataccactcactcttaggcgtttgccctagactaatggttcttgagtatgcatcaaagtcatctggagggcttgttaaacccagctgttggggctacccttagagtttctgattaagtaggaattgggtggagcctgatagtttgctttgcatttttaacaagttcctgccgggagtgggctgaggggtgggggggtgggatgttggtgctgcttgtccaggaatcatactttgagagtcagccattgctttagacatagagaaatgtgtgaatatatgaagtaggaagcatatatataagattgctcataacagtattattcatattaaccccaagatagaaaaaaagttcaagtatcctcagtagtgcagtagatatcattgtgtgtttacttatggaacaaaaaactagttcaaatagctaaggaaaaaaaccacactacaaacagctcctgcctgcatcaatatgtatgaatctcacaaatacattagtcataccttagaaccaagtcacaaaagattaagtgcaacatgattctattcgtaaacagtttaaaaacaaatgcagttaactgtattgtttaggaatacaaatataggtactagaattataagtagagatactagaattataagaaaaatcaagggaataatgatgataaaagtgagtgatagtgactacctcagggaggagagaaagtggatgtgattaaggacaaatgggagacttttaagataattggcaatgctatttcttaccttgggttgtggggtttgctttacagttatgctttaatggaacgatgttttgcaaacttctctacatagctttataataaagggaaaatttatctcatttaattttcatctctgattactagtgaggttgagtatgttttcatatgttagcctttgggttttttcttaaattgtttatagacatgccatttgtagattatgctatttgtttttagaacttatttttaggtattctgttatggatagtcttctttatccatcatatgtcaaatatttccttctagtccttttttatttgtatttttatttatttttatttcttttttaagaggcaggcctcccactctattgaggcctaggctatggatagtcttctttatccatcatgtcaaatatttccttctagtccttttttatttgtatttttatttatttatttttttaagaggcaagcctcccactcttttgagacccaggctggagtgcagtagtgtgatcatagctcactgcagcctcctgggctcaagcagtcttctagcctcagcctaagtaactgggacaaatgcacaccactgtgcccaactaatttgaaaaagaaaaaatttgtagagatggagtcttgctgtgttgcccaggctggtctcgactcctggcttcaagtgattctcccaccttggcctcccaaagtgctgggattacagacgtgagacactgttcctgccctagcctttccttataaagacatatgttgttgttactgtttatgtggtcagatttagcagtcttttcatttatttatttattttgattttgattttgatttttttaagaaatctttcctggctgggcgcggtggctcacacctgtcatcccagcactttgggaggccaaggtgagcagatcatgaggtcaagagattgagaccatcctggcatggatgaaacatggtgaaaccccatctctactaaaaatacaaaaattagctggacgtggtggtgtgtgcctgtagtcccagatactcgatagcctgaggcaggagaattgcttgaacccgggaggcagaggttgcatgagctgagattgtgccactgcactccagcctggcgacagagcaagactctgtctcaaaaaaaaaaaaaaaaaaaaagaaaaaagaaatctttcctatccagagttaaaagcatattctctatattgtcttctgataaattgaaaattttaaaaattttgtttaggtatttaagcagtctagtatttgttatatgaagatgtcttgggggatgttattttcccaacaccatttgtacatatgtgcacagtctttttctcacttatttgtaaagcaacctctcatttctaccagattcccatggaccgatttctgggctacttcttaacctgtttgtctataacctgtttgtccacattactactttatatctttggttttggtaatgccagtctcttctctttgtttatttgcggcaaacatatgctcattcactcttccacgtgaccattagaagaattagattgtcaatgtcctctaagtctaggtatttggttaaaaaaaaaaaaaaagaattaggttgtcaaattctgtaaaaagtactattgggattttcattgtgattgcattaagtttatatgttaatgtagggacatatatattagagatttattatgatactgagttttccaattcatgaacatggtttttatcttcatttgtttataggtctcttccccccccacccctttttttttttttttttttgagatggagtctcgctctgtcacccaggctggagcacagtggcacaatcttggcttattgcagtctctgcctcccatgttcaagcagttctcctctcagccttccgagtagctgggactataggtgcacaccaccatgcccggcttatttttgtattttcagtagagacggagtttcaccatattggtcaggctggtctcgaactcctgacctcaggtgatccacctgcctcggcctcccaaagtgctgggattacagacgtgagccaccgcgcctgggccatgtgtttctatttttagtagagacaggatttcaccatgttggccaggctggtctcaaactcttgacctcaggtgatccacccgcctcagcctcccaacgtgttgggattacaggtgtgagccactactcccagctctgtttttttttccttaaaaggtttatagttttctacataatgttttcatccttttggatgtggaggattggtattatttgcgagaatctttttgtgctgttgtgaatgagatgtttagaaaaaaatatatttttttactggatattcatatacagaagaatgaaactagacccccacctctcaccctatacaaaaatcaactcaaaatggatcaaagacctacctgtaagacccaaaactacaaggtgaaaccacagtgtggtatcatctggccccaggtaggatggctgctataaaactgtagaagacttgggaaatgcaaatcaaaaccacagtgaggtattgtctcatcccagttagggtggctgttataaaaaagacaaaaaattaaaaatgctggtgaagatacagaggaaagagaactcttggacgctcttggtgggaatgtaaactagtacagacactgtatcagtatggaggttcctgtgatctagcaatcccactactggccgtttacccaaaggaagggaagtcagtacgtcgaagagacatttgcatccccatgtttactgcagcacactattcacagtagccaagatatggaatcagttcaacaacagaagattgggtaaagacaatgtggttgtatagcatccgatggaatgctattcagccgtaaaaaggaaaaatcctgtcatttgcagcaacatgattggaactggaggacatcacgttaagtgaaataagccagcaaaagaaagttaaaccctgcatgttctcactcttatgtggaagctaaaaagagttgatttcatagaagtaaaaagtataacagaggatactcgggctgggaatagtaggggtagagtggaagctctggggagatttattcatggatacaaaattacagctagataggaggaataagttctagtgttctgtagtagtatagggtgactatagttaataatatatagtttcatatagctaggaggaggatattgaatattcccaacacaaagaaatgacgaatgtttctcctgtctttagtgagaatgcttctgttatgcttggtgacttacagactttttatagataccctatatgaagtttaagaatgtttcttccatttctagtttgctgacagttgggcatttttaaaaatcctaaatggttgttgaattttgttagatttttttcgtacatttattgaggtgatcatgtttttttcctacattgatctatttaggtaagtaattgtattggtagacttcctagttttgagtaagcaactcttgtgtcactggatacattttattgtatattcttttaattgattgttgaattaggtttgcctaattcaggtttttatttagggattttacgactgtgtttacaagtgagctcagtctatacctctctgagctgttccatggttttggtatcaagagctgattcgttttctagagttttctgtgattttggccagtttttatatcagaccaaagaaaatgtttctcgaaagtaagttcattaggctttaagtaaccactgggcccattctttgactttcaacttttctgagtgagttttagatgtggatgttatatacagcatttgttcagggctttggtttgtgagctgagtttctttttttatttttttaatagatgagcttatctcatttatattttgttgataaggcagttcttccacattattaattatatttttctttgggggctttgtctcttatgggtatgtgtgtgtttcccatctaatagtttttgatgattttttataaatcttattctcttactaccttcatagatttaatatctgtaagcctccatttcttgatttgtgaaaataatcaggactattttaactccttgctaataaaggtaagaaaatcagtacacttatacctccctttccccagctaccattaaaaaaatttttttccatctcttcatatgagatataaaccttgtcattgaaaaaaatgcatttattttttactttatccttaagtctcagagttacatgtttgaatgggattaatattcacctttaattctttaaaaccatgacttcttgatttctaattctgttttatttatcttttcatcagcttgattttcctatcaagtagttctgttttttctgccaagaatggcttccttttttcttcttcagccatttctttctgtttccaccgtggccttcatttctgaagtggtctttttattaccttccatttctttcttgaaccctgctaactcacttttcatttcctatttcttttttttgagacagggtctgggtctctcactcaggctggagtgcagtgttgtgatcttggctcactgcaacctctgcctcctgggctcaagccatcctcccatctcggcctctcaattagctgggactacagacatgtgctaccacacctggctaattttttgcatttttttgtagaggcagggtttcatcatgttgaccaggctggtctcaaattcgccttggcctcccaaagtgctgggattacaggagtgagccactgcctcctgcctcatctcccatttcatctgttcttcaattttgttttttcagtcatttttttcccctaaaatgcatttgatagtgatagatggggatatatcagagacttcttttgtttccttgactaacttctggtgtttatctgtctttgcctattatgtttcttctctcatcccccactccctgttttattggtggtgtggcgggtggggttgttaacgtttctcctcatagaccctttgctggattgtttctttttattactcatccttgttgtctttgagtagagtacttctatttgagcctgctctttgcttaagaatgttatggggggctgggcacagtggctcacacctgtaatcacagcactttgggaggccgaggtgggcagatcacgaggtcaagagatcgagaccatcctggctaacatggtgaaaccccgtctccactgaaaatacaaaaaattagccaggcatggtggcgggcgcctgtagccctagctactcaggaggctgaggcaggagaatggtgtgaaccctgggggcagagcttgcagtgagctgagatcgcgccactgcactccagcctgggtgacagagcaagactctgtctcaaaaaaaaaaaaaaagaatgttatggggaacagcagggagaataagcctaagcaggcataacttttttctcagacatcttgtctcagaaagctcgttcaccaaatctgttgtgttctctaccctgggaatacatcactcctccatttttaatgtcttttttccccttcctgccattttgggccaagccaatcattcagtcaggatgaagactccatccaggcaggagatgggtgaggctgatagtgaagttggacatcaaatagattcctgttcgatgatttgatttttaatttgttctgctcagctgcctttagcttttaaccttttatatcttatgttcaatagttattctcacaaaggaactggttcccaacataaatttaaaattaaaagtgatcagttctctcctctagcaaactgtaactgcttttattttatgtgacttgatctgatgtattgttttgttccctggatcatttaggggtggggaagtaaagacagggaggtctgtgtttcactttaaaaacaaaatctaaaccagataaaaactcgtaaaatgtcatatttcaggtcctctgtgatcttgccctttcctacctctctacccctgcccacgtctatcagccatccttgctgtgtactaaatgctctagcacagtatttcctaaagtttatattgtggatactgaatattcaaagtgttctcccaaagataggttccatagtttacaattttgggaaactttaaatgttcctccttgtctaacctgttgagtttctaagctcaaatgaggggggatactgtgttatctaaatcttatttgatttctgtattttacatattaagggattcatctaaaaagtatctgaattgatttggcaagcaggtgataccctgtactatattatatagctccccttttgggatttcataattggatattagcatagtaatggttgagaagaactgtagtaaagaagcttacctttgttgatttattttttttttttgacacagattctcgctctctcacccaggctggagtgcagtggcacaatctcggctcactgcaacctccacctcctgggctcaagcaattctgttacccttccaagtagttgggactacaggtgtgtgccaccacacctggctaattgtttttaaatatttttagtagagatggggtttcaccatgttggccaggctggtcttgaactcctgacctcaaatgatccacctgcctcggcctccgaaagtgctgggattacagcattagccactgcacctggccttacctttgtctaaattagaattgtataaacttccttgactatggaacattgcttgtgtgtagtatatgctaatattctttgaaacattttagggaaatgctgtttaataccaatcaaatccttgcattttttcagggttgtttcctgttgtttctggccctttgtcctagaatgctctcttccttcattttctccataccacccaattttttttttcaatggtttctgaggtgatacttaccctgctgggaggcatttggaaatattttgattgtcatgcctggaggatgctatttgggatttaatgccctcaaatcgaggaacacaatgcactaaaagtcctacacagcaaagaattgccccacccaaaatgccacttctacagtggccctccatatctgcaagttctgcatcctaggattcacccaactgcagatcaaaagtattaggaaaacagtaaaaagtaatacaataatacaaatacaagataatacagtataacaactatttatataacatttacattatattagtcattataagtaatctaaagatgatttaaagtatatggaaagtaagttatatgcaaataccctccctttttatataagagacttccgcatccaaggatcatggtgttgtagggtagagtcctggaaccaatcccttgtggatatggaggaatgactgtatactcctttggagaacactgaactcagcaacttttactcatcctttagaatttagttctggttatcttttccaaaagctttctctaagtacttttgttttcccctctaccccacaccctctcattttctctgcgtggtactctcagagtattttaggcacatcttgattatttgaagtaaccactttgtagtataggagcctataactgtatacctctactgtactgtgagttcaaatctttgagggcaaagacattttgtatccttggtatatgatatataattagtcttttaaaaagtgcatgttacatgaatacattaataaataagttgtacttttactttaaatcagaattgtggtatgactcttaaactgttgcttagactgcattaataatcttgtgcaattgtggaaaataatctcattttactctcataatagaaaattaaaatatgcttccttttgctcagatatgggtgacagctgttagagtagtgttttatttgggttttgaccttgcctgtacatcagaagcacctggagaacttcagaaggtacagatgcctggggccctgcaccagaggttctggtttttgagggtgaggccttggtatctggatttttaaaagcttccaaggtgatttttaatctgaagttaagattgaaaagtcatttagtgagacactgatatgtagcattttgggaagtcagtaaacttaagagtgagaagttactaaatcattgaagaacagtgaaaggagtagggagttttagcttagaaaaaaaaaatctagatggagtatgtgagttctctgagggctataggaatttgtccgtcttgctcaccactgtatcctcaactcctagcatgagcctgagcacatacagggatttggtagatatttattggctgacagaagaatatgtatcattaggtgtttaaaagatagtcattgtagaaccacagagattatccccaaaaaagttttatagtaataatgtgccacttaattttatgattaaaaataatgaactggatatttaattcatttatcatttcagtttattatttactttgtgccagtcactgaggattccatttgattctctggtcaaatctatgaagtttgtatcattcaaataatagggctgtgtcaagaaactgacacttgggggttaagtaatttgcctaaggttacaaagctaagtgacaagagctggaattcttaaagtctgtactcttaactgctatgccttaccataagtcttcaccacaaccctaagagttagatatggtttagaaaggttatgcagcttgcctaagggcacattgcttgagtggaagatttgggacttggacccagacattgtgacactagagtccatgctgttaactgccatgctattggaacccccaaccccctcgcttcctattgtataatgtacaaccatctgttttcatgagattattaaccacagtggacagcttgtgttgctctccttataccttttggcatcctcactgacttttgactgatgggttgaatttggattattgtcttgaatctccttagtaccctgggctgtggtagtcctagaaaataaaacatttctttactaggttctttttcttcatttctttttccttttagttaggattttaaattagaattttaataaacttgcttgcattaatacactgatatctgttagcttctgttattttaagtcggtagtctccagacttaaaaattttgttctctatcataaaaaaaatttgagcacattacccctagtagatatctgttttatttatgctatatgtgtactactgaagaaaatggtaatattttaaaaaatatgaacttgttagcatgaatttttttaaagctaagctaaaaatgaagtgagtttaaaattatgaagggtttttgctgatgtttcaagtttagctaatgtttcaagttacaacataccattaggccaaggttcgttattataatagtgtgtacaaattcatattttaagtagcctggataatttttttaaaatagctagtttcttgtcagaaattaagtaacctggataattttttaaaagccagtttcttgtcagagattattagattagggtttctcaacattggcgctgttgatgttttgaaatggatgtaattcttgcttgtagggttatgatctgcagttgagtgaatcctacgatgtagaacttgcagatatggagggccactgtaaaagtggcattttgggtggggcaataatactatgtattgtaggatgtttagcagcttccgtggcctctgctcacaagatgccagtagtacccccaagtagaaacatcaaaaatgccgggagacatttccaaatgtcttgaggggcaaaattgcttctggttaaggaccactagattagaattttttttttttttaagacggagttttgcttttgttgcccaggctatagtgcaatggcgcaatctcggcccactgcaacctccacctcccagattcaagcgattctcttgccacagcctcctgagtagctaggattacaggtgcccgccaccgcacccttctaattttgtacttttagtagagacagggtttctccacgttggtcaggctggtctcgaactcccaacctcaggtgatctgcccgcctcagcttccagagtgctggtattacaggtgtgagccactgcacccgcgctagatcattgtttttatcctgtattatggatgacaagcagcttgtagtagagtagggaaagtgttaactttgattttttcccctctagcagcaataatgttttcttcagtatgaagtttgagatctgtttgtaggaattaattttaagtcacttgtccattctataaggtttagttaaaacttggtaacataatccatacgtttacttaaatcaatatatgtgagtcatagtatgtcacaatgagataaatgcaagaggagagccactgtcaagtgttctgcagtatggaatgcccagccttcagcagacctcttgactatatgtgtcacatctctgatactaaccctaagttagggtgcctgtgtaaatattaaatgctgaggccaggcacagtggcttacgcctgtgatcccagcactttggaaggccgaggtagacggatcacaaggtcaggagatcaagaccatcctgactaaacacagtgaaaccccgtctctattaaaaacgcaaaaaattagccaggcatggtggcatgtgcctgtagtcccagctacttgggaggctgaggcaggagaatcacttgaacccaggaggttgcagtgagctgaaatcatgccactgcactctagcctggatgacaaagcgagactctgtctcaaaaaaaaaaaaaaaattaaacgagcatggtggcatgcatctgtagtcccagctacttgggtggccaaggtgggaggattgcttgaacccaaaagtttgagcctgcggtgagctgtgatcacactactgcactccagcctgggcacagagtgaaaccctacatctcaaaaaataaatattaaatgctgactttttctaagtttctagatgaacacattaactaaataatgtagcctacctatatccccaaaaaagagtcttcctatgggccctcaggtgtatgtgcatacctattttgtaaaccacttgtttgaccatcacattgtaacttattgttcaatttgtgtcactgcagccatattacccaaaagggaaaagtaattttagctctctgaactgacctccacctaaccaactcatcaggttaactgatgttctccatttcaaaaaatatttgcggtcagattaggtgtgaatcatatttaaaggaagattgttggtcctatatcaaagattagagaatgaatgttcattttacagttttaagttaaaatgtttaaggacagtgtttaccattgcacatgattccctgatttaactgaccttttcagttaactagccactagacataattacattgactataggggcttcttttgtgccacaccagtgttggaattgtgttgatttacttgtggagttggaactacagtttctctcagcagcctgcttatctggttgtttaaacttgtagctgaattattatacaaagttttcaaactttctgttttggaatggtcagttactcaaaactgtggcttcctccttgctaccttacagggtagttgtgagagtattcctcaacaatagttcagactctcattacttcttgtctataattgtagcatgcttttaatgggattccctgcctccagtacctctctggcttgttggttaacataaacattattgccagattaaacatcctaaagtataatgtgtaatcagatcaaaagccatttataacaataaaaactacattaaaaaattacttatgtcctgggcttagatgtggtctctgcaatcagatgttcattaaacaaattatttaaaaaatacatacatacacacacacgcaaattctgaattgtgatatgtgccaaaagaaaaaatggggggtgatgtgagagctcagtgaggatcaaatatagattgggaagaagggtgatgaggaaagacttctttgagaaagtgagatttaaactatctgaagaagctgtgcttagtttagaaaagtgctaggcaaagagtgttccaggaagaaggaatagcatgtgtgaaggctctgctctgctgctgaaattgtggttcagtttattgagtatggcatagaatgaatagtgcctgatgaggcaggaggtaggctgggatgagatcttttcagatcttgcactctgtactaggaagtttaggttgtattctgagttactggggagccattaaagggtttaaggaaggggagtgttgtgaatcagttatgtgttttgcagattctactctgactacagaatggatgagagcagaatgggagttagagcaaaagaaatgaggaaaccagttagaatgcctttgtaagtagtaggtcagagagaaaggatgataattttgactagagtcatgacagtaaacaaggtaacacatgaagtgattatgtcataaactattaccattaccctgtgaaggaagtatgagcagaataagatttagaataaacttattccaagcccatctaataaagggtggtgtgaggaactgaaacaatgggtgtttcaggacattcggtccttgtctctaaaataaaatccaaactctgttgaagatttttcagcctactcttattatctttgtcttctcctaaactcttactcacctatgctataatcataccaaactattacagtgagtatcatgaacatttcctgtaccttgatgccactgatgattgtttactatggctggaatactcttactcccacatacacttaacaaaaccctactcattgtttaggatccagatcaaatatgaatgaagccttccaaatttgcctccagattgatattgcccatttatcttcttttaaccatagtagttcatattactatcacattatagtatattattcaacagatgtctatgtaattgattatgtgccaggtactatgtgtagacattatggatatatccacatacaaaaatagacacagttgccgcatttgtggaaactacattgtaacacagaccttgaacaaaatctgggcacaaatatgtaactaaatgttaataagaggtatgaaggaatacctgcaggtttctgaaaccctaataaggcccttgaggtcaaaattattttcataatcctactaagatactatttgccttttcattctcgttcttgtgagtatgtagtagttataggatgtatgatattccaacaaattgaatacagaaggtgggagaatccagatatcttttgttaaggcagacattaaagaaattggcaaaaaaaaaatttttttttttaaagccactttggggccaggtgcggtggctcacacctgtaatcccagcactctgggagtctgaggtgggcagatcacttgaggtcaggagttcaagaccagcctggccaacatgatgaaacctcgtctttaccaaaaatatggtagctgggtgtggtagcacatgcctgtaatccgtccctgtaatcggaaggctgagaggcgggagaatcgcttgaacctgggaggccaaggttgaagtgagctgagatcgtgccattgcactccagcctgggcgacaagagcaagactgtgtctcaaaataaatgaataaataaacaaacaaataaataaataaataaaaatgaataagacactttgccctctcattgttttttgttgttttggaaaatgtggttatttttttcattaaaaaatagatcacttttgttaattagtttttttgtcattttaaaatgaattttaaacatttcttggttataatttttaatgtggtaaatactgatagcgataaactacatagataaaagctttctagggtcctccataatttttaagagtataaaggggccaagtgtggtggctaacacctgtaatcccaacactttgggaggccaatgcaggaagatccaacatagcaagaccctatctctacaaaaaaatttaaaaattagccagacgtgatggtgtgtgcctgtagtcctagttacttgggaggctgaggtgagaggatcacttgagcccagagtttgagattgtggggagctgtggtcatgcactacattcctgcctgggctacagagtgagaccctatctcaaaaaaaaaaattatatttttatacacacacacacacacacacacacacacacacacacacacacatatcttatatatatataagagatcctgaaaccaaaatcagagtccctgtaatggggagctgatttaaattgggggcttctggagaagtaaaagatatcttatgtctctgttaaacacttatgttcttctagaaattaggagtgtggttttctccgtatttccaaaaactgcaagtctttttatataacgagtgtgttggttgaatctaattttaaaaaaaatttttttaatttaaaaattttttaatttttaaaaatatggagtgcttcatgaatttgcatgccattcttaggcaagggccatgcctatcttctctgtattattccaattttagtatatgtgctgctgaagcaagcaccaaattttgttatcaaagtctactgtagatggccgttctttctttgatttgtggtttggttgaaacctttgttggaaataccatcttatttcttattactgtaggaaatagatctggattcaaattcctcttggtatgaagctgggaagattacttaacctgctaaaccttaccattatttatctgtaacatggaatacatattatcttactgtggtgtaatgatttaatgaactaatgtatgtgacctgattcataagtgaccagaacagagacaatccataaaatggtaattctttttattttatatacacagcacatacatactggggttagtttcagttagtgagcagagaggtctgtggataaatcaggatataacaatcatcattcaaggatatattcaccattcaaacagtttatcagaaggcagaaagccagaatgatctattgtgtatggttattcatctttagaaaaaggaacagaaagtgtgggcttagaatattttaaataagtagctctatgttacaatgtagatgatttagggatggggtagagttttatgtgtctggcactacagcagtgcctcacatttactaaatgtttgaataatattaattaactagagattcttgaaaacacatttttagaagccttgaaaaagttatatacgacagattaaaggccaagcctgagaaagcttacatggctaactggaaaaataaataaaggtaccatagaggaaaaacaaaattgccctgtggggagaacatgtggtgtcatatggtgtgactaaataggatccagtaagataagacaaggtagagcatcttgggagtgattccatgtttcaaggttaaaatgttaactacattaaaggtagtaaaccagtgaaagaatcctcaagatcccagtgcagaatgtttgccaagagataagaagatcaactgttttggtattcatagcagaaagccataggaaaattatctttttgatattcttttttgaagaagataggtcctttatttatttatttatttatttatttatttatttactttattttattttattttttgagatggagtttcgctcttgttccccagctggagtgcagtggtgcaatcttggctcactgcagcctccgcctcccaggttcaagcaattcttctgcctcagcctcctgagtagctgggattgcaggcatgcaccaccatgcccagttaatttttatttttagtagagacggggtttcttctccatgttggtcaggttggtctccaactcctgacctcaggtgatccacccgcctcggcctcccaaagtgctggcattacaagcgtgagtcaccgcgcccagccaaagataggtccttttttaagacagatacttagggctgggtgctgtggctcatgcctgtaatcccagcactttgggaggccgaggcaggtagatcacctaaggtctggtgttcaagaccagcctgaccaatatggtgaaacccaatctctactaaaaatacaaaaattagctgggtgtggtggcgtgcgcctgtagtcccagctacttgggtggcaattcaaggagaattgcttgaacccccgggaggcagaggttgcagtgagccgagatcgtgcctctgccctccaacctgggtgacagagcaagactccatctcacaaaaaaaaaaaaaaaaaaaagatactttgataaagaaataatagttatttctcattttatttctcatttgagatgaactcaaagttggctaaagtgacacacagttttggacctataacttgcttacattttaaatattaggttggtgcaaaagtaattgtggtttttgccacccaatagaaaggattgtagacatttttttatttgacaactgtaaagcattgcaggaattatatgtggaattataggcttactttgttttattgtgtttcattttattgtactacacagataatgtggttttttttacaaattgaaggttggtggcagccttacatcaagcaagtctgttagcgccatttttccaacagcacatgctcactttgtgtctctgtgtcacattttagtaattcttgcaatatttcaaactttgtctgttttggtgttctgtgatcttgcatgttactattgtaattgttttggggtgccacaaaccacacccataataaggcagtgaacttaatcagtaaatattgtgtgtgatctaactgctccactgactggctgttcccccaactcttctccagcctccgcatgccctgagacacaacaatattgaagttaggccaattaataactctacaatggcctctaagtattcaagtgaaaccaagagtcacatgtctcttgaaatcaaaagctagaaatgattaagcttagtgaagaaggcatgtcaaaaagctatgccttttgtgccagacagctaggttgtgaatgtaaaggcaaaattttggaaggaaactacaagtgctactccagtgaatacacgaatgataagaaagcaaaacaggctcatgcctgtaatcccagcacttttaagaggccaaggtgggaggatcacttgaggctaggagttcgagaccagcctggccatcatagtgagacgtcgtctccattcatttttaaaaagcaggcaagcaaaacagcctaattgctgagatggagaaagttttagtgatctggatagaatatcaaaccagccacaacatttccttaagtcaatgacaggctttaaagcttcaaaggacaggctgactcttactagaggctaatgcagctggtgactttaagttgaagtcagtgctcatttatcattccaaaaatcctagggccctttggaattctgcaaaatttactctgtctgtgctctgtaaatggaacaatgaagcctggatgacagcacattcttttacagcatggtttactgaatattttaagcccactgttgagaccccctgctcagaagaaaaaaagatcccttccaacatattactaatcgttgataatatacctgatcacccaagagctctgatgatgtacaaggaagattaatgttctcttctgttttctatgtgtgtgtgctttttttgttttgagacagggtctcattcttgcccaggctggtgtgatcatagctctctgcagccttgaacccctgagctcaagcaatcctcctgcctcagctgcctgagtaggtgggactacaggcatgcaccaccatgcccagctaattttttttttttttttaatagagacagggtctatgtttcccaggctagtctcacaaactcctggtctcaagtgatcctcttgcctcagtaatgtttttcttaaccactaacgcagcattcattctgcagcccatggatcaaggagtaattttgactttcaattcttcttatttaagaagtatcttttattaggctatagctgccatagatattcctatgatggatctgggcaacattaattgaaaaccttctgcaaattattcacctttctagatgccattaagaatgtttgtgattcatgagaggaggtcaaaatagcaccattaacaggagtttggaagaagttcattctaatgcttgtggatgactttgaggggtcaaaacttcaatggaggaaggaattgcgggtgtggtagaaatagcaaaataactagaattagaagtggatcctgaagatgtgaccgaattgctacaatgtcatggtaaaacttgaagaaatgagaagttgcttcttatagatgagcaaagaaagtgattttttgagatggggtttactcctgctgaagatgctgtgaacactgataaaatgacagcaaaagatttagaattttacataaaattagttgatgaagcactggcagatttgagaggactgactccaagtttgaaagtagttctactgtggttcagatgctatcagaccatattgcctggttcagagaaatcttttgtgaaaaaaagtcagtcggcacagcagacttcattgttgtcttgttttaagaaattgccggccgggcacggtagcttacacctgtaatctcagcactttgggagaccaaggcaggcagatcacctgaggtcaggagatcaagaccagcctggacaacatggtgaaaccccatctctactaaaaatacaaaacttagcaagtcgtggtggcacgcacctgtaatcccagctacttgggaggctgaggcaggagaattgcttgaacccaggaggcagaggttgcagtgagccaaaatcacgccactgtactcccaccctgggcgacagagcaagactccatcttaaaaaaaaaaaaaagaaagaaattgccacagtcaccctaacctttagcaaccactgacttgatccggcagcagccatcaacactgaggcaagacccaccaacacaaaaatgatgactccttgaaggcccaggtaattgttagtggtttttaacactattttaaaattaagatatgtgctttttttttttttttttttagaataatgctattggacattactagactacattatagctacacttttttgttgttaatttaaaaattgtgggccgggctcagtggctcacgtctgtaatcccagcactttgggaggctgaggcaggcagatcacaaggtcaagagatcgaaaccatcctggccaacatggtgaaaccccatctctactaagaatacaaaaattagctgggcgtggtggtgcacgcctgtagtctcagctactcgggaggctgaggcaggagactcttttgaacccgggaggcagaggttgcagtgagcagagatcccgccattgtactccagcctggcaacagagcaaaaccctatctcaaaaataaaataaaataaattatggccaggcgtggtggctcatgcttgtaatcctggctctttgggaggccaaggcaggtggatcacttgaagtcaggagttcgagactagcctgaccaacatggtgaaaccacgtctctactaaaaatacaaaaaaaattagctgggcatggtggtgcatgcctgtaatcccaactgcttgggaggctaaggcaggagaatcgcttaaacctgggaggtggaggttgcagtgagctgagatttgcgccactgcactccagcctgggtgacagagcaagactccgtctcaaaggaaaaaaaaatggatacataatgattatatatatttctggggtacgtgtgatattttgatataggtatacagtgcgcaatgctgaagtcaaggtgattgggatacccatcaccttaaacatttatctttgtgctggaaacattacagttctcttctagctattttgaaatatatgataaattgttaactgtaatttccctactatactgtgaaatactagaacttactgtttctgtccagttgtatgtttgtatccattaaccaacttccctttatccctttctccctccttttcttcccagactctgataaccactactctactgtctacctccatgagatcctttatgtattctggatatagatcctaattaaattcatgacttgcagctattttcttgcattctgtaggtttttttcactttcttgagaatattcattgcacaaaaggttttaattttgttgaagaatgatttgtcagtttttttttgttgctcgtacttttggtgtcatatctaagaatccattgctaaatccaaggtcattaagatttacccctatgttttcttctgagagttttattattttagctcctatatcatttattcattttgagggtttttaaaatatggtgtgaggtaggggtggacatttattgctataaattgtcctttgagcattgcttttgctgtatgccatcagttttggtatgtgtgttttttttgttttcatttgtctaaaagtattttctaatttttcttgtgatttctttttttgaccttgtatctatattcaagagggatattggtgtataattttcttttttgtacagtcttttgtattagtgtaaaggtgatgctggaatcataaagtgagttggaaattacttactccttttctgtttcatggaaggtattttgtagaggtggtcttatgtcttctttaaatacctgatagaatttgctactagagatttatttttagaaaggtttttaactatgagtttaatttccttaatagttacaagagtgttcagattatctgttttatcttgtgaatataaaagatatcttcagatatcttttatcctgtgagagttttgtttttctttggtttttgaggaattggttcatttttttctaacattttgaatttatgtagagtttttcatagtattcttattaacctttaaatgtctgtgtgtaggggagtctgtagttcattgtttttttattactgatattgttaatttgtgtcttccctttttgtcagtcttgctagagatttgtaaattgtattggtcttttcaacaaacaagcttttgttttcaacatttttttctgttttcaatctcatggatttctgctttttattatttttgtgttgctttctttaggtttatttagttcttcaagtttcttaagatagatttgcaactgtttttctttgctgatataatagtatcagtttaagagcagggcttggtggcacatgcctgtaattccagctatttgggaggctgaggtggtagcatcacttgagcctaggagtttgaaactagattgcgcaacatgcaagacccacccccccccccatctcttaaaaaaactaaaaaaaaaataatggcacaagcttaatgatattaattcactgtagcactactgtatttgcatcccacagatttagtatgctgtattttcattcagttgaatattgaactagccttgtggtcctgggattaaccttattgtcatgtttattatgccttttacaattgctggattctgtatgctaatattttactaatgattatgaggaatattagtatgtaatttggggcttccatttgactcaaagattatttagaaatgtgctgtttaatttccaggtgtttggagattttcctattaactttctatttctagtttaattctattatggtcagagaacaaacgtttgtggtttttttttaagcttgtgaaagtttgtcttatgactcagaatatggtctgttttggtgagtgttccatgtgcatttgacaagaacatgtattcagctgttaagtagaatgttatataaatatcaatcagatcaggtggattgatgatgttcatttcttccatattcttactgattttctgtctactagttctattactgaaaggagtgctgaagtcatcaaatataattaagaatttgttttcctatttgtaatgttctgtaagtttttacttcatgttctttgaagctccattattaggtgcatatatattagttatgctttctattatgaaaattatatttgaagtgaattactcgtagactacatatagttgggtcattttaaaaattcattctaacaatcttgtcttttaatttgtatctatagactattcacatttaatgtaattttggcatgtttagatttaggtttaccagtttagtaatttgttttctgttagctgcttctgttttccattactctgtctttcctgcattcttttagattgtttgaacaacttttagccattctgttttaatttacctgttgtggcttaaaaattcttaactctccatatagttttagtgatcactccagagattacattataaaaacttaacattttcaccacctgctttaaaataaattcatttctttaaatggattatggtccacttaaagaaatgttaaaactacgtaggtctctttatcttctctccaccttttctcttattgttggctgtatgttacgtttctattaattgaaagcttcattgggcaatgctattgtttttactttcaaccattaaacatatttaaggaaactaagaggagagggttaatgtatttttgtctgcatgtttaccattttgcttactcctcaacctactcttccaggtttccttccggtattatttcccttctgtgtgaggaatttcttttagcaattcttttagaacaggtctgctggtagcaaattctcttagttcccatttatctgaaaatatctttgttttatgattgctctgaaagatactttaactggatatagaattctacctttgatagtttttttctctttcagcactttaaaatgtgtaacttccttctggccttcatggtttctgctgagaaacctgttgtcatttgaagtggtgttcccctatattttatggattgtttttctctgttttcaagataatttttaggctgggcgcagtggctcccacctgtaatcccagcactttggaaggccgaggcgggtggatcaccggaggtcgggagttcgagaccagcctggccaacatagtgaaaccctgtctgtactaaaagtacaaaaaacttagccaggcgtgttcgcgggcacctataatcccagcttctaggaaggctgaggcaggaaaatcgcttgagcccgggaggcggaggttgcattgagctgagatcacgccattgtactccagcctgggcgacagagcaagatgctatctcaaaaaataatagtaattttttgtgtttcattttcaacactttatgatgtgtgagagtgtggaattctacgtatttatccatttttggattcaccgacctttttgaatctgtagttttatgtcatttgtcagatttgggaaggcttttgacattatttcttcagatatttttaatcatcctattctttgcttttagaagttcactgacacagatgttagatctttttgttactgtcccatagatccctgatgtattactctattcttgaattgctataaagaaatgcctgagactaggtaatttataaagaacagagattcagttggctcatggttctgcggactgtacgggaaacatagcagattctgcttctggggaggcctcaggaaacttaaaatcatggtgaaaggtgtaaaggggaagcaggcatatctctcatggctggagcagaagcaagagatggggagggtgccacatacttttaaatgaccagatctcataaaaactcactatcacaatgacagcactaagggggatggtgttaagccatgggaaaccgcttccatgatccaattttctcccatcaggccccacctccaacattggggattacatttgaacatgagatttgggtggggacatagattcaaaccatatcacctggattctgttcattttattttaatccccacagctacatcaattggagacctggttctctccctgctctcagaatgttggctcttttgaagatcctattgttgccgctgccaccatggggttacgtgagaaaagtgaggggaaaaaactgagacactatctttgaatgttatttctttgcctttttttttttttttttttactttttttcttttaaaaagtaaactttttttaggccagtcgcggtggctcacgcctgtaatcccagcactttgggaggccaaggcgggcagatcacaaggtcaggagatcgaggccatcctggccaacgtgatgaaaccccgtctctactgaaaatacaaaaattagctggacatggtggcgcgtgcctgtaatcccagctacccgggaggctgaggcaggagaattgcttgaatcagggagttggaggttgcagtgagttgaggtcgcgccactgcactccagtctggcgacagtgagactccatttcaaaaaaaaaaaaaaaaaagtatgtaaaatgtaaactcactgatggtttcatgatgattcagatccttgtcctctatcccaatcgtctactgctatttacttccagtgttgtcgattagctgctctatgtgttctgtccaagttttatagttggactaaatctttgaagtgtgttcccaccacccccgtaatgtgtgactactaatatttctgctcaatttgttctttttcccctccttgtttttatttttattcttggcttcctaggggttgctcctgtctttccatagcttaatgtcaagctaaagatttgtcagaggttttgttcaaatatttcaaggccagtaaggtttctattctttctttgtgtgtctatctgtgtatcagggagtatattcaaacttcaggccaccatgttgcctgacctggcttttgctttcctccgggctcctctgtgtctcctgtgtgcatgaacatgcagaggctcagtcagtcaaggatgtgtggaggtgtgggccctgtccagaccctgtagcacgtgcttgcagtgtccgttcaactagtggagtgtggaaagtgtattaagcccccaacttgcagtggaggttatcacttaaattcacagcactccaaatcaattgtcaacaccctcacacacacacagtctctagctgaacacatgccaacagagggagagattggtcagtcatctgaagaagggatggcagcagcctcaagcaaaaatgccacagatggctgggcatggtggctcacgcctcttatttcagcactttgggaggccgaggcagatggatcacctgaggtctggagttcaagaccagcctggccaacatggtgaaaccctgtctgtactaaagatacaaaaatagctaggcatggtggtgcatgcctgtaattccagctacctggaaggctaggacaggagaatcgcttgaatctgggaggcagaggttgcagtgagccgagatcgtgccattgcactccagcctgggcgacgagcagaactctgtctcaaaaaaaaaaaaaaaaaaaaaaagccacagactgtgatgttcttactcaggttcagcctttagctgaagtccagagcactgaaatggttgttttgacggttttgtccagctttatagttgcttttgggggagaggatttatcaatgtactcatttcatcatgccagaagtagtagtattgatatgattttttatatatatcttagaattttgaagatactgttttcttattttctagcatacaacaatctgattcttgttttttattccttagaattttattggtactttcttatttccttttgagtttaacttagcaggatttgtttaattttgtatccctccaagcacccaggctggagtgcagtggtacaatcatggctcaccacagcctccacctcatgggctcaagtgattcttcctctttggcctcctgaatagctggaactacagacacatgccaccatacctggctaatttttatttttttttatttttggtagagatgaggtctcgctatgttgcccaggttggtctcaagctcctgagctcaagcagtcctcccacctcaacctcccaaagtgctgggcttacaggcataagccaccatgcccagctcttattctttctttgttaaaaaaggaactttggttctgaagactcttatttgccttttggctcaaggagaaattcttaaattttctttgttatttcttcttcttattttaattctcataaaatttctcttagatgtatgtaggataatttaatctgtattctgggatattaactttactctcataatttaagctttcattttacttcatattttttttttaactttttgttaaagtaccatggactttagctttgtccattttgctagttaactccttttttaggtttatttcaacagacattttaaatttcaagcttgttctgtgcaatttatttatttatttatttatttattttgagatggagtttcactcttgttgcccaggctggagtgcaatggtgcgatctcggctcactgcagcctccaccttccagattcaaatgattctcctgcttcagcctcccaagtagctgggactgcaggcatgtgacaccacaaccggctaattttgtacttttagtggaaacggggttcaccatgttggtcaggctagtctcgaactcctgacttcaagtgatccacctgccgcggcctcccaaagtgctaggattacaggcatgagccaccgtgtctggcctctgtgcaatttagtatttttgttttctttagtgagtgcagctcctccataatagcactatatacaatataattttctgtgctatgcagtatattagccagtagctgcagtggctgggaatgtggcctgtgagagtgagaaactaaattttatattttatttaatgttagtttatataaaattaaatagccatacatgtctaatgattactagattggacagcacagctctacaatttaagaatccttatactttttggcttcaaaataattctgatgccttagttcatctcctcattcaattgcatgtctgttttttatgctcttggttttttttaggtgtctaaaggttaataaaggttaaaaatattggaagttagagtaggtttcctcaacacttaagtgagtttcttctggagaaagtgaatattgaatataaaaatccattaatttctagttctactaagtgagctaggcagtccttgctttagagaatatgggtacttcttctcaatatgtgtatgtgtgtagcctctgtccctgtggtggccagaatttactataattctgtctctggccatagtgtccagacagaaatccctgtaagctgattacccttttccaccaggtttagatcagatacaaatatatgggggcaaagactgagttactctttttttttttttttttttttttgagacggagtcttgctctgtcccccaggctggagtagtggcgcgatctcggctcactgcaagctccgcctcccggattcacgccattctcccgcgtcaccctcccgagtacctggtactacaggcacgtgtcaccatgcccagccaatttttttttgtatttttttttgtatttttagtagagacagggcttcaccgtgttagccaggatggtctcgatctcctgaccttgtggtctgcccgcctcagcctcccaaagtgctgggattacgggcgtgagccaccgcgcccagccagactgagttactcttgaacatgtgatttgcatctaaaccaaatttgttaaaagtcttttttttttttttttttaagtaagaaaaggcagtgattttgatttgtaatgtcttttgttaggagaagtaaaagaaaaaaaattcttgaagaaaagtgagccagaattactgcctagggagtgatagtcatgtaggttcacaatgaagtttagaagtgctcttcgtggttccgtttcctcttttgctttagtgttcaggaaactaaaaactgacagtagactagttggaagatagactaggttttttttttttttttctagttaacctaagtcagaagggtgatatcactagagacttggaagtaaaaagagctacctgcaaagacttgaagtactaagattacctagaatctgaatgccctgtgttactctgcagatagggcattttactgttatgaagagataagatctattgtaaatagtctaaactaataataacgagtaagtatggaattggcgtttttcctttaaagttttagcatataattttgaaatgttttaagaatatttttgaaatgtttctattttttaatttctcttttagaagtcttatctaaaataagcatgtatatcttacatgtaaggaattattaacttcattttttcataaaaataatcagagtaagactttcaacagatgtcaggatagctgaagttctccatcactgtcatacgtttcacttatgacaggtttgtaatttctgttagggaatgtcatctaagtgctctgcatctggtattttctcctgcaccctcatgacaagaaaaaagcctttgattatttctcttttctctctatttacatgttcaccactgccttccatgttcagatgtgatctacatgcaatgatgattactctttccttcctttcccccttgccctcttttatcgtctttctttcttcctttttttggttgaccctgtttaaatgggatctatcaaatataccaagtttcagtgaaagttacttccttgtgttaaaagtcatgactttctcttttatttatacacttaataacttgattatatatacttgaattttgttttagtgcagaataattttataatctttctgaaggtattttaaagtggcagttaattccaacatttgtaataccaacaatgcagataactgagttgaatgacaacagcatgaatagccttgattaagttgtacatgtgcagatagctactgtgtatatcatgcctgccatctggacaacagtgatttttttttctttttttttttttgtttgagacagagtctcagtctgctgcccagactggagtgcagtggcgtgatttcggctcaccgcaacctctgtctcccaggttcaagtgattctcatgcctcagcctcctgagtagctggaattacgggtgtccgccaccatgcctggctattttttgtatttttagtagagacggggtttcgccatgttggccaggtaggtctcgaattcctgacctcaagtgatctgcctaccttggcctcccaaagtgctgggattgcagacatgagtcactgtgcctggtcagaaaacagtgatttttaagatgtcatcaattgtatggtagaatctgaattcaaagatgttaagaaggggatgggggaaaggtgtctcttagaacatgtaaaagaacatgttatttctgtcaacttccaaacttttatctccagccacatctcttacttgatttcagatttgtatacccagctcctgttttacatctccactctggttaatgtgcctcccgggatattttaaatataatttttaattctgcatcctatgccttgtcctcccaacctcagtgttccttcttcattctttttgatttttggctcttacatcctttgacttaggttataaactgtagagtcgaggatgactcccttttatcatacctcacatccaatttaccagcaaatcctattgactgtacctttataatatatttagcatctgacacatcttatcatctcttccactatcagtctgataaaagccaccatcatctttcacttggccatcatttcccatctggtttcttggcatttacactatagttcatttccagtatagcagccagagtaatactttaaaaatataattgatcatattgtttcctttttttcaaaagtaacttcattgagttcacctaccatacaaatcactcatttaaagtgtacagtgcggaggttttagtgtattcagtgtgcacaacaaccatcaccaaatttaattttagaatgttttcattagccctaaaagaaaccccacacccttagccattctcccccaatccttatattccccccatttctaggcaatctaatttctgtctctgtggatttttctattctggaccattttatatacgtggaatcatacactgtgtggttttttgtgactgcttcttttacttagtgtaatgtttccaaggtttggtcatgttatagaatgtatcagcattttgtttctttttattaccaagtaaaattccactgaatggatatgcgacattttatttattcatcagctgatgaatgtttggactgttttaactttttggctattgtgaataatgctgttatgaatattcacaagtttttgtgtctcctcctgctgtggactactgtttccctaacagaacgtattaattttcttttgtacaaaagccactccaaagcatagtgcttaaaacaaccactgcttgggtcaatgagcacactatattctgcactgcactaactttggctgtgctcattcatgtctgtgaccagtggtggttttaggtagatggctagtctaggatggtcttgagtggacaacttggttctagtaaactagtccaggcatgttctcatagaaaggcacaggtgagagagtgagcaagttcaattgtacaagaggacaagacttgcatatttgcattttaagcttctctttgggtcatgtttgctaatactacattacaaggtatcacaagagcaaggagaagcccagggtcagaatggaaaggggattgcagagttacgggtaaaagatgtgcctacagagaagccattaattgggggtcattaatgctatgtctgttgcacataccaattttgcttctaccttaatgctttttgcatttgtttcccttctgtttgaactagttttctcttacatacctgcatgctgaacttgtttcacttccttcctatctctgttcatgtatcatcttaccaatgagaccttcaagttttaccatactacaaaatgaatagccacccaccccgatcctgctcacagtctctgtttttctctataactttttatgaccatctgacattgtctgtttttttttttagcgtttatcttcccttaactagaatgtatgctctatgaggtcagggactttagtttaattacactgtcttcattgcctagaaccctggcactcattaaatatttgttgaatgaaaaattaatctacattgatccatttttacctaaattggaattatcttaaagttctaacctgccttcatgctatggcatgtataaagtgtcagtcttttgattagaatacctaatgatggaatatttcttctacttcttatagagacatagaccatgcaatatatgagtaattctaccatttacttagctgtctgacttgggccaagttttttttaacctccctgtttcctcatctgtaaaataggggtaataatagtcccagcctcatggagcctggcacaaggtaggcactgtataaggttggtgcaatgtgtattgcataatattttttatcacctacttgttattggagtatatggcacagggaaaatggaattgaaagctggagcaatcttatattatggagaagttgcaaaatctttgaaaactattttttcaaagggacaaagcacataaagcaaatgaaataggtgatttttttttcattgaatgcatcataacattatatccttaaaacactgtcttacaaagtgctctctgaaaaatactgttctttatttcagggtttacgaaaaagtacataaaactagtgagcatacatcttaactctctgagagtcttataagtaccatcctagatgcatggagagaagataattcattacttacactaggtcatgccttaggtcgttaagacttaagtatctcatggaaccccagttgagaaagaacaaaaatataacatcttgactaaggtggctagtgcttctctgatcttaactattatttctctagcctcaggtgagccttcttgaatgtgatttcatcagtctcctctaagcttacccagaatatagaatttttaatattttatatagccagcacttataaactacctgcttcatgctaggtagtatacttaggtgctaggagtaaaactgatcaagtggggtaagttccaaattcacagagcgcacagtcctaacaggctgtcatgcctcagttgtttatttgtgacagtgtttcccacagacttttaattttggaatgataggatgtggtgctctggaatggtgtcccagggttttggagaactgagagtaacctgggaaagcaggttacagtgagagaaagttatgaccaggagttgtaccaaaacgcaggaaacatgatatgtatattgttatggtgcataaaaatacttacaattaaaagtcctgaacctacactacatctattgtttcacatattttccttcaatttaaatcctgctccaaatacagctcctttccgaaaattcagttttatgtgacagaaatttgatctgtttcactgaaaacccatttgaatagtaattgtgagcaattgttgaatttgtaaatgttacgtaaatttagtggatgactttgtggacagtttgacgttatggacagttattcttgatactgtttcccctcctttcccctgccatccctgaaactttagggcttaatctgcttttaattagccagaaaaaaatgtttgatcctcttattcagttttagattattttagatgatttctaagttaaactctaagttagaatagtttctgcttattgatttcatgaatatcacttctctatttctacttctcaccttctgccaggccaaaggaattgtggaactatgatcatcaaactcctaaatcatcagccttttccttaaaagacttaaaagggttctatctatgtagacacttgtctggctcctgattacagttttaccattctcaagtgatactatttgtttcatcacagtccacataattcagggtcaagatactattatgaaatgactgtaaaaattactaatacctttggctctctaatttttctctcttttcatcatatgggcctgacaaaatgcccgctacctgcctgcacttaggcaattgaatgtagtgctttaaatgtataccaaaaccctcaacagggcatcaacaatgtctggcagtgcagctgcttcttcactttcccaattaaaaatgcgtttgctggctgggcgcagtggctcatgtgtgtaatcccagcactttgggaggccgaggcaggtggatcacttgaggccaggagttcaagaccaggctggccaacatggtgaaaccccgtttctactaaaaatacaaaaattagctgggtgtggtggcgtgtgcctgtaatctcagctacttgggaggctgaggcaggagaatcgtttgagcccaggacgcggagtctgcggtgaaccaacatcgcactactgctctctggcctgggcaacagaatgagactctgtctcagaaaaaaaaaaaaaaattcatttcctccactcattgcaaacctctcacagctcccactcctatctgtggaattcacttcaaactttactgagaaattaaatgcagctcttgtcatcttttcaccaccaattctacaaacttgtctgcattggtcctcttgttctgtcttcctttcatttgttatcgaagaccattcccgacagtctgatttctctacttgtgactcagatttcatctttcctgcatctctgtcttccatatcattcttctcccctcgattaaattccctttagccacaaacatgctctattatctcccagccccaatacatctgcaaatgtatgtaaataggaatgaccaaatatgtacagatatacaattcctacctttcctaatgtcttctagccactattatgtgttcctattcttatctaataaattttcttaactgaatattttttccttctacctcagtgtctgtttctttcttttcagccatttttggtttctcttgtaaatgtttatgatccccagggctgagccttcttggcctatactctcttgtaggtctgcctcccagtatgctagtgacacccaaatatgtcttcagcctcatctctcctccagggttctaaacttgcataaccagctgccttcttgatcatttagtaagcctctcctgttggtgacataatgcttgatttctctccctcatggcatcactgtccacccgttgcacacatcagaatttcagaatcagccttaattcttagttttttctcactcttcctccatgtctaatccagtagccctatctccactgttttcaccttggtccaagcaatcatctcttgcttaacacaaccatagtttcaactagtcttcctccctgcattcactcttggcccaagcaatcatctcttgcttaactatggttgcttaacacaatcatagtttcaactagtcttcctccctgcattcattcttggcgcaccgtaatccattcttcactagagtgataattagaggtactataatatatactgctctagagttatattgtctagaatttactagctgagtggccttgagcaatatacttaacacttatgccacaatgtgctcgtctataaaatgggatggtatatttatctgttctctgattgctataaaggaatacctgagactgggtagtttataaagaaaagaggtttaattggctcacggttctgcaggctctacagaaagcatgatactggcatctgctcaccttctggggaggcctcaggaaacttacagtcatggcagaaggcaaagcaggagcaggtgcgtcttacatggcaggagcaaggggtagggggaggtgctacacacttgtaaacaatcagatcttttgagaactcactcatcaaaaggacagcatcaagaggatggtgctaaaccattcatgaaagatccacccccatgatctagtcacctccaaccaggccccacctccaacattggggattacaatttgacatgagattgggtggggacacagattcaaaccatatcagaagtaaattgttagtaaaatataaatcagattatgtcacacatacctgtttttgaaactttagattctcattgctcttagaataaaattaaaactctacttaccgtggctttcaggatccttcataacctggcatattgcctaatttttctgatacccatcttgtttctactctccccttgcttaccatatagccacagtcactatctttaactttctagttggaaacatggctttttgtggggtgtatttccttttactttctattgttttgggaccaacttatttacgtcagttttgtgtttgttttgttatatgtaaaaatagtgccttaaaaaatcagtttttttttttaacctggtgaatcatttgttttatctttataaatgctgggacgagaggcctactccttttttccaattttgtgagagattggtaaaattcttagaagtggaattgctaggtcaaaagatagaaatgttttcagatggatgattcctattgaagtaaattttttgagaacttaacatgtccaaaaaggttttcatttgccctcatgcttgactggtagtttgcctggatgtaaaattccagattcacagtcatttttgcccagacagtgaaaacattattctactatcttttaaaaaataacagttttattgaggcataattcatataccatactatgtgcaatttagtggtttttaatatattcatagagttgtatagccatcaccgcagtacattgtagaatatttttatcactcaaaaatgaaacccctggatttattagcagtcattctctgttcccaccaatttgcccaccccccagccttaagtcaacaagtaatctactttccgtcttcattgtcttttaatgttgctgatgaaaagtctgatgccaaattaattctagttataggaagcttttagagttttccgttttgaatttctggaatttaattatgtaaactaggatttatgtagatatgagtcttttaattcatccgccttagcctcactgagcccttttactcagaccattggtgtttttaactccaaatatttttagcataatctttatttattctattttcttcatttagaactcttactaaatgtattttgaacttcccaaacatattctttatatctcttcaactttttacttgtatcacccatttctttctttcttgctctctcttttttaacctctctaccttctgggacatttctttgtgttacatatcactactatgatctttatcaatactacttctgttatttaccccttctcctcaagtgttttcttagtaataatatttcagttttctccttgcccatttattctgtttgttcattgtgatctttttctttcctcccattggatattcatagtgtcttgtgattcttgtttattgaataaggactaaattgacaaaaactttgcagttacataggtctaggattcttttctaaatgggaaatgactacaagtgtcatgtattcattgactggctttcctccagggtgcagggattttaagaggcaggcttaaggccaccccagttaccaaagtaaggacagctttactatgtttattcctggaaggagctagcttacttacttagtatcctcctccttcagtatcttccctctttccctctcgccctcccacttttcctttctacttcaagtatatagtaaagtgtagggaataatataataactatgtacctattactcagttttgttgaattgtcttatatatgcttcagatttttataaacaaaaaaattatagacacagatatagcaccttacagtcttactttgatacttttctctgccctttctgccttttcagaagtaaccattatcctgaatttactgtttatcatgcccatgcacatttcagatacttttgctgtgggtgtagatccacaaacaatctagaacgttgattgcatgtttttgtgaaccctgaaagaaccaaccctttaaggcagattctgagtggctaacagtccaaattcaaaatagacccacgcgatcctttgcagacatgtagagatcatatgtgtactccgcattcctggaaaacctatacacccagtaactttaggactttcatagctgtctgttcctatttatgccacctgaattaacagctaccagaaaataccatttggccttttgtacctaacaaacactctgtgacctgcctcagccaatcagaactgaacaagtttgcacccctcatttgtatagtggaccagagtgggaacctgactgtgaactttctctgtaaatgacaaccccttttctttgttctctcagaaggcgcctttattttctaccaaggtacatctccacggtttgcaaactgtttgctggaataaagcctgtttcttttttaagaaagaaaatctttttctgtagattgttgacattttaaaagttgtatatatcctgaaacttgctttttcatcaatattatgtttttgagatgtattcatgttgataaatatagcgctagctttttgttttgacttaatatgtggtattttgttatacagatgtaccagtttgccattttttctctcttagggaacatttgagttggttctagttttttgctattataaacattgctgcagtgaaaatgtcttgtacatatgtgaatataagtagctacatgataggatatgctcatccttagctttactctagatattgccagtttactttcaaatatttatattataccacatgtagaatatgatagtgtttgttgctacatgtacatgattaccaactcttgtattattaggcccaatttttttgcagtctcactgatttttcatatgtatgtatgtattttttgagacaaggtcttgctctgttgcccaggtgggagtgcaataatgcattcctgtcttattgtagcctcaaacttctgggctcaggcaatcctcccacctcagcctctcagcctctgttagctgggagtacaagtatgtggtaccgcatccaactaattttcttttttttcttttttttttttttttctagagatggggtcttgctatgttgcacaggtgctgggattacagggatgagccattgtaccaggcctggtttttcattgcatttctttgattactaatgaggtcatttattttatgtgtttattagatattcgaattccctatagtgaactacctattcataagtcttttgcccattttcttttggattagttgaccttttccaaaaggatggccacttaccctggaaatatttattatatagtccgttctgttccccactaaattataatgccaatgtgaaccatatgctgtgtaaataaatacctgtgcctctgtttctgagccctctattctgtctctttgggctttctgtctctatgctagtatcatttctctgtaagtcttgttttcctggtaacaccagtcttaccctccttattattcaaaatagccaaaggctactattatacagtgcttccataaaaattttagaatcaggctgggcgcagtggcttacgcctgtaatcccagcactttgggaggctgaagcggacggatcacgaggtcaagagatcaagaccatcctggccaatatggtgaaatcctgtctctactaaaaatacagaaaattagctgggcatggtggtgtgcacctgtagtcccagctacttgggaggctgaggcaggagaatcacttgaacccaggaggcggaggttgcagtgagccgagatcatgctactgcactcgagcctggtgacaaagtgagactccatctcaaaaaaaaaaaaaaaaaaaaatttacaatcagtttttcaagttccatgggggaaaaattatttttggaattttgtttattgcactacactgaatttatttgtggaaaattgacatcattataatattgaatcttcccataaaaggatatttatgtaggtctttgtcaagtgaaggggaacacatctgcatgcacacatacatgtcatttggtgtaatgtgaaataaggtttagtggagaaaaataaagaagtattaaggcacacacaattccctaaggtctgttatccccatatagatgtgtgcactggccagacacatctagaactatgtactgtggaaagggctcctgtgtaataattggagctttgaggttggtgaaatggtcttactagggaaagccatcagtactctgtggctgatcagccttttcttgcatgaaacaaactcagacctcctgagccaactttttgataagctaccaaaacaggggtggaaacctctagagtcatctgactctgtctctcttcttagtagccttttgtgcacctgcacattattttgttgtttccgtcacaaaagttttgggaatcttttgttagacttttcttctagattctttataatgttactatcatgagaagcatctttttttaattggctctggctaatgtgttagaacaccatgtaattttatgtccttgattttatatccaacaaaccttgctaaactcttctgttagtttttatagttaataggtattagccctgatggtttgtagattctcttgggtttttctgtagatagcatgtttcctacaaataagttttttgtctctataattctaattcttatgcctctttatataaatatatatttatataaacacttatataaacactacctatactaccaagattcaatgattgttaacattttactgtgtgtatatctcctaagaaaaaggaaattatttcatttaaccaaaatatcatatgtaggaaggttaaaattctatcatcttacatctgatatgtgttcagatttccatggttgtcccaagaatgtctcttgcagctatcttccatccctaaactaagatccactctgcatgcactgaattatttgttgacttttagtagtagttatcttttagtcttaaactgaccacctactgttttgttctcccatgaaatgatttattaaagaatccaggacagttgtcttagaatgtcccacattttggattagtccaattgccaaggctttgactttcaaagagaagaaaaatgtcttagagaatgttccacaatctatatttgattatttcagtgtagcagtcttagcgtatttctctattccctgtgtttcttctaaaccagaagttaagtatgaaggcttgattagattcagtttaaatgttttgcatgtatacttcatgggtgatgtctcatgttgtatcacatcaagaggcatatgttgggttgttccactattaatgattctaagccacttgaaggtatgttttccccttcatctttaatctgtggcgaaatactttggcactatgtaagtatcctgttctccatcagcttttctcctaatgatttttagcatcatttgatcctttcctgaaccaattattttatattagctggcattcttttgtaaagaagcatttccccatatcaagtgggaataactaatttttcctaaaaaggcgggatacatgcataatttttttcatttaaagttcagttttctaagggtgtaataatcccctacagtgtgagcaactgctctcccacccttttaatttttatggaattttgaaggttttttgtttatttgtttgtttttgcataccatctgttatagtcaattacagtacttattctttttgctgaaaatctccaaatttggtcagtaggagtcccttcaagctggcctctgatgttgttctgatatctggcacaagatgttcctagatctctcttcttgaataataatagataggtttgaaatgctgtaatgctggccctttcccccattaatgtagtcattgtgttgttgttactttgtgtaatctaataatgcttattttgttaagacctaatatgcttattaataaactcattagtaaaacctaaatgcttatttaggtttactttcatgtatattagtctctagattctccatctgtgttcattttctatggctgcaataataaataacaacaaacttggtcacttacaacaccacaaatgtggtgtactctcttacatttctggaggtcggaaatccagaatgagtttgttttactgggcaaaaatcaaggtatcagcaagactttgctctctctagagacaataaggaaaaatctgatttcttgccttttccagctcctagagctgcactgcttgtatttcttggctcatggccacctcctccatcttcaaggtcagcagtgtagcatcttcagatctttctctgctgagtttttatatcacctaatcatctatagtaaaattcccttttatttccctcttataagtatgcttgtcgattacatttagggcttacccagatatccagaataatctccctgtttcacaatacttaatcacatctgcaaagttccttttgccacataggataacatttacaggttcttctgggtcttggtatatgtttagttatcttggtggggggccactattcagccctctcatgccactctttctttgatattacttcttgattcagtttcctttttctaggttgtcagttattttcttcttgcaccttaacgtcagttcattatcttcttgcttcttttactgatgttgagaagtatgccatcagtctgacttgtctttactttctggttgactttaagaactgaacttttttattttcacctgttttggaaaatttatggccagcttctgttcaaatatctccccattccctgtttacctcccagattaactcattttgtgcttcgtgtctttcatattttccattcatttatctctgccttttggctaattttctcagaatcaccttctagtcctttaattctctcttcagcagtaatctgttttacgttacctgaggttttaatttgatgactgtatgattcaaaactcatgtctttatagtttcctcatgcttcttctttatatgtgttgtctttaggcttgctgttcttccagagttatctcagtagaaatttacttttgtgttttggtctgcaatttattagctttgatttctttgtcaaactgattatattcgttttctgtttttcaggaatgttctgaatttttccaactaagtggttgatggtcctggcctccttgctttcagtactgtgattctttcaaccattttcttgaaattttaagaccacttctgtctctcccttccctccctctgttcctcccccaaccccacctttcgtaacaattatttgtttcttggaatctcttaggctagtcctgtagttttcccctttgacctattaagtattatgttactggattcctaattaatgattattcttgcttttaatatatatatttatatatactattatatatgtttatatatcatatatattaatttaagagtttgatgcctttcttcacagtttggattattttatgttttgtttgtttgtttgtttagagatagtcttgctctgttgcccaagctggagtatagtggcgtgatctcagctcactgcaccctccatctcccaagttcaagagattctcctgcctcagcctcccaagtagctgggactacaggcacgcacccacacctagctaatttttgtacttttagtagagaaagggttttgccttgttggccaggctggtctcaaactcctggcctcaggttatccacctgcctcagcctcccaaagtgctgggattacaggaatgagccattgtacgtggcctatttttttttatgttatctttgttgagttttgacatctaggttttgctagcttcttaaagtaatttagaagatatataagtatatatatgaatatatatataaaatcacctgttactaattgatattttaattacattttctttaagggatgaggggagccaatggctgtagttttttttttgtgccatagctccccttcatgtccttccatagcagtttgtctgcatttatattttaacatgggcatcttctaggattttttaaaaaaaattctcagtcttttttttggagaaggagttttgccatttgtaaagtcactaaaaatgatcagttatttactaagcttgcttggctgtaatagctgtggtctactgaagagattaaaacaggagaggagatcttttagtaactttcttgaagtttttagttttgtttttaattttttcatctcccttttaggattgtggtaacaggtttttcttttttttccaagaagatgttttaactatgtacctaccgttagcttttcagtatcttattctactttttaatatatctctattttataagagtcatcaaagttctttctctgactcttctggagattctgaaagactttctctcccaaacacattctttaaaattccaacaagggtcattgtgacttttttttattcttcggatataaaattactcttctttggggagataaaaaacctgacttccagacacttatggtctggccccactatacctagccaatattatcattttcttttactttttttttgagacgaagtcttgctcttgtcacccaggctggagtgcagtggcgcagtctcggctcactgcaacctccgcctcctgggttccagtgattctcctgcctcagcctcctgggtagctgggattacaggcacacgccaccacgcccggctaatttttgtatttttagtagagacggggtttcaccgtgttggccagctggtctcgaactcctgacctcaagtgatccacccgcctcatcctcccaaagtgctgggattacaggtgtgagccaccactcccagcccaatcttaaccgttttttataccccagcaagaaaattttattctaatcagctcattctcttcatttctcatctctgattattttcccccactttctctctcccatcctttgagagaaatagttctttatgctaactgcatatgagtttttatggaacattgaaaaaaaaaagggagtgtgggtaatattgtcctgaatttactggacctaagaaagaatcactgaactaggatgacctgttttctttcctaccctattctgaaaccagcttaaatcttcagctttaattgcatacctattatgactaagacaccaaaataaatcatgaggggacaaaaaaagaaaatgtttctgatcttaaagtagctaatagacatggaaaacataatcaactttatgttatcaaattatgacttagaaaacagttttgccgagttgatcagtgaacacatcatagagggatgctctaaggaaagatccatcctggacaatgtggcaaaaccccatctctactaaaaatacaaaaattagccaggtgtgctgctgcgtgcctgtagtcccaactacttgggagtctggggtgggaggattgatgccagggaggctgaagctgcagtaaaccaagattgtgccactgcactccagcctgggagacggagaccctgttttaaaaataaataaagtattcatttttttttaaacaaatatatgtttgcttattgtatgctaggcactgttctaggctctggggataaatcagaaaaaataagacaaaaacctatgccctcctggacttcattctgttggggagtgggaagacacacaccaataacaaaatgaacacgtaaaatatatatagtaaggtggtcacatatgctacggaacaaataaaattaacaaagggcatagaagctgattctgtgcctttaaggaatgggagggatagagcctttctaaatgagaaggtaagagaatgcttcattgataaggtgacattgggataaagagatgaatgaacttggtaagacagcaaactttatagaaatcttaggggaagagcattccaggcagaaggaatagtaaattcacaagtcctgcactgggagtatacttggcacgttcagttaggccaaatgtgattggaatgggatgagtgacgggagaacaataagaaatgaagctagacaaatagcagagggccaggtcatggctttggtgatttttagtggggaagccagtggagggttttgagcaagagaatgacatgtgatctgcagttatagttttgtttttgagatggggttcactctgttgcctaggttggggtggcgcgatcacagctcattgcagcctcaacttcccaggctcaagcaatcctcccacctcagcctctgggaccacaggcacacaccaccacgtctggctattttttttttttcttttttttttgtagatacagggtcctactatgttgcgatcctcccgtctcagcctcccaaagtgctgagattacaggcgtgagccaccatgcatggcctgcagttacagtttttgaagaatagctactgtgccattctaggcatgaaataggagaggccatttcagaaactcttgttaataaactaacagagaaatgaaggtggcttagaccagggtggtaaagttagagaaggtgactaatatctacatatattttgatttggagatggattgaaatggattgtcagatgtgagaaaagagtcaaggatgatgctgaagtttttggtttactcaaagaagggagcttatttcctgaggtaaagagactaggaaaaacaagttttgtgggggtgatgggggagatcagaagttagtctttgaacatgttaagtttgaaatgcctattaggtatactagtagacatattcagcaggcagttaggaatctggtgttgagaggaaaaggtagagttggattttaaattttgggcttcatcagttcatagttggcatataaagatacaagattggatgagatcacctagggagtaagtgtagcttgacaaaagaagccatctgacactttttggagatatgaaaaattagcaaaggcatcatgaaagaaaacattgaaatacctgactggaaaaacaatttggaacctctatcactgcttctcagactttaatatgcatatgaatcattttgttaaagttcagtagatctgagatggagcttgagcttctgctgtgtgttttgtttgtttgtttggtttttggtttttttttttttttggcaggttgtggggcggcggtagaaactgagtctcactatgttgcccaggccggagtgtagtggtgcactcatggctcaccgcagcctcaacctcctgggctcaggtaatcctcccacatcagccttctgagtacctgggactacaggcatgcaccaccatgcccggctaatttttgtattttttatggagatggggttttgctatgttgcccaggctggttgtgaactcctgggctcaagcaatccacctgcctcggcctcccagagtgttgggattacagatgtgagccactatgctaggccagcttctgctgttctcacagtctttcagaagatgctgctgcttctggtctgtggacccacactttgagtagcaagactttatatgacaagagtcatgaaaaacaattgaaagaccttaacatttgtagaagaataaagattaatatccagaataaagactatctataaatgaatatggaaaaaacaaacaactcaatagaataaaagggagtgcagtatagggaattttccaaaatctcaaatggccagtaagcataaaaagtgctcaactttgtaagaaatacaaattaaaacatgattgccttttccctttcagactggcaaaagtttagaagtgtgattgtgctgggtgttggtgagattgtggggaagagtggacttataccctgcagatagggacttgacttgatacatttcttcttttggaagaccatttggcatatttattaaattttaaaataggtatatccttcaatcctggaatcctatacctagataccaaaaaataaaacttgcacttttactctgaaaagcagttcagaactatttgttggagtattgtttgatgttgaggaaatggaataatctaaatgtcctttagtaaggaaattattaaatcaagagatttggaactcttttttttcatttatttcccagtacatttaaaaattgatatctgacattttttcattataactttgaatagtttaaaaggccataatttctactgtgtgttatatttatgttaaatacattttttggacaagccttaaagctgcagatttagatcattcaacttagaaacagaatcttccgtataacctaatagccagttctcactatcaaaccagacaaattggactgtttttcttttttattaagaaaaaaaacctgattacttatttatcttaaaacagatatactaatatatgccttttaataaccactaaacttctggattctagtctggctggctggtgatgggtaaggcttggagccttgccacaaatttgtttcattgataaaatatggtcctgctcttaatttttcccccttttctctcaaggaatttccctatttaattgtctatttgttaggtactttggaatttatacgtctcagaatggtgcatcttagtagtatttgaggtggaaaagaactttgcctttcttttataaagtggaaaataattattttaaaagaggaagtagacaaggagaaccagttcttaagcagatcaatcagggagcatacagataaaacttgaggatctggaaattctcttaaaattgtctatgcccacctaacccctggataccactgaagtttagagactgttgaaataagcagtgcaatgctatgaaatgaatgctatataaccattagggagtaaaatatatgcatattgacgtggagagacttctgagacattactccatgaaaaaagcaagtgttaaaagtattttatatatagtatttaattatatgtgtacatttcatatatgtatgtcttaatgttttttccatgagtaaaagggagacatggaaggctgctcaccaaaccataaacagaacttaacctttttgaaagggggcctgggaatgtgaggaagatgaagagagatttcatggtttattctgaatattcatgtattctttgaatcttttatagttgagaatacgttgtattactagtgtagaaaaaaatttaaagatgtttcataataaaagagaaaaaccactgtactaaatgatctctaagctcaaaatttgaggaacactggcagttactgtgatgtagttgtctatgttaaaatatttctaattcatatactaagtgatttttatttaaattcttttgaaatattttttaggtgtggaatatcaaacaaatgattaagttgacacaggaacatatagaggccctattggacaaatttggtggggagcataatccaccatcaatatatctggaggtaagcttttgagtatcatatctagtaattttgaaaagaaaaaaaatgaacttataaaaacatttgtactgataatcttgattattttaggaggtgggattaggaatagatttgggaagagagaattagctttgcctgtattatacttcttaatcttgttttgtgtcacttgttaaaataaacatgtattttataatttagaaaacatcagaactaagggggaagtgatataaatttcaaggtattactctgaattaaatttttatttttatttttattttatttatttatttttttttgagacggagtctcgctctgtcgcccaggctggagtgcagtgacacaatctcagctcactacaacctccgcctcccagcttcagacgattgtcctgcctcagcctcctgagcagctgggactacaggcgcacattaccacgtccacctaattttttctatttttagtagagatggggtttcaccatattggccaggctggtctcgaactgactttgtgatccacccacttggcctcccaaagtgctaggattacaggtgtgagccactgtgcctagccaattttttttttttttttttaaagagaaagcacacagttttggagctcagcaaaccagttaccatattggaaaatggggtaattttttaaaatattttttccagaatgagtttccccaaaattggtttctgcttccttataggtaaaatttgtaatttttaaatagctcaacattgtttagctttactgtttaataatgccttgaggtttgtgtcaagccttgagcataattgtaaatttatattcattaatcctatgagttagtaggtgctgttataatcacagatgagctttcttagcattagttttcttaagtagtcagtcagactccacagccaacaaggtgttacagaatctaggtggtaaggctctacagcccacactgctcactactaccctacacaccctttctttataaaagctggctcagctgtcatcactagtgaggcaaggagatggagaactctaaattagaaatgatcaggttgccatttggctccaaataccagagatttttaagcacagattgaaagacttctgaactaaatttgtaacttagtaatttaattactttttgaagggccagttaagtcttaaggattttatgagaaagttaagtttatatttctgaagtaaacttggaagtttggaaataacagctaatatgctgttttctttctcctcttcttcatgtggctcatcccagatcacactcctagttaatatcaaagctaggactagaattcttatttctcattactagttagtgtacttcctaatagcctgtgctatcttctatacatatattattaggaggctgatcaaaggtgtcataaggaagcaagtactgctaatgagaatggcaattttttattaatcagaattagacaatataaccagcagtttttcttccaaccatttctatgtcttggagactttgaacccatgctgagatgtaattcatttgcatcaatagctatgtccccactatagcagtgattcactgccccctcctcacataactcttcaggctttttactatttgaagactgatcactaacaacaaaccttagagcttcttattctgtgcccagtactgtgttaaatgtattttattgcttaactcatttcttatagttactttgagcaagatactaggtactggatatttttgttattcccattttacaagtgaaaaaacagagaggttaagtaacttaactaaggtgacactgctagttaggaaagaaggcagatatctaagtcagaaatctgtgttcttgatctctatcttattctacctttatcatgacattgtctcgctctttccccaccctcaccccccagacagcttttcttatttgggctaaatatttctattcccttcagccattcttagtaacataatttatggaccttttattagatacagtctttttggttggttcttttagaattagacacacaaaattgaactacttattaaaattaaatctgagtaggacagcatacatcagaccataactcacaggttatattattagcttgtggtaaaacagattcttatcttggggacttgtggtatacaatgtgtgtgtattatgtgtatgtagtatgcaaaggtatgcatatacacatgtacatacacacacactgaaggcagcagtataatataataattacgatgagccatggagtcatacagactccatgtttgaatcccaactctggcttagtttctgtactcaagatatccagccttcttataccccacctcattagtaaagtggaaataatatcacatcttgggtaagttaaggattaattgagtttataattatgaaataacatagttcctgattcaaatattaagaattctataaatagttgatttatcttgtactgctctaggccttggggaatagcaattgtctgtctttttttttttccccctgagatggaatcttgctgtctcccgggctggagtgcagtggcacgatcttggctcactgcaacctccacctcccaggttcaagcaattttcctacctcagcctcccaagtagctgggattacaggcatgcaccaccatacccagctaatttttgtgtttttagtagagacagggtttcagcatgttggccagtctggtctcaaactcctgacctcaggtgatctgccccccttggcctctcacagtgctgggattacaggcgtgagccaccgtgcctggccgggaatagcaattttttaaaaaatggccaacaatctccgcctttttaagcttatattttaatgaggggatggatatatagacaatgaacatataaatgagttttagaacattgcacttatcaccattttatttttttattttttgttgagatggagtctcgctctgttgcccagtctggcatgcagtagcacgatctcagctcactgcagcctcctctcctgggttcaagtgattctcctgcgtcagcctctcaagtagctgggattacaggtgtgcgttatgactcccgactaatttttgtatttttagtggagacaggtttcaccatgttggccaggcttgtctcaaactcctgacctgaagtcatccacctgcctcggcctccctaagtgctaggattataggcgtgagccaccgtgcctggccatcaccattttatatactatgaatggactctaaccagcccaagagaaaagacctgtacatactgatatttaaaggcccatcagtgaagagctagatctactgattactcactgagacccaccgttctgcaggtttctcatctgccatttaagattcctttacactttttttttttattggggtaaaatatgcctaacaaaatttaccattttaaccatttttaagtatatggttctgtggcattaagtccattcatgtttttgtgtatccttcaccaccatccatttctagaaattttatcatccaaaactgaaactctctagcctttaaacactaaatctctatttccttctttctctagttcgtagcaaccaccattctactttctatctctatgatctatgaattggactactctaggaacttcatgttaatggaatcatataatatttgtccttttgtgactggcttatttcatttagcttaatgtctttgaggtttatccatgttgcaacaaggataatgcatatatcaaaatttttttcctttttaaggctgaataataatccattcattgtatgtatttaccatattttgattatccattcatccatcagtggacacttgggttgcttctacgttttggctattatcaataatgctgtgaacatgggtgtacgagtatctgagttccttttacttctttggggtatataccaggagtagaattgcaggatcacatggtgattttatgattattttttctggagttgccacacctttttctgtagcacctgccctgttttatattcctactggcatcgcatggggttctaattttttacatccttaccaacacttattattttcggttgattaaaaaaaccatagcctaggctgagcgcggtggctcacacctgtaatgccagcactttgggaggctaaggtgggcggatcacgaggtcaggagtttgagaccagcctgactaacatgatgaaatcctgtctctactaaaaaatacaaaaatttcaggtgtgtgtagtggtgcgcacctgtaatcccagcaattcaggaggctgaggcaggagaatcgcttgaatccaggagaagaggttgcagtgagccgagatcatgccactgcactccaacctgggggacagaataagactccgtctcaaacaaaacaaaacaaggcaaaacaaaaaaaacatagcctcatgtgcgtgaagtgataccttattatggtgctgatttgcattttcctgatgactaacaatgttgagccttttattatgtgcttattggccatttgtatatcttttttgagaaatgtctgatttaagttcttggtccattttttaattggattgtttgttttgttcttgttattgagcgtagttctttatatagtctagatatcagttcttattggatatttaatttgcaaatatttttcccattgtgtgggttccctttttactctgcttatagttttttagtccaaattatctatttttctttttgttgctcttgcctttgatatcatatccaagaaatcatcaccaaatccaatgccatgacattcttctcccaaatgctcttgcatttgggtctttgatccattttgagttaatttttatatgatgtaaggtaagggtccaacttcgttcttttgcatatggatacccagttttctcagcatcatttgtggaaaagactgaatggccttggcacccttgtcgaaaaccatttgactatatatgcaagagtttatttctgggctttctattccattggtctatatgtctgtctttatgctgtcatcatactgttttgattacactagctttgtgtagtaagttttgaaatcaggaaatgtgagttctccaactttgttctttttcaaaattgttttggctattcaggatcccttgagattccttttttttttttgagatggagtctcactttgtcacccaggctggagtgcagtggtgtgatcttggctcactgcagcccacctcccaggttcaagtgattctcgtgcctcagcctcctgagtagctgggattacaggcacctgccaccatgcctaccttttgtatttttagtggagacggagtttcaccatgttgaccaggccaatctcgaactcctgacctcaagtgatccacctgccttggcttcccaaagtggtgggattacaggtgcaagccactgtgctcagcctccatgtgaattttataaaggatgtttctctttctacaagtaggtcatcaggattttgatagggattggattgaatctgtagattgctttggttaatactgatatcttaagaattcttaactctgaaatatgagtggacagttaagaataaccagatatttaaagaaagctgtcaacaggaaagacagcagcagaaatggtcaacagaaactcagaaacagtgcagaaaacagaataaaacttaaaaataactataattagcatcagagataagatctattagtcctgtcttgctttgtagcaatactaaagaagcaaaagtaacagagaacaagaaagacctcttggaaattaaaaatacaatagccagaaatttatttttatttttatttttttttaattttctttttaattctcagcaaggcaagttacgtctatagaagggtgcgcccttacagatggagcaatggtgagcgcacacttggacaagggaggggaaggggttcttatcccatatgcatgtggctcttgctgctgtgtcattcccctgttggctagggttagactgcacaggctaaactaattccgattaataactagaattttttaatttttattattatttttctttttttgagatggagtcttgctctgtcacccaggcgggagtgcagtggtgcgatctcggctcacttcaagctccacctcccgggttcacgccattctcctgcctcagcctcccgagtagctgggactacaggcgcccgccaccacgcccatctaattttgtttttgtatttttagtagagactgggtttcaccgtgttagccaagatggtctcgatctcctgacctcgtgatccgcccgcctcagcctcccaaagtgctgggattataggcatgagccactgtgcccagcccagaaatttttaaaaatatatgtatatacagacatataggtatgtacatgtgtatatatgtatgtgttgtatatatataaataaatgttgaaaaataaatattggaagataaatgttctagaaagcagagtaaaagcagagagatgggaaattttagaggaaacatgagaaaaattaaggaataaatcccaatccataaaaattataaatgcgtttaactgcaagaaacagaacccttcaagaataagtttctggaacaaatagggattttcatttcctttcacatagcaagaagcgtagaggtaaattattgtaagactagttctacacaggtcagttgtcagatacttggttgaatcgctatagtccctttagcttttctgtcaagaccacagcagatttttaagatctttccctcatacaactcctcaaagcagaaagcagagaacagagaagttctcttgtatactaagctcttgctaggaagaaaatctttctcaaaaatcctctataactcttccttttatatctcattgactagaatgaggtcacatatcacccctatactagtgactatgcttacatttcctgaagtaagagtctaataagtcaaaaatttccagtgttcagtttttcttcagattagtttgtatgctgtcaagtagaagttgtgctatgattattttattctataacatttcaacagaaaccccttttaagtttctataggaagataaatcttcaactacttattcttgcttcttctcttcattgtagcaaaacagagaaattggttacaccaccatcagaaatcctcttgattttctttttcccacgtactaatttatttaaaagccatcttttcagttctagatgttctcctactggcagataacagttaacattctattgattcccttgatgataactacagtgaaatatgagatacagtactctaaagaatttcaaatttgtcttctcagttgatctttggttcccttttttctaccatcatccaaaggaagaaaagataaatttactctgaaaagttgttccccagagtttcttcatttcctctcagtgtttccatattcatttatccaacaaattattggaatgccttctatgtgtaagatataatgctagatgcttttctagtagtagattcttctttctgtacttgatttattggagcccagagatgaagggatactgtctctgtaatcaccctacagctgagtcctaactacttcagaatttatggttgaatcctacagtcccctgtagactgatgaagacagtaacagctcctgacatttactgagtatttactatgtatcaggtactaatcatatattagttcatttaatcttcagcctaccctttgagttacacttaactattctcattttcattttataaatgaagcaattcaggcacagagggatttaataatatggccaaggttacacaacttgtaattggtagccaaggtttgaatcccagacattctgaatttacagcccatgcgtttaatcaccgtatcattcttacacttggcagcctttctgatttttagtctatatagaacctagaataatacagaggcattgtgtcaaacccttcaatgaaattaatactggaagctggatgcttcctgtggaatgcagaacagtccattatatatcatttatgggcagtttgtaagatttcattgtatcttgtgagagtaagaataattagactaaatttaattaactaaatgataaaaaataaaatttttatttcgctgctttttctcattacattgaaattaaatagatccttagatttttttcccttctgttttaattgagaaataattcacatactatacgattaactttttaaaactgtgtaattcagtggtttttactatattcaccactatcttattccaaaacatttttatcactccccaaaagaaaccctttatgcattagtagtcattccctgcagcccctgacaaccactgatctactttttgcctttatggatttgctggttgaaatatttcatataaatagaattatattatgtggccttttgtgactggctgcttttacttaatgtaatgtttccaaagtttgtttatgtagtagtatgtatcagtacttcatttcttgttatggctgaatatttcatcatacacatatatcatgttttgtttatccattcatcaactgatgaacatttgggctacttatatgtttttgccattatgaataatgccaccatgaacattcacgtgcaagtttttgtgtagatatattttcatttttcctggctgtatgcctaggaatagaattgctgggtcttgtggtaactctgttttacactttgaggaactaactgccagacagtttttcaaagttgctgcactattttgtattcctaacagcaatgtatgagggttacagtttctctccatcctcatcaacccttgttattatctatttgtttttttaattaaagccatcttagtaggtgtgaattggtatttcatttggttttgatttgcagtttcctaatgactaataatatagaacatcttttcatgttcttgttagccatttgtatatcttctttggagaaatgtctattcaaatcctttgcccacttaaaaaaactgggtttgtccttttattactgagttgtaagagttctttaggccaggcatggtggctcacacctgtaatcccagcactttgggaggctgaggtggatggatcacttgagtccaggagttcgagatcagcctaggcaacatggcgaaaccccgtctctacaaaaaatacaaaaattatccaggcgtggtggtgcatgcctgtagtcccacctgcccgggaggctgagatgggaggatcgcttgagcctgggaggcggaagttgcagtgagccaagatggcagagtcacccaggctggaatgcaggggcaccatctcgactgactgcaacctctacctcctaggctcaagccatcctcccacctcagcctcccgggcagctgggactacaggcatgcgtcactgtgcctggataatttttgtattttttgtagagatggggatttgccatgttgcccaggctggtctcgaacacctggactcaagcaatcctcccgccttggcctcccaaagtgctgggattacaggtatgagccaccgcacctggccaggagttctttatatattctagatagtagatccatgacttgcaaatattttctcccattctgtggtattttttcccactctttcaattttgtcttttgaagtacaaaagtttaaatgtggatggaattccaatttatctattttaaagtttaaatgtggatggaattccaatttatctattttctgtggttgctgtgcttttggtgtatcatacatgagagaccattgcctaatcaaaggtcaggatgatttactcctgtgtttttttcctaagagttttatagtattagttatatagccaaaacaggtttagttgcttgctgcctgcagagtccaattagtaagagcaaagtctagtataaagtgacttttttattccaaagttagcttaaaggaagaagacgtacaggcttcctgccttaagggtactgcttccctgttggagcagaaagtgggtgcttttaaagaaggtgcctacacgggggcagaaatgagcgggtggaagatctgcatattcccttcggtgccttctttctcaggcagtcaagttggtggcttcatgggcaaaaatacctcagaggtggctgaaaactctagcagtcttacttttggttgtagatcaactattacctcttgaggcaacttcctgacgggtgagagttccactcaggattgtctaagcacataattagatcaacttgccttgtagggaatgtctggtgaaaaggagataaaaggccataattgcatttcttttattcttttatctttttctttttgaaacagaatctcattctgtcactcaggttggagtgtagtggcatgatctcggctcattgcagcctctacctcctgggctcaggcgatcctcccgcttcagcctcctgggttgctgggactatatgtgcatgccaccatgcccagccaagtttcatattttttttagagatggggtttcaccatgtttcccaggctagcctcaaactcctgggctcaagtgatctgcctgccttggcctcccaaagtactgggattactggtgtgagccaccacccctggcatataattgcatttctaaagagctaagtaggaagtggggaggaggaggaaagaaaaaaataattaaactttttcttagaaaaatgagggtgctcaattatataatagatatgtgacccattttgttttgtttttaatttttgtaaagatggagtctatgttgcccagtcaggtcttgaactcctggcctcgagtgatcctccagcgttgacctcccaaagagctgggattgcaggcgtgagccaacatgcctggcctatttcgagttagtttttggatatgttgtgaggtagtagcccaacttcattcttctgtgtgtggatattcagttgtaccagcgccagttgttgaagagaccattctttctgcattgaattgtcttgctggctttgtaaaaaaaaaaaatcaattgactgtaaatgtaaggttttatttcttgttctattgagaaataattcacatactatattattcacttttttaaagtgtgtaattcagtggttcttagtgtatttacacaatggacaactgtcaccactatctgattctaaaatatttttatcattcccacaaagaaacccttcatgcattggaagtcattccctccagcccctgacaaccactgatctactttttgcctttatggatttactagttgtaccttgttctattctgttctatatgtgtgttcttattccaaaattattgcgctgtcttgattactatagttttatagttaagttttggaatcaggaagtataagtcctccaacttcttttttcttttataagattgttttgataatttcaagtccgttgtatttccatatgaattttaagatcagcttgtcagtttctacaaaaaaaaattgagattttgagaaggattgcattgaatctgtagatcaacttgggaagcgttgtcattttaatgatattaagtcttcttagattcttttttcttttttgagatggagtcttgctctcgttgccaggctggagtgcagtggcgtgatctcaactcactgcaacctccgcctcccaggttatcaattattactaatacaaatatttattggatttttgctatgtggtagtctctacaataatttgttttacttgtgttatctcatttaatcctcac

SEQ ID NO: 1455 - DNA, 2510 bp, Homo sapiens
cgcctcccggccccctccccgcccgacagcggccgctcgggccccggctctcggttataagatggcggcgctgagcggtggcggtggtggcggcgcggagccgggccaggctctgttcaacggggacatggagcccgaggccggcgccggccggcccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttgggattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactgaaacaaatgagtgagagagttcaggagagtagcaacaaaaggaaaataaatgaacatatgtttgcttatatgttaaattgaataaaatactctctttttttttaaggtggaaaaaaaaaaaaaaaaaaaaaaaaaaaaaaaaaaaaaaaccc

SEQ ID NO: 1456 - DNA, 2298 bp, Homo sapiens
atggcggcgctgagcggtggcggtggtggcggcgcggagccgggccaggctctgttcaacggggacatggagcccgaggccggcgccggccggcccgcggcctcttcggctgcggaccctgccattccggaggaggtgtggaatatcaaacaaatgattaagttgacacaggaacatatagaggccctattggacaaatttggtggggagcataatccaccatcaatatatctggaggcctatgaagaatacaccagcaagctagatgcactccaacaaagagaacaacagttattggaatctctggggaacggaactgatttttctgtttctagctctgcatcaatggataccgttacatcttcttcctcttctagcctttcagtgctaccttcatctctttcagtttttcaaaatcccacagatgtggcacggagcaaccccaagtcaccacaaaaacctatcgttagagtcttcctgcccaacaaacagaggacagtggtacctgcaaggtgtggagttacagtccgagacagtctaaagaaagcactgatgatgagaggtctaatcccagagtgctgtgctgtttacagaattcaggatggagagaagaaaccaattggttgggacactgatatttcctggcttactggagaagaattgcatgtggaagtgttggagaatgttccacttacaacacacaactttgtacgaaaaacgtttttcaccttagcattttgtgacttttgtcgaaagctgcttttccagggtttccgctgtcaaacatgtggttataaatttcaccagcgttgtagtacagaagttccactgatgtgtgttaattatgaccaacttgatttgctgtttgtctccaagttctttgaacaccacccaataccacaggaagaggcgtccttagcagagactgccctaacatctggatcatccccttccgcacccgcctcggactctattgggccccaaattctcaccagtccgtctccttcaaaatccattccaattccacagcccttccgaccagcagatgaagatcatcgaaatcaatttgggcaacgagaccgatcctcatcagctcccaatgtgcatataaacacaatagaacctgtcaatattgatgacttgattagagaccaaggatttcgtggtgatggaggatcaaccacaggtttgtctgctaccccccctgcctcattacctggctcactaactaacgtgaaagccttacagaaatctccaggacctcagcgagaaaggaagtcatcttcatcctcagaagacaggaatcgaatgaaaacacttggtagacgggactcgagtgatgattgggagattcctgatgggcagattacagtgggacaaagaattggatctggatcatttggaacagtctacaagggaaagtggcatggtgatgtggcagtgaaaatgttgaatgtgacagcacctacacctcagcagttacaagccttcaaaaatgaagtaggagtactcaggaaaacacgacatgtgaatatcctactcttcatgggctattccacaaagccacaactggctattgttacccagtggtgtgagggctccagcttgtatcaccatctccatatcattgagaccaaatttgagatgatcaaacttatagatattgcacgacagactgcacagggcatggattacttacacgccaagtcaatcatccacagagacctcaagagtaataatatatttcttcatgaagacctcacagtaaaaataggtgattttggtctagctacagtgaaatctcgatggagtgggtcccatcagtttgaacagttgtctggatccattttgtggatggcaccagaagtcatcagaatgcaagataaaaatccatacagctttcagtcagatgtatatgcatttgggattgttctgtatgaattgatgactggacagttaccttattcaaacatcaacaacagggaccagataatttttatggtgggacgaggatacctgtctccagatctcagtaaggtacggagtaactgtccaaaagccatgaagagattaatggcagagtgcctcaaaaagaaaagagatgagagaccactctttccccaaattctcgcctctattgagctgctggcccgctcattgccaaaaattcaccgcagtgcatcagaaccctccttgaatcgggctggtttccaaacagaggattttagtctatatgcttgtgcttctccaaaaacacccatccaggcagggggatatggtgcgtttcctgtccactga

SEQ ID NO: 1457 - DNA, 63294 bp, Mus musculus
  misc_feature (3478)..(3794): "n" at positions 3478 thru 3794 can be any base
  misc_feature (7386)..(7433): "n" at positions 7386 thru 7433 can be any base
  misc_feature (9273)..(9758): "n" at positions 9273 thru 9758 can be any base
  misc_feature (11328)..(11347): "n" at positions 11328 thru 11347 can be any base
  misc_feature (17356)..(17375): "n" at positions 17356 thru 17375 can be any base
  misc_feature (21543)..(21986): "n" at positions 21543 thru 21986 can be any base
  misc_feature (30816)..(30835): "n" at positions 30816 thru 30835 can be any base
  misc_feature (49223)..(49242): "n" at positions 49223 thru 49242 can be any base
  misc_feature (61489)..(62638): "n" at positions 61489 thru 62638 can be any base
tgttcctgtggctttcaggaacctaagtcaggtctcaggcatgttacaccaattacctttgcactctgagctatcttgctggttccctctttatttttgtttattactttaaagtaattttcccccctgagatacggtttagatatatagccctggctagcctggaactcattgttgatcaaattagattcaaattcacagagatcagcttgtctctgcctccccaccgacagaattaaagacatgtgccaccagcccaggctttctctgttttaattgcatccatttattgactcgcttgtatgttggtgtgggtgctccattatggggttggaatggataatgaagccaggaggtcaagagcatatgttaggggatgtatcctaaagccttgcttagcagaacagaacactatttcactagaatcttttgtaaggagtagaaggcaggatactgctgagaggggttgtgcagtggtaatgggcacctgttctgtaactacacaggccaaagtgttaaccctgatcttccacaaaagtcactcctgcctaggtcttccttcagcctcctctgtcaaaggggagagaaaaggctggctcctctatggaatccatggcttaacctctgtagactgccgagccatttcatactggacccgagcttggcctgccttagtaaatttaggagtcaaagatagaagaattggaagttcaaggccaggcttggctctaagagatcccgtctcaaaacaaaacaaaacaaaacaaaacaaaacaaagcaaaaccatggggctggagaatgactcagtagttaaaagtgttcactgttcttgcagaggactggagttcaggtcccagcactcacagcaggcagctcatagctacctgtaaacccacgttccatggatctgatgccctcacctgatcttcaacagacacctgcacacaagtggcttacatacctcgaatgtgcacactcacaatgtaagactgatgataaaaacaaagaaccctgaacttgagctatttattctccataatagttctggagggagcggtacccccatttctctgtcaatagttctaggagtgaactctcgcctcccccctcccttgttgggctgttacacaggagtcggtactgctgaatgcaagcaaacagactctttatgtgtgaagagagcacaagggctggtgatgtggagcacccaggacacatcgccactcgtggaactacagccctgctcataccaagactacagcagtcataccaagaacctctacactgatgctaggaagttcagaaacccaagccccaggaatccacctggccccccaaaagaactttaagagaagttaacctacatgacaagataaaaatcagagctattctgatagaagatgtgtgtgtggggggggtttgggggtgggggtggagagggtgtctctgaggttacaatcactacttccccatcttctccctgcactatcatcttttaaaggtcccaggatttccccggagctctgtttggaaaccctgactggtttacggaaagaatcagtttcaatgccagaagacctgactttcaccaccatgatctccccaccatgaaggactagaccctcggaatggcagccaaatataaatccctccctccttatgttgcgtttttctttattttgtcatggcaacacaaagtaactactctggaatatgcaagttacctagctttagcactattaggggtaggagccatgtgacaccctgctgtggtggcttttcttggcactgtagtatactcagaagccttcactctgactacctgagttccattcctaggacccacagggtggaaggagacaactgactcccagaagttgtcctctgacctccacatacacactaacagagaaatggtgagagaaattaaacaaattattattattattatcattatgaatcacaaccagataacagtgcacccctattcttgagttatgacaacaaaaaaagtctctggatattgcctaatgtcccctagagggcaaaatgaccctcagttgagaactagtaggtacgcaaacttgatatgcaatcaaactgtcactgtgtatgcatgacaaacacatttgtaaatccacttataaaaggacagaaagagggtagaacttgaaggggagggaagctgtcaggtaaataccctctctctttcctccaactgcagctcagtcccaccatcacagagcatgcacacggggccacagttctgtaccagcctttacccaggcttcatgcttccctgaagcaccccttccccagcctgccccacgccactggcatgggtaattcttctccacccttgctaagatggatgcgttaataccagcaaactatttcttaatctcctaagcctcagctttgaatctttaaaaaggaaagagaaacggcacaaatctcttaattaggacgcccaatcacttcgataaatatttacccggttccagcatgaggcatggaaacccggcgccattagtcaatagaggtcagcaaagtgcaccttgggaacagcaggatgcaattcagcctagcttgggaggaggtgtcaggagaatgtttccagtctcgggctcctgctaaagacaggtgaacaaacacattccatacctactgctgcacacctgccccgcaccaagtcccaggtggacatggcagcctatttgtaaaccatcacctggtagtctggttgcctttgctttctggacagaggtagtgaagctaccgagcagatccagtattctgggactctccagagagtcctagctgtgctgctttggtaggtattattatctggaacgctactctcagtcaaccaaggtcacagcacttcccaagcagctaccctcattgtcaactccaactcttctgcccagtatttcctgcattgagttctaacactgcggctctacacatagcctagccttgtctatccaaaggcaagggcttctctcacattctggtaagctcttggttggactaacacccagacaccattcttcccattttacagctgtagaaacagagactgaagaagtggactcttcactcctgatctaaataaatagcctttggggacatcctccactggatgagaagtccaagataggtgtgggatgaggatgagggttggtttgtttgtttattggtgttttgttttgattttagagaagccaggttcttccttcctcaggaccaagtgacagcctgctaggcctaagagaacggctctaaagaaggaaggctaccttggaaggctgcaggagagggaaggcttctcttggtctcctccgcctactagagaacttttgtctacactcctgggctgagctcgaacccaatctttccaaaaggtcctcttctcactactcgaatttccctctgaatcagactactttatacatcttatgaactcgctggcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccacacacacacgcagaggaaatgggccagatgctgtattcccccatctgttagtacttcatcagggctaccatagctaactgttattgatcacttaatgtgccagggctataccaagtagtacttgaacaatctccattgatctgggaaagcaatagtccaaggtgggcagggccattattctcttcactcaacagaagaggaaatagaggcttagaaagagttcacaagtgccccaaagtcacaaagcttgacccagctagagagttggaagagggtttaagagactgtgggaagtcccttcaccaccaggagccacagccctctttgctgaagtgagctaggctcctcttactgccctgactggcagggcaagtgtcattaagttgtggactctggagctgagttgcctggactcaagtccatcaacccccacagtgaccttgaggaagtcattgtaccttggagtagtatcaattgcccatctgctcggtcgggggaatgacatcagtggctctaccctcattctttgggtgaggattaaacttgttaatatttgcccagcgcttagactggaatctggtgcagagtgagcactatgttaagtttgttaaacaaataacaaactccccttctggccccatagtgaggcgctagcctgtagaggaagatctgggattagtgatggatggggttggaggtggggggaggttgtgtgtctgtgtgggatgaactttccttagcaatgaacagggcagaagaaggggaccacagaatccaccaaagagaggtggctggccttgaggaagaagactctcttttttgggccagctccaacaagaggcttcccaaaaatctgggccagtagctggtgggggttgggaatgacaggaggggaggtttacaaccccaccctaggccttgagatcagttcctcaaaggataggccacagtctggtggctagccagaagccatttttcttaattccggaaaaaaaaaataacacttgtctaacgtgttttggatttattttgaaggaaccagagaagcatctctgtccccacctcaagttcccacagtcatcttacatcccaaatgaggagctgggggccttccgctgatgcagatccatcccggactttccagctcaccgcgtgactttttttttttttttaatgtgccaggaattcctctcccacgtggggtggactccgaggtactcaattaagcagccaatgaaaagtcagctctccggtagcaaatgaccctgacacttcttgtaacataaacagttgaaacgcttccaattagaactggagacagagctgtttgaagtctttttcttcagtcccctccttctttaaaataattgtcaagcgcttcggacagtgtgttgtgtgcatctttctctagcataaaataagctcatttccatttcttacaaaatttgtgaggtggcatgggggtggggttctgagcagtagtgagttttgagcttaagggacctgaaccaagttaccaagggccctgcttccctttcaggctctgggttctggttacagaagaaggaagaagaaggaaaaaaaaaagccgaggtgatacggtgaactgggagccagaggctcctcaaccataccttcagagagggttagaatgaatgaatgagtgaatgagtgaatgaatgtctttcagtaaatgctcatatagattcggcttgcacaaacaaaggagtttggccgtggatctggctgtcctggattccaattctctctgcctagctcgcggcctattactaagctttgtttgtgtatcagcccctcttctactctataagacgggccgtcagccaggccttgggagtgaagtgaggacgtactgggtaaccatggccgctttgtacctattaaacgctcaagggctgtccttccacacagtggggagcgctgctgcaagcagttcggctctgccgtgggggcggcgctcggcaaaaccgcatccatcacgctcatcatccgtgtggcaggccgggtgctggcgcctgggttcacaggagaactcaatgtgaagtctgccttgcactagctcacgctgactagtggggtccttgggagcatcactgccctggcaggagacgcggagaccagagacagagctgcggcgcttttctgtacacagtccgcatagacaggacctgaaagcccaaggcatcggcggccgccaggaggagggcgccgtccgacccagtccggagggagacggaggagagagaggccgagtaaggcgccttggcttgggcatcttgaaggcattgtgtttaataaatctgggcgaaaagcacacccgctcttctccccccccccttttctcggctcccaaatcaagacctgctgtacgacccccagtttaaggggtcttaaaacccctgcactttgattagcagcttcaaagagatccctttaaagttccccttcttccccaacctcacctctcctcgacacccatccccccccagcactcctaagaccagaacaacaacaacaaaactaaatgcaagtttaaaggggggcggtggagatggaaaatctcagacttcctcctgaacgcggcccatagaaattacctatttcagacgtgcgcaggagtaggaacaccgtggagtttgggttttgattttcttccttttttttctttctttctttcctttttcttcttcttttttttttcttcagggtttgtgtgtgtttttaccttttattatttaaattgatacgtttcattactagggagaaaaataaaatattcctttgatacacaaaatcaaattgatatttagcctctgcttacttttttatgcatggctcctttataccacatggtagtgacagattgtttgagctggaaggaaaagccattcaaagctaattaagcagccattccaagcactatttgcaagcgggaggctcagaagcctcggcatttgtcagcgctcccccacccctcgtggttttgactgacagctctggctaaggactgacagctctcggaatctccaccaattactagtcgagagtctctttgctggtctgtgattgggttttagacttgctcgggggcgtggccggcgcgccccacgtgggggctggagcgagaaaggggcgggccgggtaggaagcgggtgcgcccacccgtgacgtaagggggagggcagagaagggggaggggagagggaagctccaaagaggagccattttgagactaatggatgctttggccagatgctcgcatctgtcgagctaggcttctccctgccccctcccccttttcggtgcgcatcgtacacgatttatgtttttatttaggagaataaataaatgaagaggggagcgtggtcgaggccggagcgggcgctgagaggctccatctcggggcggccgctcacgtggaggtccccgcgcgctcccagctactcattaagatgcaaacgcgaaactcaggctcctaatgaggggaaaatatagattccgggggcgcgcggccggctcgcgcgcgcccgcaacgggccaggagcgtgtgcttgcgtgcaagnnnnnnnnnnnnnnnnnnnnnnnnnnnnnnnnnnnnnnnnnnnnnnnnacctgggcggcccactcggcgttggttctccgaggcccgcgggacctagggtgggcagtgtgccctgaacgtgacccttgtctgcgagcagatgggccccagagtcgaatatctacgcctccttgggtgtctatgctggtgaccagggacgctccaggctcgcagtcgctcttccacgggtggctgccgatgcatgtgcccaggcaggccatcaggccaagaaacggggtcggaactctgggttcgtagccaggagggccccaactccgtgctttcccttcttcaccatctcgggcccggagcactgctgaaggaacccgcccttggcaaggctgcggccaggacgtagctgtccccaaagggcaagagccccaaatggggctagccgcactactgagcctgttgtccgcagactgccaggcccttccatctgcgcggcccgccaagccagagttctcagacttccccctcgccggcagccgccttgcatcagaggcgctgtttatttggctttctgaaaagaagggcgaatgaacaaaggagaaaagcggggcgcccaagggtgggagagggggcagaaacggataaaagaaagagaaactcagtttggagaacagtcttagaggtcggaggtaactttgggtgccagcattttatcggtcctaaatcttttgaagtgaaaacattaaactgacaaagtgattctgtttgttttatagtatctaattgggctgctttgcaaccctaatgagattagaggggggcaatcgttcgccgcctctgcagaatcaactgatccattactaccagccacaggttttaaggattgtacagcttgtccttttttcccccccttttgttgttactcgttttctccttctcccctcccgccaaataattatttgctagtagatcgtgggaaaaaaagaagaaaaaaaacctagcagcccaggactataatatatatctatttattatatgtctttcggttaattcctgatgtgaggagcgctgtttttcactcccaagcgaaagtcaccagcgggtagggcctgattgctacttttcatgcatagttttagacacaagagggcattgtgacgtcgcgcctggcggcgcccagtcgcagtccgagtcccgtggccccacgtgggagcctcgcactcccattggccaacgctaggcgaagccgccacattattttgttacttttcagtccctatttggaactgctctcgcggcagttcagacctcgtgctcggcccccttcgcctgtctgtgtgtggtatccgcaggtccgaggcacttttttttttttttgagtgcgtgtacgtgtgtgtgttgagtgcgtgtgcttgtgtgttttgggggtttgtcggggcgcggagaggagagccaggctgggaggaaggaaagaagccgcagagctcccgggctcgggctacgtctccccctccggtgctctccagcctgcgcgctcctaggcggcaggacgcagaccgctcctcgccagagacgcggccgatccacttgaaagcagaggaccccttcgccgaggcttcctatgccggctggagttaggatgccacggctcattatttgcaccgactgagcccggagttcctcctcgaccctgggaagggctggcggcggcggcaggagcagacggaacagcaggctctcctctccgaggggggtgggggggcgtcgaagcgtcctcgctgggctctagccctcacccacggtcctcaagccgtcacctcggtggcctgcttcctttctcttctcgccgcgagctccgggcccgaccgcctctgggatctgacccgcgcgccccggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctgccatgtatccgcaaggcagacatccggtgagtaattgcaactaggcttatttaagcatctatcatggcagggtaaacgaggcagtttatctagcacctccattttgcttgttgctacctttatggtgcgcgcgcgtgtgtgcgctcacacaaaggggctgggtgggtgggggcgccgtagagagccaagggtaattgcgctcgagtggcccgggcggcctgcgttggagggggacgctggcttccgccccggcccctctcctaagtcttccaactcgcgctctcggcacttggccgccagagcccttttggctttgggggtggtcgggatgcccgcttccgggccccgtcgggagagcgttgaaaaacttgctgggaaggttctgggctgtggggtggtggccttgccggaggctcccggcggggagggggccagggacccagaggaggcacggggccgcgtggagcccttctgatgtgcccactcctctcccctatgttgtccttgtgggctccaggcaccccatcaacccgggcagccgggatttaaattcactgtggccgagtcctgtgacaggatcaaagacgaattccagttcctgcaagctcagtatcacaggtaaggcgggtggggggtggccccgggctggcgaggagggcggccttgcgcgctcctgctaccccccccccgcggggccgagggggacgtcgacccccggctgcggggcggctgggcctccgccttttgtttcccctcaccgagcgcgcagccttaaccctttgcgttctgcgatctcccagctcctaaagcccgccctgtcgagggtcggggtcttgcgccttcgtccgggcccgcccccgcgtggccgagacgagtcccctcgctagatcaagggaagtttggagttggtactgctaggctccgggtggtgggcagccaccctcactgcccggaggatgctagagaatgggttactcagggtgccgggcaagtgaagtggtcctcctaggccctagggtccaggtctcgaaggaggcggtgtaagcgccaggcctgagagtctcttcctgccctcacagcctcaaagtggagtatgacaagctggctaacgagaagacggagatgcagcgccattatgtgatggtgagaggcagcccgcagcagggcggagggagggagggcagggcagggcagggcacccaggctttgggacagtcgcagacccgagctaggcccagcttcaggacagccccctggagggctcccttcttcagcttcctcttccctgccacttggaggccgaaagagaaacacattcctggccacctttgtaaagagcatttcagttgtgttttgaaggtttcccagagggctggttgccttaaactggttagaaacataagagtcaaatgagccggtgtcagggttgtataaaaatccctcttggagccctcctgggagtgtttggaaacttttgtttggcagaggggatctaggcagaatgggacaggagtgcctacctttcttccccagagtttttccagattggaggagcctttttaannnnnnnnnnnnnnnnnnnngagccttttaaagccctctgcctcccgtgtcccctcctcaagtatttcctcagttgggactctggtcctccccccccccccccccagctagatatcttttaaccttgagttcaagttgacatctttcgtttgggagtgggtatgggagccacttaagggcaggccagcagcaggctttccacataagagaccttccacccagtgctaaccaactcccagaggacaagaggagacgggtatacagcgttccctgtagagcctgcaccttgtataaacagcacatatggtacagggggtgcctgtgggagggggcacatatatttttgtgtatagtattctgagtggagaggaatgcttagccacttcccctatcagcgttgacacctttgtgggtgggtggactttagtggctttggacccagtgaatggttttgttaaagccttgtgagggggaggggtaaaatgagaagtgtcctggggttgcctgttaatgaccctttttctttttttttcctttttctttttttttttaattttgtagtactatgagatgtcctatggcttgaatattgaaatgcacaagcaggtaagtactttccttttttatataaataatatatatttaaattgtaagatgtgtgatttctttggaggtctatcctcccatttgaaagtgagcctggttcttttttgtattcccacttggtcttgaaggataaatgttcagtgagtggtctgaatgaaggcctggtgcctgtctgggctctgctgggttatattgggcttttagcatttgtgaacttaggcctggtctgggatctgggtggataaagacccaaagacctaagggaaagttgtccagttgtctcccaggagctgtgtgacacccggaggtagagagttggctgtctgcttctatctgttttaatgtaaaattttcaaaaaggaaacataggcagagttccttgcccctcttctttcttttccttgcagagagagacagagagagagagaggtactgccttgataagattacacttcaagggcctttaaaagccaggctgagctgttgaaatgtaagggaatgaagccactaacggcctagaaaacttaaagccagagtgaaatgcaatcctgtgccttgcgtttaggaggagtttctcaactctctttatttgaaggcagctgtgtcccatttcacaggaggaagctgaagcccagaggtgaagtaacttgcccaggggccagcctcaccaggccttttgagccggctggcagttgagctcagctttgtaatcctgaagtcaaaccagtttagctagtgtggtatcctttgatggatatgtaaactacctcacattgtcaccctctaataacagtatacctcaaacccagcaaatacaaacactctttatctcgagcatatcagtagctagtcctgagctaggccaggctgtgggagaggcctgtttgtctatttgtgttccaaggagaggctgcctataatttggcttggcggacgattagcttcgacttggcacgtataaatggcgcaggccggttgttctttttaacaattggtgttcttgaaatctcagaaggctgttgactcattctagcctttggtgaccgtgacttgaatggattttctgctctaaattaacagtcatttacaaggtttaaattttgctctttaaagggggcagggcccagggcaggtgagaagggcaggtgaccctgagggggaagtgtgcagattcctgtccagcaccagtggcttcttttgaatctagtttcttttcccttcctgtagggagccccgccattgggtgaagggtagccagagaggggccagcatttagtgagtgatgtgggaagccggctgtggtttcctgaggaattggttccctaggcgtgcacacatggaggctaccacatttggagttcttggcccacagaaataataaacaaacactgctttatatgtgaagaaggttctggggaagataggcagaaatggcttctgccttctaggtagaattggtccagggtcttgggtgttttaaggactttggggggggtatttattcacagtgcaaggtacttccacttcctccctttctccagtcctctccctccttggtgaatagtatcttgggcgtgttttaaagagggtaattgcacccaggttcaaaatttatagcagtagttgttgttataagagcttctaattaaggtgtaatatgtccttgcatgtcgagggctgcatgggtggtgttgcccgcgtctgaatacatggttgtttggcacaaagaagtcaccttggccgacagagcaaagctattctgagccccggggatgctgtgaactcagaagagctaagcatctcaatgctctcttggtggtgggacttctgtgcagagagcggctgtgttcatctgggatatctggccattcctcacataggattctcagatgagaaaatgcccgagatctggccacattgtcgttcatcctctcagccaggggtgggagagagggacccttaccctcttttttataggtggggagaccaaggtatccaggaagccctcatggcaagacctaggggcttatttcagagcctctgggttctgcagctgagctgccatgctccaggtgccttccagccccttcccggcttgaatgcaggctgagcagtctctgggttgggtgaactcaccctgtggctgtggaggaacaaagaggcagagaggtggagaaaccctgactgggaaacagggcagtacacccctgacctaatggcgtgctagccactccctaggcttgcaaggttttgtagaagaaaaccctgccactaattgtagtgtgggtctcgggtgcatttggcggatggtggttaggcctgagcaaacaagtttatcagctgacctgtttagcggttgactggtgttttatctgcacacacaatcaagtgactggagtgcttgaattattcatgcagtgtcctgccctctagacttgactgtgtgattacatctgcctggaacaaacaggctggattcttcatctttaagcgagtaggggtgggggtggggactggatgtacttttatataatagtctacagagctagcaccttgggaaaagtctgtctagtcatcctcaacctacacacacacacacacacacacacacacacacacacacacacacgcacttcaccaccaccacatatttttttcaaaagctcttcttcactggctccatgggaaataccaattagctgagaacctttcgttctgccagatggtccctggtattgacagagggcagctgatgaggtacgtccagcccgtttttattttactgagaggttaaactcactgtggctggctctgtccctggctgtgcccccccccccaatctctcttccaagctgtcaaatctcagagaagtaataaatgggtcctcctactcttctgcctccctccctaattatggtaaagcaaagattacagaatcacaggcctggcctgtgacttgaagaggtcaccacctcccccaggctcctgcttccaggcagagtgtcaaggatgattcagcgagggccaggaggcgatgatggctgaccgaccggcccatcagttcccgtcttgttcccgtagtgcctttccagtgtcagcagcagatgacaaagccagcttagaaacagactccagagcaactgtcatgcagtggctttgaggcgtggtgctgggggaagccagccgggaggctggcctttcaccctctgttggtgagcactgatgtttggcaagctgacttgaggcattttgatttgggggcagcatcatgccaatactagacagtcactattttcagtaacccaagcaagtcccagagccccagagctggaagagcgagcgctttggcttctcatccaaacctttgaagtcatggatgaggaagtaggctcagagagactggagctggcatccccagactgccacagtcacaggtggtgggatcgaatgctgtactgcagacttgccctccctaccccaggactcctctggagccagcccctttccgtaacttcgtagcatgctgtgtctttaattacctctgcttgtcccatgctatttattatccagccaggctcaggctgcaaacttggctccaccaaagtccaaagtaccccatttggggttgtataaccgtgtcagctgaatgctctgtgtccacagacctgtccccatttgccagctatttgcacaactaatgattgtgtgtttggtaataagacagagggcaggttcacagatgaggcgaaggtggtaataaataaataaataaataaataaatccctcaccgttttaccctgaccacaaggtggccatcggcacagggctgaggactgaaggccgaccataggcaacagttttctggaaagaccatgccaaagagttgacaggctttggtggcagtaggatggggatgcaggccctggtactaggggcagtgcctgtttgtgtggcatctgggttgagcggtgagattgacttctttgccgggagctccttcattcccccacaccgtgggttctttgactttagctgccttgttgctctaccttggaattgtgggggttgtgtgatctccccagcagggcaccatctttgctgtaccttgggaattactgagcctgaagctctttttaactttgtcccatccagctagagggtgacctaaccctctcatctcaggcttcagtggatcccttgtctgtggtagacgatagaagtgtacagagcaaagctttctgtactcctcccgagtcttttccttcttgtacacctgaccattgagatgaccttaggactagatgaagatagagaagcctgctgggaagccctactcccaattctactattccatgcgctcttctgagcagggttgtgtggttaccggggctccttttctccctgctctttagaattctccctccacccaggaagaatctcatttacttagggactcctttactttttggtcctcaatgccacattgttgaaggggattgttgaagggggagagagttggccaagaaatataaaacattttccatataggaaaatgtttttctgcatcactgtataaaatccaggaacaccaggagccaggaggagataaacagctctccgcagggctcgcccgtgatctggcctcgtggatctgagatgaaccacttcatctcagagcagtggaggatgcccctttgccaagcacacagtgtgtaataggtgctcagtaaacacgtgagggtttccttctttgggttgtgggcgggtgggtggccctacactgcacagagccctgggaaggaagtggggggttgtcattgtgggctgcctgctggtctgcagcctctctctgtggctgagcatacagtctcctcatcagcaaaatgagagagttggatccattcccaaaacggttattaggggtctgggatgtgctgggtgtgggcccgggcttggttacccagccgaataagacaccattccctccactggggcatcaggcctctaaataagtaattgcgatgcggtgaggtaagcgctaatgtggccgcagcgacacttgcttcactcttcctgggaaagcagagacgggtcagagaggatgtccctggaggaggactgttacttgagtggggccttgcagggagggtgggaggggagttgttaaaggcagacgccagcagccagagctcctcccaggtgacaacagctcctgggacggcagtgaagtacatttaggaagccacagtcaggaagagtggattgggggagggcaggggccgcacttgagaactgagaaggtggtgatattgtacagcacagcattatccgaaggcctctccaccctcacagtcacgactcggtggctccctctgtccccatatggctctccagggctggctccagtccatctggcaggggnnnnnnnnnnnnnnnnnnnnccccaagtggcattgtctcctttctcatactggtaattctgtaatgactgggtatgacctgcccctcccccatatttaattctcatcagcccggctctccactttgctattaatgatagcagccagcaaaatagctttcaacatgccattgacagtctggcttaagagcgcacttgaggcagtgctagacagctgaaagcacccataattgtgtaccagagtgagaactgcatgctcaagggtcttgtttttatatgcttaaagggacaatatcttgttttcaacaaatgctctctgagacacatccaagatgctttcttccttcctcttgtattcctcctcttggctctttctctctctggcctttcagaataaaggttcctccctaccccccacctccacccccaaccccaccccatggcttggggctgaaagaacttatagaagaggagtgatctactctgagagcagtggcagaaatccactaggctcgcccaaggcatcatccactcccaacccaaaggccagttggcctttccctgctgacaccagcactggagcagagacaagtgttggctggcatagagttttcaagtccttttgttggctgggcatggtgcatgtcagccagagactaggggattcgagctactgagctgtggctgagtgcagaggctgccatgataggacatggagaataggtaagccttggagctagacggagtgccaagtctccctgtctggtcagataacaggaggatcacccttctgcagagcccttgggtctaaggagcctgtctggaaaaccaggagggcggtgtatgggactggtattcttaactgaaagattgtaccacacttgaggggagccagaggaggtcgctgataactccagagattttactggacaagaggtcccctttttcttcacttcatccaccatcggtggcaaagtacatacccaagtgcctagctatgggaaggggaggagtgaggtccaagagccagagaaaccctgtctgtaaatggtcctcacttctctccatagccaaatttctcttgggggaaaaaaaatggagcctgggtcccttccctttacccacgcacgcctcgagtgacagtctgaagttctgatattgctattactacatccttgcatatgaacacacacacacacacacacacacacacacacacacaaacccaggtgatcgtgcaaatgtcagagacgagagtaacatggccgcttgagattcctgtagcacttgactgccaagcaggtgaggcatttttctccggaaatactggggcgtttgcttccagaacccgaggatcagacaccagaagagctgggtgtgggtggaggtgacctgtgtgtgcctggaggggcttgcccgtcgattcgggtgtggtggggtggaggtgtggagcccgggactgaggaacaggagtgttctgtgctgactgagccttgctgtctgcctggcagtgaggtgacaacacttcatcctgtaggagactcactcggacactgcggtctaggcttctcttcctgattgcctgctgaccaaggttatggttgtaaaagggatgatggtcagtgacctgtaccttgatttggagagtcttttctgtttgttttccttgttatctcctatcaagtcaaaggggggaagtgggggggagatgcagaagaagggggtgataaagctgaggtgtggagacaggaatgaggaagcgccagggaacacctctctgtctgggctgcttgaagcttgccttaccttggcgtttggtggtggggttcctagggcgtggcctttgtttatcttggcttgacaacctcttccaggtttgggttggttgctggtaattctgggaacgactctgaccctctttaaacttgtttatactggaagggaccatcttcccacagatggagacacaaagtcagccaggggttctttcccatcccatggtcctgtctccaggactgtgcagtccagcctgggtcaggcgggaaacccatcgtgtagccatgtgagtgaaagagagaagaggggccaaggtcactaccactgcccaagaccataaagtctttctttactccgggtttgacactgaggacattggtcagacaggcagcacacatgttgcttcaggagccagggaagaggagggcagtttagcttagaccagtgtcttggggccttaccattgtttttcctagcagagccccttcttctgctttctctcaaggaggagaccgcagcccaatttagctttgcctcagagtagaagtcctgggggccagcctggaggaattgagctcttaacagtgcttgcctctgcctgtcagtcttaggggtctcaacatgtcaccagcagctgctgctctctgctgccagggttctcctgtgtgggtttgacactaccttttatgtcatagcctaatgggggaggggtatcctgtaacctttagctttcctccaccccattctttcacttgaatctcaccccacttctcaagagaccccttctttgcagacaccttaaactcttaagtcaaaaacccagggccatacaggattagggagggtttctgacaaccctgtttttatgtgggtgagaatggaggtgtcagcagatttggagtttctcacagagaatccaggttctctagagggagagaaagaaccaggagcttggggggggtggggggatggaattctctggaaggctagagtggtgctttagagtcttaaaaatatgggtgtctgtaccttctgttcccaccagtgtgactctggacagcttcttgtcctttgtaaggttttgtgagtggtaggatgggtaatatgaccctacctgctagggtagccagagttttctaggattttcacagctgtggaagtacagcccaacgtggtcgacattagctacgtggactgctgaccaattgaaacgcgtggccctgtggtggctgaagcactgagctttagaactgatgcaaatccagttgcacgaggtcctgtgtggcccctggctttctagacattgggggtttaggaagtgcgatgggattatgggtgggagtggatgcccaggacgttagcacacagacggcctcacattgggacagataagagcctcaaaatttccaaggcctcagagagggagaagggactcaagaggagaggaaggggccgggctgcttaggttgcttaggctctgagcccatctcattgttaagtagctactcatttcagccctgcagtgtctctgattggcccagtaccttgaagcaggtgcccctgctgttggaagggtttggatgacgtgtgtggttgaaaggtggcccactggtagggtcagatcaggaccacatctgtttgacctggcctgtatcatgatcatgaaccactctgggctttggttccagtgcccacaagtctttatataaaatcttttaagaactcattttttttttaaagtgcatgcattgggtcagaatcagcctgccctggggctcttacccactggttggttgtcagcagcactgttgtggtcctgacaaatgtttgcagacattgcaaacatttgcaatgtcctgtcctccaagaaccagaattcgctagcagtgcctgaggagacctttggtataagggaagactcaggctctagacctgggagatgtggttaccttcgtcttgatctgtggagagcgatccctcgccctctctatacctcatctttggcttccgagaggtgggaggtttcctgtctgtcagagcagtcggtttgcgagtgaggagatggtgagacaagtgcctgaacttgatttccacggcctgtgaaatgtctccacgtacttgaggaaaggagacccgctgaccctctgaattttaatgtaagcaggggacgtgctccgtgcttgtgagagcaaatagaatagggctctgtttctccctactcggtccgctgtgtgctaccttggtttctcagtgagcccctgtcctcaaaatgtcaaagcagttggtttcatttgtaaccctgacctggtgaggagacccccaaaatttaatgagctgcctcagcaagggtaatgtgacttttacagcctgttgaggggcaaggggaagatttgcataacgctccaagggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatgattcagttccgtcttaccaagtagggtgcttccatccccctgccctctgccaccctccccccccccgaatttctaagagccctcatcgtgcagtacccctcctccacacctcgtcagtgctgcgtaaaggcccagtgggaggactgccccaggacgggtgcaggctcctgacgggggttgcagtttcttcctcctcaacccctcccactctcactttgcctggtgtgtagacttcttaacttaccagaacaaggaaggcccattgctttcaggaaagtgcctagaagggtcatgtcaccactcagaaaccccaggctctcttgctggggtggccctcgtgacttccttcctctctgccctcctctctgttcctccctctcatgggaagggcacagggcctgatgcaggaggtgtctgttgctcccaggccagctttgccgttcttgccctgtaagacagagatcttaggggtcatgcggagacacaggtgcttccctgtactcagtcttcctagcagaaaggctccagcaggctttctcggagggcgtaaatatttaatggtgttgtagttatatataatttgatcaatatgtcagtgttaagaggtcctttaaggaggcccatcctatcactaagcaatctgtgatgtaagccagcaccccctcccttccctctgcccccacaagcagcaagcatcatctcccaggctgctaaatgggtcatttatccctttcttagtcctcagcgggggtttgtagcatggagggaatggggcctgggaacaccaccctggcttttgttccttccttgttgctccctctcccctgattttctttcctttgttgatagataccacctgtcttaacccaaggagaaactgcctggccaagggcgccatcttattcagtaattgaggggctatcaatttagaattgcccaggaaataacaagggatatgtcaagtcaagattgcccagacattctggaatcttctaatacttgcttgctgggttgttatggagccctagttctgggaaggtaaaggccagagccgcttccgtctacacatagctactggccccaaactcttctctttttaattcacgatgaagcaggtttgctttagttaccccaagaactaagtaggtaaaacctgattgaaattgggggtgggaggctgtgatcccacagctgatttgatatctcacaggagtctagagaattaactggatatggagagacaggagtctgacactcctgagatcacagcggtaggctagactgagctgggttgggcgtcattggttctgtgtggctttgatgtgtacctcacactgcaggtaggcagctgtctgtcccttgtctttctcacatctatctggaaatgggtctctagactcatttgatgactgtccgtgacactgccctgatcctcacagaagaaacccttattttagagctgtaacctggaacttgggtgtgctgggcaggcagacatgctgctgctagtttaggtgaaggaatgtttctctgtgcactgagagatctgtacatacagtaggtactttgagatacatcgttactgcttgtatcagctgatgtcctgttgctgccacaaaacacctggccaaagcaacttagggggggggggatggggatgttttcatttggtaagatgcctgcactgccaacatgaggacctgaatttggattctagtctgctgaaatgcatctggactcttgttagcagagatggacagaggcaggctgaccaaccgcctgctgttcactggccagccagcccagccaaattgatgaggtcagagttcagtgagagaccctgtctcaaaagaaggtgtgaatgatcaaggaaagacacctctgagttgacctctggcctacatgtgcacacggcacatggacacaagcctacacacaaaacctgcatatcccatacacactttacataaagcaagttaagaaaggagagcactttctacttttcatgtgtaggttagggcccagctcgtgggatagcatgtctacatatagggtaactcagtctttctaccacctcagccccacccagagagtcttactggcatgccctgaggtttgtctcctgtcaggttgataattctggccaccatgtttctcttgcctgaggctctaggacagttgtatgcagtctaggtattgggcagattgaatggctcgtggaaagattggacttcaggacccagcccctagggagcaccacaggcttgcccactgtcccatcgctcatccagctgtcagggtgtgtcttggtacccatgtaggcatgtctgtggttctctgttttgcagagctgggtgaggaagtggggaattggaggtcacatagcaagtcaggctgttcagacgtgtgtggccgtctaaagtctgaatttggcccctgagaccaaaatgagctgcccggtgtgccccttcccttttccagggaatgggaaagaaagcctggagatgagaagtgtcttgcttaaactcggcggagacatctgggagaaggagctggctcatttcttctgtctttagagcttcgagtgctctttaacggggctggtttcttccccgcctcccttttggtcttgctgaggttaaaatgaaatgcgctctctcatcgtccccaggcacaggcgaccaggcagtttaaagctaactagcggtgagatggtctagtggagtgactgtcagagacactgtgtactgtgtcaagcatggtcagctaaaggaggcagataggccaaagactgactgggtgatgaagggcctgcagcagccactggttgctgggggtgagggctaaggcttgccgccatcctctcccttaacctcagggtcagggatagtctgaagctggagcagatcgctcgtacaggcagatgcgccatttcagggcattcacaaaccctcagcctttggcctgatgttgggagatcttgctttaatgaggagagggacgtgggaccggagctctgacaacacagggaacagagtgctctttgggaaatgtgtcccccccccccattttgtcttctgtcatttatttgcctaacaatctcagcagacgttcctcccaacacccagttggtatcacagatactgaatgtgtcaggactccggcccttcccagaaatcagtagcctggaacagcagtgtctttctaccagcaacactgccacccttgaactgtacttaaaaagcactttgaaaggccaaagcagcctccccagacacctttccccaggatgttcaaaggaagccatcctcccctcccaccacctctcaggtagacctgaaggccagggttacctgcagagaactgctccttgtgtcctcaggaggcggggaggatgggagccaggcttgcttaaccctggctgccacactggcaatgcatcgtgcctgagcgcctggagtttcctagtgcacgcattagctctagtgtggtgtgtgacctgtcttaattgttgaaatcacgcatctagattcttgtccccccccctccccccctccctttcttttttggagcgggtgctgagaggttgtttgagttggatcaaatgctgtttggacagctgttgcaatcagaaatgctgtcaatcattagcctcgacggtcgattttctttcaaaatcatttctctgagccgtctcaacctactgaagtttggcttcctggccggaagttatttagtggagtcgcttaatgggtgggtgtcagtttccctgtgtggaagatagactgttcgtaggcgccttcctgcaggctgtgagggctaacacacagagcgctggtggcagcgggcaaggtggatgtttctctgttactctttaaaagcctttatgtctgggtagctggttccccttcctcatgtaacacagtggttctcaaccttcctaacgctactgccctttaatacagttcctcatattgtggtgagccccaaccataaacttattttcattgctactttataactggaatttattactgttaagaattgtaatataagccaggctgtggtggctcatgcctttaaccccagaaaccctgctcgagaggcagaggcaggcagatctctgtgagttcaaggacagccagggctatatagagaaaccctgtcttgacaacagaaaaaccaaaaccaaccaaacaaacataatgaaaatacctgctatgttcccccaaaggggtagcaacctacagagtgagaaccactgctctaatacaacccccaagagattgtctggtaagtaattttcccattcatctctggactcagtggagtacacagcagcctgtgcacaaagatgggaacggctcagtccgtgctgtgtagacaggagagtaagagagatgtagttacaactcctgccaggagggagggcaggtaacagaaacaaaggccagcccaagcaagccccgagacagtgaagtccgctggttatagaagttctccagatgtagtgtgcaatcccccgcctcccaagtgcccttggtgacctgtcagaatcctttctgccaggcaggcctctctgtcatgcttgagcccagatgtcattaccatggacttctagaatgttcttcctgggagttgttctgacagttcctgtgctcagtagctctttgtggtgctggaaggtggattaagtagggagtgacggcttctccgaggtaccaggccttgacccgaacatggctacaaaatcaaagagaatcccttttcttagtgatagaggatgctgggctccggtaaggtgggagaagtttcctgtaggaaaccagtagtcacaagcttcctataggtcggtgaagtagaacacagtgccttttaattttctctaaccaccaagaccctgaccctcggcctgattagtagaggatgtaggctctgtctgaaacccttgagagctgtagtaggtcaactggctggcagggatcagagtctgccttctccttcctggctgtatgtgtggggaattgatagggcaaggagagatccagtgagctggcttgtgcttgccctgccttggcatagacattcaccctgtttaaagggcctaagccattgtccatccccacctcccttccagctgactgtcaacactttcccagcacagccctttccacagatgttatccacatagggaatcgtggccatacgtactgcaacatggagtctacatatacatgcacacaaacacagtggcgccgaggagatggctcagtcactaacacccttgctgtgtaagcatggggacctgagtctagaattccagtgcctatgcaaaagcccggcgtgtccatgggaacctacgacccaggactggggctcgcagagtcaggaggatcctaggagctcattggcttctcagtctagctgaaccagtgagctccagatttactagcagactctctctgtaaataagatggaaggtaaaagaggaaggcaccagatgtcagcctctggtctccacgtacacatgcacatatatgtgcgcacaggcagcatacgggcaccacacaggcaagagaaagaatgaatactagcagtgttattctttggctagatatttattgagcacgtagtgttttccagtcattgctactctgattgtttgaggcaagagaagcctgggccaggggtgcttcctcagcacctgggctgatgatccagccttggtgttttgccctttataggtcctgttcttagccatgcgttctctgccagttcctagtgagatgcaggcaggctcggtgatttcagagatctggtggagtacagctctcatccctgtgttccctcttctttattcattgtttgaacaagtgagaggggtccttgttttggggggtacacttacttcttcctgtttacctaggctaacttagactatacaaagtgatcctctaagagcccttacttagagcaagaatggccgacatccctgaaaaaggccagagtctctgtggttaagagtcttgcaatatatagaacagcccagcggaacaaacaatttgtgaccagtgaggttgagaaaccttggtgtgtgtcatctttgttgttgtctgccaccattgtgcaaatgtgggccccaccagctcttagctggaatgttacctgccctactctcagagagctttgagattggagaccatgctgatgcagatggtctggagtctgaggagcagtccctcacagtaaagaattgttttgctacgaaagcctggagaggtgcctgctgggtaacactgggcctgtttctgaggagacccagctgttccctcatggccctgacctacccaagaatttaccctgtactgggcaggtactctgggttgcatcatttggccccacaggatacagggctgcttaagcccatcaggctcccgtcagggcctgttctctccataaaaccagagacattctctttaatgcccagtggcctccagactcttacactggccccaggaattccccaaggccagagtgtgctggtgagacttcagagggcattgtttttatctgaggcacactagatttcgcatgcagagtcatctgacatgcagatgatcacaggtttttaaaaggctgttgtcatggttttgtcagaaagattgcctagctgatgaaagctttgaaggctgctctgagaccttcgtcctggctgctcagggttcagacaagataagaaagccaattccaagagttgtctgtctgcgtcccagtctttcctgctgggctcagttaaccatttagcagcactcttgatctgtgatctgagtcacgcgtggtcccactggaaattcttggtattttaaacatgggctttactgggaagctggggcgggcagagaagccgtctgatgctttgtgaccgcttgtatgaggatgcaggaaggggctggagagatggctcagtggttaaaagggtgtaggaaacctttgggttccattcttagactagaccctaaggatcgaacactcaccatactgcaggggttagaagcaaccgtcaaagtagaggacgagggccacatgccactgcatatgaggctggccctgggagagcccttccttcttggtgccctgggctctcttgcctttgacctctagtttggagcattagtgggcagcgcagttctctcagcactggatttgtttgtcacgggttttctggactgtggagaggtctttgttttgatatagtagggattctttctagaggatgcgagccattgacccgagtcccctgtgaaatgggagctttctaacacatggtcactggagcccatgtgtaaggggctgcagtgtgtgtgtgtgtgtgtgtgtgtgtgtgtgtgtgtgtgtgtgtgagagagagagagagagagagagagagagagagagagagagagagagaatgtctgtctttctgtctgtctcagtgtttcagtgacttgacttgtggtctcttttcctttgcagacagagattgcgaagagactgaacacaatcctagcccagatcatgccttttttgtcacaggaggtaaggccttcgtctctttcctcttctgcctagggcagcccagtgtggctgtttcctggggcccaagccccgccctagctactgtactgatctagccggtaggattcacaggccttctctgctgacctgggggcagggatctcatcaccgggaccacatgctccttttccagtaggagaatggttctctgccacacctgaggagggaggctgagccctgtgaccagtgtccttcatacacttcaccacgggcctcagctttccagggtacactcctatacctagttcaagtaaggctggttggttggtgccaaaggtcagaccctgtgtggggtgctgttccccaggtgctaagtgccctcgaaagtctcgtcactttctaagtaccccttgggagacagcccccttaccctccaagtggaggcaagggctggactcaggagcgttttgaggaaggtatctccaaagaggtgccagaggcgatgtgcagacctctggcccccatttctatcctgtctgatctcactccagcagggccagggcctaccctacatttatcccctaaggtggctcggatcatatcagctccctgctggagttctggatctgagatagcaacccaggactgactaaatacatctgagaattagatatggctcatgctatttgttagcttctgggagtgtataaaacttaacttttaataacagactttagtttttcaagggcaattttaggttcgttaggcaagcttgagtggaaagtacaaagtttccccatggcctctccacaccgggctggagtgactgttaaccaacgctcattgtgttcgaagactgaggctgtgttaggatttctttggtcgctctcactttctagttagacacttagctctctcttctggtagccatagatgcatgtttctgctcagccctttaaatctaaagcccacatgttctgtttaattcaccctagccaccatagcttcctgtcctgaaacatggtgtctgtcctatgtgattaccataatgcccagaaaagaaccactccagtatgtaatgcccgactaggttcttagtgcacagagctaaggttttcctgaatgtggagttgaggaggtcacgggccagtcttgggaactcatctctgccttccttagaaagtagtacttgctcgtttaaagactgatagagagtgtggcatcactaaacacccacatccctaagtcctgggcctgttgagcaggcctnnnnnnnnnnnnnnnnnnnngaagggtcctgagagactcctggtgccccgtgatggacagtattgaggaccttgatcatgcttcatttcccaacagcatcagcagcaagtggcgcaggctgtggaacgcgccaagcaggtcaccatgacggagttgaacgccatcatcggggtacgtggactccccaatctgcctctcaccgtgtgtatagcccttttattcctctcatttaccatgaccagagatgaactctgaccttaggcgctctcaaagaatggcagccccggggcccatggcatccctaggcaaccgagggcttagattcaccacattgtctcctggtcccaaactaaagaaatactagacacaccttgagtccacctgtaactttattagcttccatatccccagcataaggtactgaccagttcctggctggtgccccctctcctccctttcccactctggctgcccttctttggcctcctggggtcagaaccatctctgctgtttattgatgtgcaccgtgctgtacagttttggggttggggtcttgctgttccatgtgctgggctgcatggctgagcacccacacacatccttcagagtttcagctgtgtacctggatggaaccttctagaagccccacctcatcccccaacaagggagtactcatcctgcagtgctctgtagggccctcagtgaagagaaaggagagggtgggggcagttcatctttctaagccttccggctgtgggcgtggcctccggattgtcctcagagtgtgtggtcactgagttcttcagtaaaggcagttcagagggttccttctagtgttagtatctgtgggagctcctggagactggagggcttaagcctccattgattcttggtgttgagggtagagtaaacccagcctgtgtgggggaagggcaagaagcttggtgctgggaggcagcactctggggagagaaaccctgatattctaaagcttgaagtatctccggtgatcatccagctcagggttctctttaggaaatattttttttaatttgctttctgaaaattttgtcatacatacagtgtagtttgatcctatccacccctacacccactacccccttctgaaagagtattgttttacatttcttttattgaacttatgtgtggtcatatgtgttacagagcacatgtatgtgctggaaaaggatgatacatatgagccgttctctcctcccaccacgccggaccccataatcaaactcaaaatgtcaagcttggcgggaagtattttcacgttctgacccacctcagtgccctccccgccccattgtccacttttattctctgcttcttctgggtcccttcttcccccaagtctccctttcactgagtttatttagggtttcttgagaacaggggtgggacatgtgtgggacatttattggaacaaagagcctgacactgttgaaacttgggggtcagataattctttgttgccgtgtacagttttgtatattcagcagcagcaatcttgctctgtacctactgggtgtgaaagcaccctcccccatacacacacacacacacacacacacacacacaatctgtgcactccaaatgtctccagatgttgcctgtatctgcatgggcacagggctctccggttgagtaccactggtttagtctgataccagtatttcacagagattagcagtcaggccggcctgagagcatccctgagcatagccggtgtcctacagtggcggtgtagggagttagaagggggcctgagccccaggttgtcttcagaagtctttctcatctgcttcttgtcttcagggcaagttcttccaccaagctgcaggggctacagcctggtcccacctcttactctttggaattaaaatccacatgtgaaaatactttttttctttttctttttgaaggaaaaagtaaaatcgggcagcagcgcagctggattggctccagctcctttaagtagcgtttaggaagctacaagttaggtcaaggcggccctaggcagatattggaattcaattaaagcccacgagtggggcctgtgacccccattttcaaggtaattgcttctcaggctctgagtgaatgcggccgtcgccctgtcattaggcaggcagccgtctaatcgctgcgcgcctgacagagcctcacaaggcaggaattgctgacagctggggcacccagactggggagctgtgcttgactgccctccagcgaggggccttgttccttttcttctggaggcgagaggggagccaccctgctgagataagggcacaggcaggggcagtgctccagtcttgattttctcagatagaaaggtttctagtggcacatctgctccagttggctgatcgtggcctcctgacacagggctggagtctggggtctccatttagctgggctgctagcaatatgaggagtgtggatgtaaccagaagcatgtcacggggttgaaatattgtgggagaacagaaggataggtgaaaggacctgggctgctggccatccctgtcccctagttcccagtttgtccttagggaactcatgtccctttgggtaagataggcctagagatggtgttcctttttagaacttagctttgtacatacaggattgtgtggtggcctgggaggtggtggactcttggctccttggtctgggttgcctggagaattatttagtgggtggtatgtgcagtgttgacttggtggttttcttaagaggggagaagagacgggaggagggaggttggagttggaatttgtcccagactgtgcagagatctgtgaagcgctctcagggcttcctgtcttctgccgggtgatggctgagcaggatggctggctggacaggagttgggcggtagaattttagaagggatagaagggtggatggctctgccttagtgcctgtttccttagaaactgaggggaagtaggggattgctgagttgggatcctggcttaggtttctgttgtttggtgtagttacttggcccctggggctgtcccatctctgaagtagggatagcaaagatcatggtgacctctaaaaactgctgccaaacccagaggccaatgctgcaaagggagccttgggtatacctactgggctgtgtggaagactgggaggtcgagttacctgacttcccaggaccctgtctactccctctcatgcagctagctgttggcctgtttgactctagaattgaagcagttagacaactcccctaagtttgacccaaattacgaacctaagaaccgaagcatctaatcagccagcagaggcatgaagcatgaggtgtgtaatcccgttacacacgctcctccagcaagctctcccatcagcctctgctgtgggccattcctgccagtaccagaccgtgcgcactgggcactcagggatggagggcccaggaaaccccacggggccatgatgtgtttgtgtttggttatgaaatggccaaggatggagagatgatgttcaggagtgtgctcggttgtgggtttctcagccctgcccgctgcgggttaaggccaagagggagaatcactgaacttcccttcttctcatacatggagaagagccagtgttaggagggacagtaaaaggtggaggcaggtggcctcggactgtggtattgtgacatttctctgccattgagaaagctttccagttgagagcagtgtggccctcccactcagactaaacggtttgggtaccttgctctctgaagccaccagaggacagaaacacggcccgagtgtgactgcatcccgcttgcctgctgaaggaggtgacacaggccatgctccttcctacctacctgtgaatcacttcattgccagctgctcctggccccatcagggagagcatttggcttcgctccgaattgctgccaagaccatcgctggcagaacctccatccagaggggcagtggcatccagatgcatccgttcttaccttttgaagaatttacagcttaggtcttccatcagtctgtctgcagtcttccgggctggcccccgtggtaccctcagaccaccccaaggagacgaaggcagtgagtgttttctggcagtgcagagccaggtgctttgcttgaagatgagaaacgtccattttgcatggaagcttccttgcctcttgcagaggatacagaccctgaggagcactgtgatagtgttggaaactagtcatgttgtgtcgctgccgcccccgcccttgtcacaagtttctgctgtggatttactagtggatatttggggaaaacaggacacttatctacaccattgaccctgctgctccaactgcctctaactaactgggcctccagggctgtgttgccacctttggatcaagctctctgctcctcgtttttccacttacctgctgctaaccttctccagcgtttcacttactcactaagtgtgggtacagggatgagcccggacttgttggaggccctggatgggtaacgcaatggctctgtcttactgcaactcagcagttgctcaacgacaatggcgatgatgatgcccatttgccgaggaggcttgcactcggactttgcttttacatggaataatgtgagttctgcacagcccaagggtgagcctcattttgatatccagttttgcagataaggatacgggcccagagaggtcgggtgacttgtccagagtctcagcgctgataaaggagaagctgaaagtcctcatctccagcagctttgcctgcttccagagtctgggttcttgaaactgggaaaggaaatttccttctgaccagaagagtggaaagggaatctgtttgaactggacagagtgggcagggtgggagaggagacccacacacagtctcacatgtctgcagccaacaacaccctccacgcactcttttgtctccttaaagcatcttgacttaccagttcctctgtaccatacagtgcagattaagtacccaggtccttactttctgggcttttattaagtaattatcaccagcagacttgaaagggcttcccagcaaggagtttaaaaacaacagggcccagtggagattctttgtaacataatgtctagataaagctgtggggtccagccatgccatggaatactaaatactcattcaaaagagaagtgtttttcccccttcagaacaccttttaaaccgggtcatataacaacagtgtggacaacaagagctcatttgtagaaaactgcatggaaaaactgtagatctgaaaatctagattctagatggcctgacagccggcggcgtcctgcgaggtggaatgaatgggggaacttaaaaagaacaaaatttaaaactttaaaaaaaaatattcttacagtgagcctgtgttatttttgtaataggatgttaaaaattcatttttaaaaaagggaaagtgggggagctgtgtttatctcccatcggagaggaatccaatcttagctgagaggactggaggtcccgtggttctgctctgaaaggtcccttagcttaggtgtgctgtgacacagggagaaccacagtcacatcgctaagatctgtggccaccaaaagcttgcacaggtgcctagaaggagggcttggggtgtcatttcaggtcctctgtggtccagggcaatggccgtgggtgccaactttacagatagagctaagagacggagcctcgggagccagaggtgtaagactgccagaagagccttaacttggagggagagctagctaggtcagcagtctgcagctccgttcattgaggggaatgtgggcagctttttcatccttggccagatctctgtaggcattccccaggtgccgttgaccttgagagctgcttgctctttcacagtgatgggcacgagctccgtcagcctatggctatcctttcttggcttattacatctttgcactcaccttttccctcttgctttgagcattctgtagatgatgctagtggttgacagataagagtccagatcccatttagagtaatggagcttgggctgcccattccagtgcctctctatcagttggctgtctgtaaaatgggcacactcactgttgcctgtcagagttacgggttttatttggatagtatccaggagtttatatgcacatacaggtggtattggtccctttctcttgggggctagtctggaagaaaactgtgtgcacaaatggggacaagcatacccagtgccccagccagtcccaagaaatacttccatccctgagaaatagttgataccatatagcctgccctacaatgccagtggttgttggcaatcttatgaataacagggcattctgtcttggctgctggggaagcatggaggcctctgagctaggaactcgggcacgggagcagaatctggtggggagccttgacgttagcaatgggaagaggtgccaggcagcaggttcctgggttggtttggggaggaatagaaggatggatgttgctctgtgcctgggagtactgaggtcgttagaacagtgggagatccctgtgagagccctgtagaaatgccagtgactgccacgaagcccattgagcggtggctgtgtgcccaagcccacataccttactgtagtcacctgccgtgggtgctgcctctccccttatgcagataaggaaatttatggcttagagggtttggaagtccctgtcccaggcatacagaatcagactagaatcctgctctgtctggtttcggaggttcagctcttcccagctctgtgttctctctactctgagggccaagggcatcagcgttgattccaccagtcctgggacttctctgctctggcctgccctgtcccgactctacaagccaggcttcgttctgcttctttagaagcccagtcagggaggctttccccaggttccagctttgggtgggaggctctggctgctgatgttaaaggcatgtacgcatgagctatgagcttaaaaatggattcctctctattgaaaggaagccctagtgaccgtgtgggttttaaatgcatgcattatttatcttgggattggaaacaggcatgggaaactctgtcctgttgctggggtgggggtggggatgatgtttgaagacatcagtccaccacgctgcagtccattaacagattttgttgagcaagatgagcatgtggtcgagggggaaggttggaggggggtgttttccctgtctgtcgcttcctgatggaggagcgaggggaggggcagaggtgacctaccctctgcccttcccggcctgtcttggcttaccaccaacttcattacagcagcagcaactccaggcccagcacctctcccatgccacgcatggtcccccggtccagctgccaccccacccgtcaggcctccagcctcctgggattcccccagtgacaggaagcagctctgggttgctggcacttggtgccctgggaagtcaagctcacttggcggtgaaggatgagaagaaccaccatgaactggatcacagaggtgtggctctggctgggctgggctgggctgggctgggtgggctggagctggagggcacactgtaaatggatgcgacaagtactgtcacctgaagcctggtgttagctaagacttggagccgtctgttgagtccagtgcatggacatgctgcagttcctgatgtagaccccggtgacagtctgtttatctacagtagccccccatattcccaataacaccctgcctagtttttagggccagccctgcatgcccttcagggtgctttcgtgattgcactgggtgcctttcttaaaagagcttgagttggggcctcgttgtagccttctgttgctatctttctggatctctgagtctcctcactgggaaaccttccaagaggcagcactgctgggggtgttgctcagttggtaagaatatttgccaagcatgcccgaaccctgagttcatcccttggcaccatataaaacaggggtggtagtgcctgccggtaagtccagcactgggagatagaggcagaaagggagaaagttcatggtaattctcatctgtgtagtgagttcaaggctggcccagggtatttgagaccctgactcagactagtggaccatctgtaagtgtagggtctcaggaatacgccaacagagaagtaactagagagacgaggaatgggaactcttgccccagccccctgaatagcaccactggggctcaggaggatatcagagggaacaaggacctggcctcatgcagcctctttgtaacgctgccagcttgtacttttggttggcttttaggtatttactgggccacatagtcaatatcttccaagctcccaggggctttcggggaggagtcgccatccaagccttagtccgtgctgtatcctaggagccagtggccaactgttttgttccttcttgacagaggggagaggacaatgagagctgctgattagctggactggtgtgaccagaggcctatgcttctgggggctttttggcaaaggaacagagaatggtgttaagaaagcaaaccagtagaagtcagttccaaattgcaatttttaaaaaaaaaaaaaaaagcaataaccttcccagctctcatgtacgattctagaaagtacggcgaaaagcaaaccaagattcttttgacacaccaggaagaaggctaatggcctggattctaggccatgctgggcactggtgggagggggcaccattaagatgccatatacggggcgtgccttcactgcactcagggaagtagagtcaggctaaccagtgagaggtggctttgataaaccacaaaggtcaactgtgatttattaaagtgaccttgttttttttcccttgtttttccttgtgggtcctgaccctcctcctttcctggccttcctgcctctcagagagagagtccagcacggtaagtgaaggtgcttttggtgtagggatggggtgcgggaggaagatgggcctgcctagaggcctgttcctagaattacaggcctggcaagtagcctgtgctacccacagctaaccccagtttcccgttctgctctgtgggtggaagctggggtttttatttatcatttgtttatgtgtgcccacagctagaagacctggcttcaggactggtatgtgggtgacggtgtctctacccatattcagtactaggggtagttactgtctatcataatataggagttgctgtcctctgttgagtgacctttaattagggaagctgtttaactctaggcacttgcctgagtgacctccaaagccccccttacaaagagacatggtcaactgaagccattagcccaccaacctacatcttccaaggggctctttggagtcactggcctgagccctgcgttcccgatgctgcctaggttgatgatggttcatcagccccgtaggctggatgcctacttccggcataatcccgagccctcctttctccagatgcccaaggtttctccctgctctgcactttgactctgttgaaaaaagtgctagctagcaggtattaaggccaggccgcctgcgtgtctgccagctcagagatttgctgtaaatctttctgatcacaccgaggctccaaggttctgtttcaagtgaataagccctctgaataagcacactggagtctggataaaaaaaaaaaatcctccagcgattagcagagctattttattcttcatcgcagagcttgtatccgggaccatcttaatctgctaggatggctctccttattacctcatgttaagtagggcttggaatgtcaggcctttaactagccgtccaggcagcagcctcctcgggaagctctctctgcttgacccgccttcctttccaatccctccctccatccagactgttctcatacctccctcccattagctgtctcttcttgccctgcctgcctgcctgctcagaaatccaggccccgcccgcccccttgggctcaggaatggctaggcacagaagaaaggattgattaaagctcaagtccattttgattgctttggtgttgatccttaaacagtggcatacttttggagaggcagtttccctacatagaagctggactaggtatgtccacctgcgttgtctcccaaccccacccccaacctccacccctccccagcttcaatccaatctcagccttatgaggtcttgtgtcttgaccttggagcccctgtctcctcctgcatgtcatggggattaccctgccagacggcctctcagctttggataggcagaccccctgtagcagggctcattacttggttagcaggaggccttccccaggaagtgggcattgaagcccattacctacttcttcatacctattcgcttttggctttgtgcccttgctgaaagctttctgccagaaacccagagggacccccaagtgtgcagcccccccccaataatgctcctggcatccaagctaggctgactcaacatgggagctggggaatgaacagggatgaatcccatgacatcctagggctgggcagctcagggagggcaccagtgggggatggggagtactctgggggctgcatcctcagggccatggtgttggatggtggagattgaaataatcagccttaggaaaacagcttgtcaacagtcaaggcctccggcaggaaggacaaggctgtgtcagagaggggagggggccgggtggacaggctggaagctgtcccagaggggttagtctggagtccaattagaggtagcttcattcatatttccttgcctagctgaagcaataaaaaatacttagttttttggccgcctgccaaccagaggcgggctggatcgatgccgctaaatgcctgacatgactctccggtagcggcgagggttttcagcctgactgcatgagaagaaagagttccctgttctcgcactgggtcgcaaggagaaacacgagcagccaccccgtcccctccctcctctccatcacccgcctgcgcaggggcagccagcctgaggggctggaagcatttctgcttagcacggggtggccgccaccatcggaggaaatgaaatgaaatgacggtgatttttttttctgcctgtgcttgcagcaactaattgaattgcggctgtgagcgcatcgccgccgctcgcccggctgcggggaaggttgagctgcagttccattataacctccattttttttcttcaaggcttgataactctgccattttaatttgcttcaggcagaaacttggcagggaagggctgcccagaaaaccggcttaggaaaggaaattaagttctgcggctggctccctcccacaccattcccccaaacccatccacctgctggccaccccgcctcgttccttgccagtgaaccccatccctgggccagcattggcctctagtaaaatggggaaaggagacaagaagggttaccgtacctgcctttagtgtccctctttgtaagcacatcgtcttgctctggagtcccacacgactccagcatgcatctttagcctgtgtggactccagcatgcgtctttagcctgtgtggactccagcatacatctttagcatgtgtggacttgtggccactcttatccctgtagttagaccggggttctctgactcatcctatcactcctgacattaatgtcagtctgaacaagggtaggtttatcagtacttttcttatcactaggataagataactggatcgaggaaggattatttggctcatggtttgagggtgtacagtccgttatggtcacattgtgacttggaggaagcaggagtgtggggtgactggttacatcctagccacagttaggaagaagctggcctgtatcagaactcccctataatcccctgtggccctgtgtctgccagccagaatccatgtccagaaggttccaaggacaacccctccccccaatcagctgggaccccttagcctgtggagcacttcacattcaaacagtggtgcttgaggtaagccattgagttcactgagggggcgctaggccttcaaggtttgcagattagcccttgccagaggttccccctccctgtgcacagccacaggacaccctgcttccagccttccctgctgctcacctgcctcagatcttctctttctcaggcttgtcatccctagggattcccctccctccccctggagcagaggaagaactgagaaaactcccagtgctctctccccagcatgaaacctacagtcctctgctgggagaccttagcttgctctcttgggacacttgtccccaccctaagggaaaggcttagtggccttgcaggctttgtgcctttgtgacactggcttgtcttccgtttgtgggaggattggcagtggaggagcccgggctcagggttgttcatctctgcttagggctttatctgcagctcagcaccttttctcattcgctgcccaacttaaaatggaagttcttcatgtatgctcatctatggctcaggtctgacttgaaaagacacatctttccttgaagtaaatagagtgacgggtgcccctcaccctcttgggaccttgcctcaggccaggaaacagaaatagcagtaccttgcttctaaaaattgatatcttgggtaagttcccagggacccaaggtgtcctgggaacgtcgtgggtgaaccacatctgcagacacagggtatctgcccacctccgtcttctggccctctgtcatccgcttactcgaatgtaatattgcctgtgtgcagtattatacaatcagcatggaggtttgaccccagggtcctcttcttccagaacaattccgtgtcaccctctgaaagcctccgggccagtgagaagcaccggggctctgcagactacagcatggaagccaagaagcggaaggcggaagagaaagacagcctcagcagatacgtacgtaggggtcggcgaagtggcttcgccgggtagggttgtgacctccctttggcctcgactctggcagttgagttctgagtctgagaggctggtagttgtgtcagggcccagagagagggagaggtttatacatactctgtggtcaggtgagccattgggagagaaatggacaggggcattacccaagcctacatgcagtcttaggagagatgaaggtcctagacacctctctgctgcaccccatgctccaagggagtgtcctggggtactccaattgtgagccccaccgtctacacagtccaccccaggcatccagccacggagacacagtttgtaacaacctgatggcgtgaccttaacctgtgagataacagtgggatcacggttacatgtcctccattgccagactgaacaggggtgagatttgagtctagaggaggggctactgccaagccatctttgtcccatctggctgccctgtggctctgatcatgttacacagagctcagttgtgctacagagtgaagccagtcacctgccccaaagtgatggggggaaggagatgctggctttcaaaggctcaggactatcgtaatgaggctgcttagacacgtcagagccccagaggctgcactacaaagaactgggaggaaggaattccaaggctgctcatagagggcaggggacccagcagccgagaagcatgagctttggggtttggttggggaagttgttggggtgcattgttaggcttgggcagatcaggggtccacatgctcttactggcttctctcttgcttataggatagcgatggggacaagagtgacgacctggtggtggatgtctctaatgaggtaagggcaggccccagttgcaggtggggtgatttgggacagatcctctgtaataaggtctcttctgcctgctgctggagccgggcagtggtgcatcaggggaagcagggagacaagtagcttcatgtgtgggaactgaaaggaagcagcagtcttcgtgtcccatagttgtctagggtggccctatcttccctctccagggttgggggagtatgctttcctggagagaatttcccataaagccctgtgaaccttgctggttagcattctggacttgtatgtgacctgggggaggtcaccccacctgtgaggtagagggctcagggtctagattgttcagagctaatcccctcccacccgtgcccattaccttcctgttgctagggcagggatacctgctttcagcttaaaagctctgttacacttgtcctttcaggacccagcaacaccccgggtgagcccagcacactcccctcctgaaaatgggctggacaaagcccgtggtctgaagaaagatgcccccaccagcccagcctccgtggcttcctccagcagcacaccttcctccaagaccaaagaccttggtcatgtatgtgggggtctgtcctggcaccttacagagctgggggaggggagagacaggaggcatgcttgcagaggctagagctccagtcctgctgcctgcagggtgggaattgggtgtggaaagaacgtggctattaggattggctgtgctttaatcattaacccacactagtgaatgttttggagccttggtttctgcatctttaaattagaaactttaccacggtccctgccagctagagacttctgttcaacccatgcttggcttcatgtgggaccagggctaggcattttgcccaactcttgggagaaaggaatcctcatggcgtcttgtggtctctgtgtgtcttcccttctcagaatgacaaatcttccacacctgggctcaagtccaacacaccaacgccaagaaatgatgccccaactccaggcaccagcaccaccccggggctccggtcaatgccgggcaaacctccaggcatggacccgataggtataatgggtaggcacaatgggacccgggtcaatctgatgggggaggggaggttggtccctggctagatagagccaaacagatggccagcaacatagggtgtccaagctggggcttcacaggtctgcctggtgatctttcttgtcaggtttaaggatatggaagcctgcacctttgacattgatatattagggtttttgagggtctttagcattgctatgtcagagtctacgaggcctctgctgggctaagtgtgaggaaagagcatctaacaggttgttaccttagatctgtgttcactgtctgttaatggttttgtgagctcctgagcaggccctcttctttgggccgtgggctgcccttggaaaagacatgactccaatcttggcctcagaagtcaggggtccagttgggtagcttcagatcgtaagagggctatggcctcagctttgtctatcagaagggtgagcccactctcacggatgcctcctccccactcatcccacttcctcattcacatcctcacagcctcggccctgcgaacacccatcaccctcaccagctcctatccagcaccctttgccatgatgagccaccacgagatgaatggctccctcaccagcccaagcgcctatgctggcctacacaacatcccatcccagatgagcgccgccgcagccgctgcagccgccgcctatggccgatcgccaatggtgagctttggagctgtacgtagaccttttggctccttttggtgggggcggggattgggtagggagtgggagctggcagggttagtatagtacatatccccgcatgctgaggggatcctcggttgttgtcttaaggtgtctattgctgcgatgaaacaccatgaccaaaagcaagttggagaggaaaaggtttagctcactcagttccatagaacagtttatccccaaagcagtgagggcaggaactcaggcagggcaggcacttgaaggcaggagatgatgcagaggccatggaggagtgctgcttactggattgctctcatggctttgctcagcctgcttccttatggaacccaggaccatcagcccaaggatgctaccacccataataggctgagccctcctctacccatcactaattaagaaaatgccctacaattggatcttctggagacattttctcaattgaggttccctcctttctgatgactctagcttgtgtcaggttgacataaaactagccaggatatctgtggacacctgacagctgctctgggaagagcacctgtttagagagagtttccttatggggtgtcagacctgcctgtcagtctcgggtgacttaaggtaactcttagaccgccctctctcatctgagacctctggataatagcctgaaaggggataagggtcccagtaagagcttagtgacatctggtcaggtaacagggttttgggaggtgggcctggtggtgacaaacagaattaaggctggcagaggggactcatttttcaggacagtttttctctactcttctatacttggggtggccccactccacaggcttacagcacactcaggaaggagagaggtggggcagggcctactctgtctggcagtgccgaggggatacaggctgaggtggggtttaccattgccatcctgtctgttactgtcctgagaggacacttggccatcctggcatctgccttctctgacacaggctccgctcagcagtgctgtctgtcacttagttctggagaagtcacagggtgcagcaggcctagaggacagtggccatggggaacagggtgaggctatgtgatgacagattgactgagccactctcctttctttataggttggttttgaccctcaccccccaatgagggccacaggcctgccttccagtctcgcctccattcctggagggaaaccgtaagcacttggctattctttttgcatgcttcacggggtagacaggtaaaacactcctgtccatcccctgagcacagggtcttgctggatacaatgtcctctaaaaggtatctgtccctcctgagacacaaaggcatggtcaccacccaaggtaagtcagtcccagaaaccccctccatcaggggaacttagggactctgaggtccaagttgatggctctgggagggtcagaatgcttgtaagcagagtacagagaacaatgtgggccctggggattccttcaggttccacctgttgcaaaggccacagcccctaccctgcctctagttcccctgctcttcaatggagcacagtattgccctgatctttgtctgcatggcttattgggaaattaaagtttgaactatgtgtaccacatagaaacctgctctgtactgtaatagatctcatgccaccatggccacggagaagggcactcacagtaatgtggacagacaaagctgagtctctgtggctcagatccccttgtcgtttttgcctttagaggggcaggaaggtgctccgtccctagtatcactgacttcagatgcaggtcgtggcatttggtagggtcctttcccagattggcatgtctggagactttataatctcaagtgtgtgtggatggggtggtatggggggtgggggcattccacaacattccatggagcacctaagctgatttggagcaaggatgtatggactaataagtaggttccaacctgatggagccatcccagtaccaaggggctcctggacttaagggatttggaggagaggggcttggggtcagggcagtaagtcacagtgtgtatacattgatttggatggggcctgtgggacatgttaggtgtagacagcaggagtgacccacctccttcttgcagggcatactccttccatgtgagtgctgatgggcagatgcaacctgtgcccttcccccatgatgcactagcaggccctggcattcccaggcatgcccggcagatcaatacgctcagccatggagaggtggtatgtgctgtgaccatcagcaaccccacacgacacgtctacacaggcggcaagggctgtgtgaagatatgggacatcagccagccgggcagcaagagtcccatctcccagctggactgcctggtgagtcgctagggccacacaaacttattctgtagcatgtaggaggtagaggaaaacaggacagacacacccagggcgggaagggccaggctctgctctgagcagctctgggtatgttgactaacctctctggccctagttggggcatctgcgaatggagatgactcttaggctccagattctagagaaaagcatgagaaattggatgggtgtagaattgagagtggagaagtctccaggagcttagacactttataaggatgttaagttacctaaggtggctttcttgatccatgacaaagcaagtggatagcacttaactctgcccttcttcttccagaacagggacaactacatccgctcgtgcaagcttctccccgatgggcgcannnnnnnnnnnnnnnnnnnnctcaccatctggggacctggcctcacccacaccccgcatcaaggctgagctgacgtcctctgctccagcctgttatgccctggccatcagtcctgatgccaaagtctgtttttcctgctgcagcgacgggaacattgcggtttgggatctgcacaaccagaccctggtcaggtgagtgaggttggcaagggaacacctaggctgttcatactcacccagcccatgatgttggtccttttggagaagtaaagggtggtcaggtacagaggcaaagggcagctcatggagggccccttcagcctaggagcttgggggaagatgtggtggaaggcagagctttgaacagttctgggaaagcagctcgaggagtggagatagcagagagtggagaaatgcagcatcgcttaatggtgaggcccaggtggagcagagcagctgagctttgtgtgtcctgtctctgagatgtcctgtgtagcttgactgggttctgtgtgacctgggtggtgtggtgtcttcctctgagtcacactacctgtgtgatggtggacggcagttcctgcccgaagtcacatcctagtgttaccatgacacccttgggcatgttttgggccatagccttatagatgagttaacttaaatagggacagcaaagactgggttgaggagtgtgtcccaaaggcaggtcctaaacatgatagaaaatcccttagaatctttcctgccttcgtctccattaccttctttagagcagagtgggctccccaggggtcccacctagatacattgaatcagacagaggtcttttctcagggaaactgtccttggtagcacccctgagtggactagcagaggcctggtctagctcggcttcctgttggctaaggttttgagacacgtgatccagtgttttgtacttccagtttccttctagcttggctgcgtagctggcccagtccttgggatgattgcagtctctggggctcacccttcttccttgcttggccttcataggcagttccagggccacacagatggggccagctgtatagacatctctcatgatggcactaagctgtggaccgggggcctggacaacaccgtgcgctcctgggacctacgtgaaggacggcagttacagcaacacgatttcacctcccaggtgtgtaacccaagcactgtgtgcttcctcttgggccccagcagctgtcaggggacagagtgaccacacagggtcatgattgactgccaagggaccagcccgagccaatccgggaaggttgcttgtaagcagcagcagtggtgtagactgggcatgcatgccctcagaaatgggcacacacccaactcattctaagtccacagcttgctccctgtgctctgcagtttgcgcatgctccctcccagctctggggtgggcacctgactcaagcctcctgtgaacctcgcccatgagccatgatatttcttgcttgttagacttgcttcatccttttaacagtcagtaccataatgtggagtatagtcgttgccagtttcttagggagtgagctgagcatagctttcagggcctgggaattgcagcccctcctgctcaacctccaaagccagcttcctcaatgggatacaaatgacatcctggggtggcgggtaggggcaacagacagctggttagcggatttgtttgtaagtggtgagggaggagggaggaggctctaaccctacccaaggggctgctccagccctgcgggtagagggacactgaactgtctgtccttgcagatcttctccctgggttactgccccactggggagtggctggccgtgggcatggagagcagcaatgtggaggtcctgcaccacactaagcccgacaaataccagctgcacctgcacgagagctgcgtgctgtccctcaagttcgcctattgtggtaagccctgaagccctagcctggcatgagagccagcatggggagcctggtccagtagacagtggggaagtaggggacccacagtcttgagtcagccaagcttatgctcctttaatgtcctggaggagaaaagtaccttccttgtcccccacccttgtcttagatatggatgtcactccaggacactaaactctcaggacagtaggctttccatgttgacctggatcttctctgaaggttacacatggtgccaactcttagcctcagagaaactgtctgggaagagtacgtggctgtgggggatgttaggagccacagctaggagcgctcttggaggaacgtcctctctgactattggtctttggctgtttctggtgctctctccaccttctggtcatagactgggaaggactagctgactttagtggctttggcagggatctttttgggaaacatgctcaacacagttaattgcattttgttctgttctggctctccctctgggcagcaggggaaggcatcctctaggtatctgtgtgccatgcttgtaactgctcttcaggagtggagaacagcaaacactaaaaccgtggtcaagcatgtctgaggatgtttccacgcggggcagacacagctgggttgggtcctgctgcacaaggcagcgagccacagtctgagggctcctttgcttgccttgcaggcaagtggtttgtgagcactgggaaagacaaccttctcaatgcctggaggacgccttatggagccagcatcttccaggtacactcctgattttcctccccactcctcccgagtcgggatgcggccacagcagttgggctgagggtagccggaggcaggacaggaggagtctggagctaggagcagacctactaacccctacccccactagcccttactagatggcggaccccagagggaaggatgtgaggaccagataaagacacaccctctgttgctaaaggcttgtgaatccttgagggtaagagcatctaggaagggactcactcatgtggcacctggtgcgtaaaatagtgagcttggctggctctgggcagctgggcccgtggagtagccatttcacccactgacacccattgaggtcaggatggccaccctaagccatcagtgtgatgagggggctagaatggacatgcgtttctacagatttaaagatctagagcctctccatttcagacacactcaatcctctctccctggtgcaacttataatcacttttttcttacaaccactcttgctcttacacacacacacacacacacacacacacacacacactcttcagcttcctgtgccacgtgtgtcccttggaaagtctctagttttgttgagggcctgcaaacccaggaccagtctttccagctggcctggctgaatgaagggtctgtctcttgcggctgtggctctgaagcgctccttcccatcagtaaacttagcagagatgcttatgctaagtgtcctgttctcatccttaaacctggggaagatcctactacagccagctcaggaggtgttccagatgaagaggcaggaggaagggactccaagccgcagaggaagtgggcctctttctaccagcacctgctcagcctgagccggagagtaggatgcgatttcgttcagagccctgaagtgccagggagaattcctgtctgttttctccccacactaaatgtcttcctgtttctccatgtcttcctcccccagtcaaaagaatcctcatctgtcttgagctgtgacatttcagcggatgacaaatatattgtaacaggctctggtgacaagaaggccacagtttacgaggtcatctactgaacaaggactctaacaggcctgtcaaactctgggagagacacccacgtggccctgacagggagatgctggccaggccccgaggacggcagaaggagggagcagcattgtggggctgccctccagaaggtggagaggacgcacgccccttcgtggattgatgtgtctgacagacttgaaggactttctcctctccccctaaccagtgctggcagatgcttcaattagatttctctggaggcttctgcttccgtttctcccacagacatcctcataagtctctgtctcttcctcccttctctgacctgtccccgccccactctgggatggggggcggggagatgcaggagtagacattgttgtttctggggaggggcgcctcgttctgattgtgcagtgcacaaggtttgtgaacagtgtaaataagagactggttgctgactggccagtgagggaggaaccccatcccaccattgctcgccgtggattttgcctgctgtatttgtaacccactcatggtggtggcttttctttcttttcttttctttttttttcctttcttaaatttttttttaccagctgttctgtggggaaaggaaacagagataagagagttggggagccgagtgaggagcttcctggggatggacaagccatcctggcgcactgggactgaagtatatctccacacgggttttagcgccatgtttagatagaatgataggcagatggacagacaagatgatggacagtactgggatgggccagcctgggctattacccacaggaacagcgaggattttctgtgggttgctctgccccatctgtctcttgccttgcccacacacctgacctccatctctttctgtcccctgccttccccaccccaccccaccccgcccccatctttctctttggtgcacactcaatcattgtgatgaggaatggaagttctagggaaccccctctctgactctcctccagcgcagcctagaaaggattccatatgggggtgggggtaggggggagatgaagcgactcagctcagggagctaccagagaaaaacagcaactggtgtgggtgcttttttttttttaatttgaataaaaataattagaagtgatctcctttgataagataccgtctcccctttcctgctctcagccctttctgctccctgaagcggggaaatggtgacccccccccccaccagtctgagaagatgggcgggacagcgggctgggggctggggcagcagtcatctgcagatatcaccccctagagtaccaatgtttgtggtattaggtttgccttgttttgttttggtcttttgttgttttattaaagaaaagctaaagaccgtgtgagccctgctggtgggctctccatggatgtagcatatggaagagagtttttatattgcatttttatggattattttataatgtgggactccgtctgggaaggaagatgagggtgtctaaaaccttcccatctccagagctccagctgagcggctgcccggaacaggatgtatgttgggacatggaaagaccgtggcaccctgcgccttcctgagaggcatgtcgtcgtgcctgtctagagtctgtccatctgtctctgggtttcagatggtcactggccaccacttgttaaggctctagccagaagggagggttagggtggaagagagttattcctgaagaaaaaagaaaaattgaaaagtcattgtaatgaagctttttatatttttaaaagttactatttaaaaaggttggtttgattgttgtgttttaattgccttttttccctccagtgtctcagtcatgcctgggaaagtggggtccatggttggtccagttgcattctggaacctgggaagcatctcaccagaaagtcctcctcccttttccctcctccctcctccctcctccctcctcccaccccatcaaaagtctgtaagggctgttgggctttttctagtccagagcatactacaccactgcctttggtctatgcaccaggcagaagtagactgggaacccctggctaagatgggtctcatgggcagcaccatgctcatatatggctgtccacggaagctatttgagcaaaattaggaaatttcaagtgaatatcatgtaagtagttcaagtaagcgtcatggtcctcgggacccagaaagtctgcattttttttcttgtaagcttcattgatgtagatgtgacgggagatgttaagcctggatcacagaagtgtacttttaaacgctgagcaaggcagaccacgggcaaggccaggtgaatgatcccaagaaggctggaaaagcagaaaagactgaaaagtagtttcctggccttcgtatacctacccatcgctgaaataagcctctcagaggaccaggattttaatggtgctccacttgttaatgtatcaaggtcactgtcggtcacaccggtaacctgctgtcccttcatggaaggagagtgccagcaaacaagggagggtcccagaatgaagcagtctaggcctggatagaactgctgtccacctggatcttgacagaagggctgcagggaggagccagcctgaggctgtgcactgtgacagcgccatcctgaccagcatgccctccagaccactctcttctccacccaggatagagcaaggagccagggacaacttggagctggttggagttggtccttgtgggtgggggaggggacagaaggccactggtaactcccaatagtttctgacagctcaaatacctggagctatctggtcagggccccagagagaaggtgactctccagccaccatatttgcttcccagatacccccatctccagatgattgttttcaaaggctcaaaagtatggcagggctaaagggtctcttcacaaggggttataaaataaccactatccccaaatgatgggaatatagaataggaacttggaaaacattttttagtactaacaatataaaatattctacatgcccccaaaaacaacaacaaaaaacaaccaggaagaggttcaggtataatggcatatgcctgaaattgcagcacttagaatggaatggtaagtggatctctgagttcaaggccagcctggtctactgagtgagcatattctatacttaggatccatttacaactattgcaccagctggctgaggcaagatgatcgctgtcagtttgaagctagcctgggctatctagtaagtttcaagtcagcttgatctacaaagtaagaccttgtctcatcctctccctactgcatccccagccgccaactctgaaaaaatacaaaatgacctttggtgtgtgaaaggacattctaaattgagtctttgattttttttatttattttttttttttactttttaacacccaagtctaagccatttcaacctatcacgggtcattgtctcaggaagggtagaggaccactgggtaggactcaacagcttgattggaaggaagactctaatgtagggagtaaggctacctgggccttctccgaaactactggttgaaagattgcttatggagggcagatagcccagagcagtcatgggactattctagaactcgcctgttagtcttgctcatctatccatcatcaacagcctattacctactcacatccatctactcttcactcatttatctagcatttatcccatccatccatccatccattcatccatccatccatccatccatccatccatccatccatccaatgtgatagactctcataagttctcaggcctggttctagtggctaagatgtaaggatcaatatgacaatcctttcacagagctctcagtcattgagagacaatgacagaaaccagctactatgctgtgaaatgtcatggcaagaggctttaacctgggcaagagactcagagcaaaagggcgcccaggaggaagagctgagcatacctgaaggatatagatgacatgccaaaaggaggtggggaggaatgctgcagagagaaggaacagcatgttctaaggtacccaacccaatctagttctgaccccatctttcttcctgccccagcccagcttgtcaagcttcagttcttggtgcctcttccctgttgttccccaggatgagcagagtgatggagagtcctgggcaaagaagatgcaggggactagggaaaagatagaccaagggtacagctcaggagcagaagggtcaatgcccatgctgaactctagacctctgggttcccagtgtgattgccattaaaagaccttaagccaaccattgccaggcccttgtttaagtaacatacctacctattctaagccactgtattcacatttcccattcctctgcttcctttaacttaaccctcatgaattcaccattcctgttgcctgacccctactccagacagacaaatagatgtatgggcaggtggatgtgctgatggatgtgaggatggatagatatatgataattagatgatgggtggaaagagaatggatagataggtaagtaaatggatagatgtgtgggtggagggatgggtgtatggatggaaggatggataagtatggatgaatgtgtagatggaaggatgggtaggtatgaatagatatatagatgggtacatggttggctagatcataaatagatggacaaattgattgggaatttggatacatggttatatagtagatttctgcttcatgggggcatgctcagagtctcataaagaactgatctcttagtgggaagagatgagaaatcttggggtgacaagtaagggaagaaaacccagagacacagagaagtccctctggtgagctcagagtcttccaatgttagaccctctactccatgctctccctggctcagagcatgcctcctgtgatgacagaggggaagacctactgagtatgacaccatctcaaaggtagaatgaaagaggaaaaggccatgcagcataggccatctctctgcttcccagcagagcacattgctctctatcatgacgttctcatccacagtccagaaatgacagctggcaactaccagctgagaactctgagcccaaataaacagcctccactaggctggctcgggcattacgtcatagttatggaagggctagcatactttccaggcagctcagaaagagcagaactgatggctcacaagtgagactttggggagttggtgactacatcaagccaggtgactggggctgtataccctgtgtctcctgggattcaagtggaagaaaccctaactaatacaccagcacacgtgtaaaaagtttggcatgaggagggtgagcatctaactccaaccctgggaatctgagatgggtagatcctgggatgcttgctggctagctagtgtaacagtgagcttcaggttcaaggagagaccctgcttcaaagagtgaggtggacaagcagttaagaaagctatccagatgctgatcgcttttctacatgagccacacaaggcagatcacccccatacttatatagtacacacatgcaaaacggagggagatcaacatgctggactaattctattttactagtatatctgatagaaggagagcccttagataaatagaaactcagaaggcagaatgaggagtccccaagcttagactaacacacccaaaactacatgaagcagttggcagtcattctgttatgacctaagcataagaaatggaggttttatgtaaatgaggaaaatacctagttaataaataaataaataaataaataaaaatttaaaaaaaagaaatggaggttttaaaaaggcttaaggggaactggtagaccacatggagaagagtggacaagggtaaaaagggtttgaatgacagacataactgataaagggttatgacacagaaccatataaccaacctttggaaaacaagcaaggtttggaaaacaccaggtgactcaggcttatcaataaaactaaacagataaagagcatacaaaggtcaacactcactcgacctttttttactttaatttttggtataaagattttatttctattttacatgcatgggtgtttgcctgaagatatgtttacacattacatatgtgcattgcccatggaagggtaagagtatgtcagatcctctgaaactagagttatagatggttgtgggccttcatggggatgttgggaatcaaaccctggtcctctgaaagagcaggcaatgttcttaacagctgagccatctctgccagttcctgtgacttttcttgacatatcaaagtagaaagcatagtgtgtggctatactaagcctatagccaagtattaaagttgacaaagttttagaagtattattttagcaagaataaagccaagaatatttttttatgatttaaaatttttattagcatatatcagtcatacaaagtaataggtttcattatggcactgtcagtgtctgggcttttatgatatttacccctcaaattaaccaacgtaataaggcaaaatgaagtgataaacacggatccaatgattgaaatgaaacaaggctgtaattatttgcagacatcttgtctgcatatagagagaatgtacaacaatgaaaacaaataagagagttaagtgacaggatccaggatcaatattcattaatcagtagcactcgattcataagcagaaaccaatgggaaacccaatgtaaaggaaaatgcacttaaaacaataaaactacccatggatttatctacataagatatttatggaggaaaaaccacaccatcctatcaaagattttaaaaatactatagatcacaagctaaactaagtgagtgatttaaaaaaaccaatctcacttaaaaggatgcctttctgagtggtctataaatgcagtattatgcaaagtcagagcaggttgttctttgtgtaatctgacactagaatatatatgaagagtaaggggccacaatatcacatatgactttgacgacaaacagggaatggacagaggatggtccgataacatagagcaatggaaagcatgctatcagtatggtgtagacagatcaacagaacccactcttatgaggcccataaatggaccatatatagggggaagtgagtccaaaacacagatagtggctgcagtggagaaaagcatcctttggcaaatatttcctggacagtgggctacctttccccatacccacagttcaagggtcaaacctaggactttgcatgcattgggtcaccaagctgccttgccacatttacattgccaacatggctctctatgtcacagaacacacgaagatcaatccaggggtctgggggctgtggttaacagctgttttagcttttagcataggagagctgataatgtgttagctggcttttgcatctgtgtaacaaacaaacaagctaacaaaaaaagccaccaccaacaacaaaacaaaagccaccacctccaccacctccaccaccaccaccaccaccaccaccaccaccaccaacaacaacaacaacaacaaaaacccctaacaacttccagaggaagatttctctttgctcacattttcagaagagttggttcaaagtccttggatctgttgaccctggcctgtggaggaacaaaacacgtaggcagcaggaacctgtggcagaggctactcacctcatgatgaaacaggaagcccatgctgtagtaacaagaagggggaggatacgatcccagagacctacttcctccattaggagccagctcccacagttgctccacctctccatagtctactcagaagttgagttcatcagtagattaagccactcatgaaggccaagctggcagggtccggtcactttccatggctggcagccaagaccccctgcatgactctgtggtcttgtaatcaccccatgaccctgaggagagaaagagccattgaacagagcctaggaaacaaagctatcatgagaaatagattagatagatgataggatgatagatagatagatggatagatagatagatagatagatagatgatagatagatgatagatagatagatgatagatagatagatagatagatgattgatagatagatagatagatagatagatagatagatagatagatagatgatagatagctagatagatgatagatagatagatagatagatagatagatagatgatagatagatagatagatgatagatagatagatagatagatagatagatagatagatagatagataaatttgatgttaaaattcaaattgtctttacaacaaaaaatgcccaacaagaaataagaaaacagtaataaaataaaggaatgcaatacttaccatcagcaaaacaagggcacctggattgtatgacaaattcagattcttccgaatcagcacgtgaattcgaaaagctagaggagtaggtagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagagagagagagagagagagagagagagagagagagagaaccttaagaaaacattagaatgtagtttagaaatttgtgtagttgatctggtatgtttttccccttatacttatatactctacagttaaagatttaaggaaataggagatctgggaagatcaaacttcgtgaggagttgccgccacaatggtttctgatgactgacagggtctctggtggcatggcattcccaggagtaaagaacccagctcctgtagctcactgtgtcacctgggaaacacttgatctctctagtccccagcccagcaccttaccatccaccaacacattctgggagcctacgcgagccattcctggctgtcttgtgctaatgattctgttagcaggcgagagcagctgtctcatgcagaaacgatgtgggtgaggtttgtttagctttttgattgtgaactacaagcatagacagttgagggggacagtgtaatgactccatgaagctgtcacttgccctcaggaaatcacacctgagcaccccagctcatccactcacgatgtatcgcttccactggatgcttatctgggaagccgcagacagttcatcactgaaagagtaagaatttttaccaagtccaaaaggtaggatctagttg

SEQ ID NO: 1458 - DNA, 2840 bp, Mus musculus
ctggcttccgccccggcccctctcctaagtcttccaactcgcgctctcggcacttggccgccagagcccttttggctttgggggtggtcgggatgcccgcttccgggccccgtcgggagagcgttgaaaaacttgctgggaaggttctgggctgtggggtggtggccttgcggaggctcccggcggggagggggccagggacccagaggaggcacggggccgcgtggagcccttctgatgtgcccactcctctcccctatgtgtccttgtgggctccaggcaccccatcaacccgggcagccgggatttaaattcactgtggccgagtcctgtgacaggatcaaagacgaattccagttcctgcaagctcagtatcacagcctcaaagtggagtatgacaagctggctaacgagaagacggagatgcagcgccattatgtgatgtactatgagatgtcctatggcttgaatattgaaatgcacaagcagacagagattgcgaagagactgaacacaatcctagcccagatcatgccttttttgtcacaggagcatcagcagcaagtggcgcaggctgtggaacgcgccaagcaggtcaccatgacggagttgaacgccatcatcgggcagcagcaactccaggcccagcacctctcccatgccacgcatggtcccccggtccagctgccaccccacccgtcaggcctccagcctcctgggattcccccagtgacaggaagcagctctgggttgctggcacttggtgccctgggaagtcaagctcacttggcggtgaaggatgagaagaaccaccatgaactggatcacagagagagagagtccagcacgaacaattccgtgtcaccctctgaaagcctccgggccagtgagaagcaccggggctctgcagactacagcatggaagccaagaagcggaaggcggaagagaaagacagcctcagcagatacgatagcgatggggacaagagtgacgacctggtggtggatgtctctaatgaggacccagcaacaccccgggtgagcccagcacactcccctcctgaaaatgggctggacaaagcccgtggtctgaagaaagatgcccccaccagcccagcctccgtggcttcctccagcagcacaccttcctccaagaccaaagaccttggtcataatgacaaatcttccacacctgggctcaagtccaacacaccaacgccaagaaatgatgccccaactccaggcaccagcaccaccccggggctccggtcaatgccgggcaaacctccaggcatggacccgataggtataatggcctcggccctgcgaacacccatcaccctcaccagctcctatccagcaccctttgccatgatgagccaccacgagatgaatggctccctcaccagcccaagcgcctatgctggcctacacaacatcccatcccagatgagcgccgccgcagccgctgcagccgccgcctatggccgatcgccaatggtgagctttggagctgttggttttgaccctcaccccccaatgagggccacaggcctgccttccagtctcgcctccattcctggagggaaaccggcatactccttccatgtgagtgctgatgggcagatgcaacctgtgcccttcccccatgatgcactagcaggccctggcattcccaggcatgcccggcagatcaatacgctcagccatggagaggtggtatgtgctgtgaccatcagcaaccccacacgacacgtctacacaggcggcaagggctgtgtgaagatatgggacatcagccagccgggcagcaagagtcccatctcccagctggactgcctgaacagggacaactacatccgctcgtgcaagcttctccccgatggcggcacgctcattgtgggtggtgaggccagcacgctcaccatctgggacctggcctcacccacaccccgcatcaaggctgagctgacgtcctcggctccagcctgttatgccctggccatcagtcctgatgccaaagtctgtttttcctgctgcagcgacgggaacattgcggtttgggatctgcacaaccagaccctggtcaggcagttccagggccacacagatggggccagctgtatagacatctctcatgatggcactaagctgtggaccgggggcctggacaacaccgtgcgctcctgggacctacgtgaaggacggcagttacagcaacacgatttcacctcccagatcttctccctgggttactgccccactggggagtggctggccgtgggcatggagagcagcaatgtggaggtcctgcaccacactaagcccgacaaataccagctgcacctgcacgagagctgcgtgctgtccctcaagttcgcctattgtggcaagtggtttgtgagcactgggaaagacaaccttctcaatgcctggaggacgccttatggagccagcatcttccagtcaaaagaatcctcatctgtcttgagctgtgacatttcagcggatgacaaatatattgtaacaggctctggtgacaagaaggccacagtttacgaggtcatctactgaacaaggactctaacaggcctgtcaaactctgggagagacacccacgtggccctgacagggagatgctggccaggcccgaggacggcagaaggagggagcagcattgtggggctgccctccagaaggtggagaggacgcacgcccttcgtggattgatgtgtctgacagacttgaaggactttctcctctccccctaaccagtgctggcagatgcttcaattagatttctctggaggcttctgcttccgtttctcccacgaaaaacc

SEQ ID NO: 1459 - DNA, 2316 bp, Mus musculus
atgtgtccttgtgggctccaggcaccccatcaacccgggcagccgggatttaaattcactgtggccgagtcctgtgacaggatcaaagacgaattccagttcctgcaagctcagtatcacagcctcaaagtggagtatgacaagctggctaacgagaagacggagatgcagcgccattatgtgatgtactatgagatgtcctatggcttgaatattgaaatgcacaagcagacagagattgcgaagagactgaacacaatcctagcccagatcatgccttttttgtcacaggagcatcagcagcaagtggcgcaggctgtggaacgcgccaagcaggtcaccatgacggagttgaacgccatcatcgggcagcagcaactccaggcccagcacctctcccatgccacgcatggtcccccggtccagctgccaccccacccgtcaggcctccagcctcctgggattcccccagtgacaggaagcagctctgggttgctggcacttggtgccctgggaagtcaagctcacttggcggtgaaggatgagaagaaccaccatgaactggatcacagagagagagagtccagcacgaacaattccgtgtcaccctctgaaagcctccgggccagtgagaagcaccggggctctgcagactacagcatggaagccaagaagcggaaggcggaagagaaagacagcctcagcagatacgatagcgatggggacaagagtgacgacctggtggtggatgtctctaatgaggacccagcaacaccccgggtgagcccagcacactcccctcctgaaaatgggctggacaaagcccgtggtctgaagaaagatgcccccaccagcccagcctccgtggcttcctccagcagcacaccttcctccaagaccaaagaccttggtcataatgacaaatcttccacacctgggctcaagtccaacacaccaacgccaagaaatgatgccccaactccaggcaccagcaccaccccggggctccggtcaatgccgggcaaacctccaggcatggacccgataggtataatggcctcggccctgcgaacacccatcaccctcaccagctcctatccagcaccctttgccatgatgagccaccacgagatgaatggctccctcaccagcccaagcgcctatgctggcctacacaacatcccatcccagatgagcgccgccgcagccgctgcagccgccgcctatggccgatcgccaatggtgagctttggagctgttggttttgaccctcaccccccaatgagggccacaggcctgccttccagtctcgcctccattcctggagggaaaccggcatactccttccatgtgagtgctgatgggcagatgcaacctgtgcccttcccccatgatgcactagcaggccctggcattcccaggcatgcccggcagatcaatacgctcagccatggagaggtggtatgtgctgtgaccatcagcaaccccacacgacacgtctacacaggcggcaagggctgtgtgaagatatgggacatcagccagccgggcagcaagagtcccatctcccagctggactgcctgaacagggacaactacatccgctcgtgcaagcttctccccgatggcggcacgctcattgtgggtggtgaggccagcacgctcaccatctgggacctggcctcacccacaccccgcatcaaggctgagctgacgtcctcggctccagcctgttatgccctggccatcagtcctgatgccaaagtctgtttttcctgctgcagcgacgggaacattgcggtttgggatctgcacaaccagaccctggtcaggcagttccagggccacacagatggggccagctgtatagacatctctcatgatggcactaagctgtggaccgggggcctggacaacaccgtgcgctcctgggacctacgtgaaggacggcagttacagcaacacgatttcacctcccagatcttctccctgggttactgccccactggggagtggctggccgtgggcatggagagcagcaatgtggaggtcctgcaccacactaagcccgacaaataccagctgcacctgcacgagagctgcgtgctgtccctcaagttcgcctattgtggcaagtggtttgtgagcactgggaaagacaaccttctcaatgcctggaggacgccttatggagccagcatcttccagtcaaaagaatcctcatctgtcttgagctgtgacatttcagcggatgacaaatatattgtaacaggctctggtgacaagaaggccacagtttacgaggtcatctactga

SEQ ID NO: 1460 - DNA, 69173 bp, Homo sapiens
  misc_feature (27560)..(27579): "n" at positions 27560 thru 27579 can be any base
aagagtctcccttttctagtaggccatttcacaggagcaaatgagatgtgaaattagagctaaaagactcccaaagcacgaggaaacacaagatcctcggaatgaggcatcaccaggacacctaaactataaaacagataaaaattaaggctgttctgattgaggtggaggaagcgatccctgtgaccactctctttacttcctcatcttctcagcactcccatcaacttctgaggatcccaggacctccttagggcacaatttgaaagcttgactggtttacagaaagaatcaatgccaatgccagaaggcctaagtctggtcagaattcgccatcgtcaacttgtgtggtggtggacaaactacctaaccttccttggccctcagcttcttcatctgccatggagataattttccctgctctacatgttgcgtcttaactagaaacccacagacacgacaatgctttaagcagaaaacacaagacaaaagtaagatggcgttggttttgtttgtaccttgcttcatactatagattttttgtggtaggttagtggtcaaataataagttggacctccaggccctcaaaattgagtctttttttttttcagttccactccaacatcaaaatctatagtcatctatgtgcctttcttacaagtgaagcccctttgccccttttcttgcccccatttctctctacttccagaactcccaggtccacctgcagcctggaccttcagagtccccatcagtctcttgtgtttgccccccaaccttgttccaacccacccctctctggttgccccatctccctcttgcagaacctcaacttcaggaagggcactccccaaaaaggcaaaaaataccccatcaccagtccactcctccctgccaaactccatacaacctaactgcatttagccttccaccctgacatctttcagggatgtgccaacagcaacttttgtgactattttccaatgttacgcaggcacctaatggccctgggctgtagtccccacttggaggagctgccagaggatcccaggacttctctagcattagctcttcataaagagactttatctgaatgactagataattgctaacttgtagagcaatctttaaaatggctcaaatactgcacaaggcaggaacctagagctgggggtatttgaattactttctagtagagagggcactgagagtagaggacagaggataggctttggagacagaggggcctgggctcaccaatcagcttcttcccttcctgaacatgtgacactttccttcctgtatctcagtttactcatctgcaaaatagggacatagagaatggcactatcttttttttattattattatactttaagttttagggtccatgtgcataacatgcaggtttgttacatatgtatacatgtgccatgttggtgtgctgcacctattaactcgtcatttaacattaggtatttctcctaatgctatccctcccccctccccccaccccacaacaggccccagggtgtgatgttccccttcctgtgtccatgtgttctcattgttcaattcccacctatgagtgagaacacgtgatgtttggttttttgtccttgtgatagtttgctgagaatgatggtttccagctgacaatgacactatttattaagattacatgagatagtatatgtcaggatctctcaacttcaggactattggcatttggggctggataattcttagttgaggagggtgttctgtgcattgcaggatgtttagaggcatctctgttctgtacccaaaggcactgctaccctgagttgtgaaaaccaaaaatatctccagatattgcccaaattccccttggaagcaaaatcaccctgagttaagagccactggtgtaagagaacacgcttgatacaaaatcaggctctcactattgctggatgtatgtgacaaactcacgtttataaattcatttattaaaaagatacaaagctgataacagatctgagagtgaaaatcaaatctgtcaggcaaataccctctcatctctcgttccctccccattccccatcccaactcagaacctccatcaaagaccaggtatgccgggcacgaattctacctaaatgatccatactgaccccagaactcccctccactggcgtggataattcttacagcgtgggcctccacccttgtgaagttgaatgcattaataccagcaaaatatttcttaatctcctaagcctcagctttgaatccttaaaaaggaacgaaagaaacagcacaaatctcttaattagaatgcccaatcacttcgataaatatttacccggttcgggcatgaggcatggaaaccctgtgccattagtcaatagaggtcagcaaagtgcaccttgggaacagtgggatgcaattcagctcaactttggagcgggtgtaggggagaatgtttccaggcttatgcttctgctaaagacaggtgaacaaacacattccatgcctaccctgcacacctgcccccccacaaagtctcaggtgggcatgagggcctcattgtaaatcatcgcctggtagtctggcttccaaagctttctggagagaggcagtggcttcctctgctagttgggccatggagcaaaccaaaccattccccagtgagtgttctctgtagtgccctggctgggtacctttgctcctatctggagctctcttccttcctcccctctgagccacagcaagggccaccctctataggcagcttccctaatagtcccagtccctccccacccccacccttctacccaataccatttccctgcacaggctctatttaactctgagggcctagatacagcctggaatacaacctggaactggggacagtctggccttgtgtatgttttcgaaggcaagggctttccttagattttggaggtaagctttctgcagattcttgccaggtaagaaattaggtgccattattctcattttacagaggtaaaaatggagaccccaggagtttcggggtcttgcccaagatcttgcagatcttccagactcctgaagcccaggttggtgctgccacacagtccggatgagtggatccctctctcctggctgtagtaaccttcagaggcatcctcactggagcctgaaatgggagtcgggataggggcagggtcttagagaagcaagctcttagctccgttccccagggaataaaaacagcttgtcaggtggcaaaactaagaaaagaccaaggaagcagaaaccacccaggtgcggggtgagggggaagggaagggtttcgatagaagtatttgttcatcctgtcccctctgcccaccacaacttctgtccatccttttgagctgagctcaagctccagccttccaggaagcccttccagaaccacccttctcacaactgttctcccccacttcatactttataggcttactttttgtggcttgtcttctcagaaatgctatgaatattgcactgtggtggcagacagatttctctctgcctctatccactcccacctcaccccagctttagctttgaattgcccctccccattccttccttcccctctcctgcacactccaagggtccttgggcttcagggatgcccaaggtcatctgaggaccatgataaagaatgggattcccagagagggagaggaaggcccagtgacctcgggagggccttcctgagagtccagaggagaggagctgggtgttcccacctgggcttggctgtgtctatgcagaataaggttggggctgctgcctggcttgctccccccagggctgggatagaagaccttcctagcctctccaggcacgcagaaaatgttggaggagttgaatcacccagatagttgtacattatcatcatggccaccacagctaactgttatcgatcacttaatgtgccaggttctgtactaagtacactacatgcattatctccatcgattctcgggacaatcctcctcaggtactggattgttatctccactttacagatgaggaaatggaggcttagcaagattaaataagtcccccaaggtcacatagcttgaaccagtcagagaatgggaagacgagttgggagaccctgggaagtcctctccttccactagccttggtcctcttccctgagatgaggtagctgcaggatgagctttataggagctccctctggggccctccagattcctgtggtccctcttgcagccctggcctgcattctcaggaaagccaagcttgtagatacagcagggcgtagtaggtaagggcaggcacactggtgcccaattgcctgggtcctgtccctgggacactgatgcccaaatgcctgtgtccatcagtcactgatgtgaccttgggcacatcattgtaccactgtgtatcaatttccccatctgtaaaatggggctgatactcatggcacccacttcatttcttgtgtgagtattaaatgtgttcatatttgtcaagtgcttagaatagcactgcacacagcttgagcactatgtaagagtttgttaaataaataaaaatttccctttcttttgctctatgtcgaggtgcttgcttgtggaggaaggtctgggatgcccggtgagtggaggggtgggggtaggggggacagaattactctagtcatgaagacaaagcaattggaggagccctatagaatcaaccgagggggtgtggcatggtgagggagatttctgtcctctctgagaagttccaacaagaggcttccacaaatcaaagccagtggaggcagtagaggaagggatgacagggagaggtttgcaaccccacccacggcactgtgatccattcctcaaataggtgaccacagcctggtggctggcctgagccataccctttaattcctaagggggtaaagcatatactaactcagctaaagtgcttgaagaatattttaaaagactcagagaagtggctcctcggactggcagacagttgctcaccagccaccttgcaccccaaataaggggctgggggctggggagccgctgctctgtaaatccaggccgggctttctgtctcacccgggtgacttttttttttttttttttaatgtgccaggaattcctctcccacgtggggtggactccgaggtactcaattaagcagccaatgaaaagtcagctctccggtagcaaatgaccctgacacttcttgtaacataaacagttgaaacgtttccaattagaactggagacagagacgtttgaactctttctctcgactcccctccttctttaaaataattgtcaagcctttggacggggtgttgtatacatgttttttattttcttttctctttctccagcataaaagacatgtatttttctccttgtttttcctaatttgtggggtggcatgttggggcggggtgggggggtgcggggagatagcggtggtaagcttaaagggatgttggcctggttccttacctccctgcccccttcctgctcagggttcaggcagccggtgagagcggggagtgacgctgggtgaggagtgagtgggagctacaggcaggagaggcctgttctcccaaagccaggctctcagaaagggctgggcatgaatgaatgaatgaatgccttttcttcagcaaaaacttgcacgtatccagcttgcgtaagcaaaggggtcgctgaggttggccattaaactggctgccctggattcgaatcctgaccctctgcccagctcggggcaaatgattgagctttctcagcctctcttttttgctctataaaatggggtccccagccaaactgcttccctcgggagtgaggtaagggagaggagagcgctgcctgggtagcagtgccctgccttgtacctagtgagcgctcaagcgctgttcttcctgactgcgtagcgtggttctaccgcccggctctgcggaggaggcggcgctctgcaaaaccgcgtcggggacacgcagccgcgaactcctccagcgtgccgggctcggccctggcgctggggctcacaggtgaactcgacgtgggtctgccctgctggagcgctctggctcgtgtggtcaccggggggcgtggacgtcggggcaggagggacacccgggcgagagacagagctgctgtccttttctgtacacaatcttcggaagacccgacctgggggccccgcggcttctcggccgcctgctggcgggcgccgtcggagccagtccagagggagactgagagggaggcccggcgaggcgccgcgtccctggcatcttgaaggcattgtgtttaataaatccgagcgagacgcacacccgctctcatccccctctcctctcagctcccaaatcgagacctgctgtaggacccccagtttacggggtcttaaaaccccctctactttgagtagcagcttcaaagagctccctttaaagttcgccccctcccccgcccccacgtcccctttcacaggccacccctcctccaccactccttctagacttctggaggacgacgacaacaaaacactaaatgcaagtttaaaggggggaggggaaagtcttcaggcttcctccagaacgtgggctgtggaagtgacctgtttcaggcgtgcgcaggagtcgccacaccgtagagtttgggttttctttttctttcttttttttcctcttttcttttccttcttctttttttttttttttttttttgtttgtgtgtgtgtttttaccttttattatttaaattgatacgtttcattactagggagaaaaataaaatattcctttgatacacaaaatcaaattgatatttagcctctgcttacttttttatgcatggctcctttataccacatggtagtgacagattgtttgagctggaaggaaaagccattcaaagctaattaagcagccattccaagcactatttgcaagcgggaggctcagaagcctcggcatttgtcagcgctcccccaccccgcgtggttttgactgacagctctggccgcggactgacagggcccagcagctccgccaatcagcaacgaagagccccttcggcggtccgtgattggtgactcgcaccttgctcggaggcgtggtcggcgtcccccacgtggggctggagcgagaaatgggcggggcgagtaagaagcgggtgcgcccacccgtgacgtaagggggagggcagagaagggggagggggaaaggaagcgccaaagaggagccattttgtttctaatgaatgctgcggccagatgctcgcatctgtcgagccgggcttctccctcccccgtcttcggtgcgcgccgaaacacgatttatgtttttatttaggagaataaataaatgaagaggggagcgcggttcggggctggcggccggagcgggcgcggggaggttcagttctgaggcgggtgctcacgtgtaactccccgcgctccggcctccgagcgcccgctagctctcagctcctcattaagatgcaaaagcgaacctccggctcctaatgaggggaaaatatagatccggggacgcgcggccggctcgcgcgcgggctcgcggacttgccggggagggccccgggggtcccgccttggccgtccaccgggcggtgcgcgctttgaggtccactccctgcttgctcgtctgccccgccgtaaccccgagcgcgggagggcgaggccatcggtttgcgggcaagctggccccggagtcgagtggcctgtgcgaccaagcggggggtccggggggcccggggccggggcgagcgagcgggggagcgtccgcgtccctcggagtgtccaggctagcgaccgagacacctacaggcttccgccaacgccgtggcactgccgggagcaggctgagcaaaccaggtgggaactcggagttcccgggcctcggccgagcagggtcccgacccccatccccaaccccctcagcctggggatgcagtgaggagcccgcgcggcgaggctgcgtcgagggtgaagttgtgcccacggggaaggcgccccgaatggggccagccgtggctgagcctgttgtccacgggcagccgggcccttccatctgcgctgcccgcctagccagagtccctcagacttctcctcgcaggcagccgccgcacatcaaaggagctgtttatttggctttctgaaaagaagggcgagtgaacaaaggagagctgggggctaatgtgggggaggcgggcagaagaaggggtgaagaaaaggggacatcctgagttccgagcaaatttttaaaggtcggaggcaactttaggagccaccgttttatcagtcctaaatcttttgaagtgaaaacattaaagtgacaaagtgattgtttgttttatagtatctaattgggctgctttgcagacctaatgagattagagggaggaatcgttcgccgccgctgcagaataaactgatacattactaccagccacaggttttgaagattgtacagcttgtcttattttcttttgttgttattcctctgtcttccctctttcctcctcccgctaaataattatttgctagtagaccgtgggaaaaaaaaggaggaaaaaaactcgagcagcccaggactataatatatatctatttattatatgtctttcggttaattcctgatctgaggagcgctgtttttcactcccatgcgaaagtcaccagcgggtagggcctgattgctacttttcatgcatagttttagacacaagagggcattgtgacgtcgcgcccagcggcacccagtcgtaggccgagtcccgcagccccacgtgggggccccgcgctcccattggccagcgccggacgaagctgccacattattttgttacttttcagtccctatttggaactgctctcgcggcagttcagacctcgtgctcgtccccttcgcctgtctgtgtgtggtatccgtaggtccggggcactttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcctgcctgtgcgctccgacgcggcagcggcggtggcgctgagcgctcctcggtggggacgcggtgctcaagctgggagcagcgagaaccctttgcggaggcttcccgtgcccgctggacttaggatgccagggcgtttgatttgcacctactgagcccggagttcctccccggccctgggaagggcttgcagcggcggcggcggcggcggcagcggcagtagcagacggaacagcaggctctcctctccgagggggggcgtcgaagcgcccgcgccgggctcccgccctcaccctccggcgctcctgcggccccaagccaccacctcgtagcccgcctccttcctcttctcgccgcgagccccaggcccggacgcctctaggatcggacccgcgcgccccggatgcttggggctgccccggcgcgcccccctacaggcgcgacccgctgagtgacccggagggggcccgagctcgccccaggaggggcccccggcctcgggaccccgcgccggacctgctggggagccgacgatgtccgcgcagtcccaggcattgacgcgctcgacgcagcccagggaaggcggccggccgctgcccgccgagccctaggcgcacaaagcccgcgcccgccgcccggccccggcgcccgccgacgactttgccgcctgctccgcggctctttgtctccacttggggcgggcgcccgactctgggatttcgctgcgagaacgagctgggggggccgggggcgagctctcggtttcccggccgccccccgctcgggctcggctcccccctcccccgcacctccccggcccgggctctcggcgcttccacgctctcggaatcacgacccctccctgccatgtatccgcagggcagacatccggtgagtaattgcaactcggtttatttaagcatctatcatggcagggtaaacgaggcagtttatctggcacctccattttgcttgttgctacctttatggtgtgtgtgtttgtgtgtgtgctctcacacaaagggggatgcggccggggggcgccgttgagagaggaggttaattccgcgcgagtggcgcggggggctgcttgtgttccagggggagctgttcacgcggtccccggccccgctctgaagtctcccaactcacccggcttgtctcccgcccccgccttactggggagagggaggcccttggtgaaaggcatgggagccccgctgccgacggggagagatggggcgccccccctccgccccgtcggagagctgagaaacttgctgggaaggttctgggctgagggtggcctcttttggttgggcgccgttggggaggggccggggccgctctgagcgcggtctcatgcccccgccccctcccctgtcttgtcttcgcgggctccaggctccccatcaacccgggcagccgggatttaaattcacggtggctgagtcttgtgacaggatcaaagacgaattccagttcctgcaagctcagtatcacaggtaaggccggtgggggccgccccggggctggcggggaggggtgggtccctgcgcggctcctgccatcccccgcggggacggagggggctcccgacctaggggcggcggggcagcccgggcctccgccttttgtttcccctttccgagcgcgccgccttaaccctttactgcccgcagcagcccggctcccagcgccgcccgtggggtccccgaatgagggtctaggtcgcggcgagcgggttcactccgggttctgggtgtcgggagccagcgtcagggtcctactcccctgctgccgtgataagtcctttggctcgcgggaagtttcgaattgtttcacatccccctccccacggcggggacccaaatccccccgcgtccccaggctgtgggataatgggggcgcccccgggggggtgtcaggaaagtggaaaagtggctctagaggcccttgggtcggggcctcagaggaggctgtccaggcgccacgcctgagccggctcctcctgccctcgcagcctcaaagtggagtacgacaagctggcaaacgagaagacggagatgcagcgccattatgtgatggtgagatgcggccgcgggcctggggggcggttggggcgccgaccccggccgggggcgcggcgtggatctggggagatgagcgccaggtccccaccaccgcccagccgcagggcggccctgagagagggcataatctggtcttgccctccccttccccagcttccattgccggggccacttggaggagggtgagtgaggggaggggcagaaagagaaaccccgattccaggccggagacttctgtactatctttatgtgcctttaatttgtgttttgaaagtttcccaggggctgattgccattgccctatcttggctagtaagataggattggaccagcccatgtgaaattagggttggtaaaaatctctcttagtgacctcctgggagtgtttggaaacttttctgctttgcagctgggatctagccagagtaggacagaagccctccttccccagggtgttgtgaggagtggagaggccttgtaaagctctctctgcctccactcccctcctcagggatcccccagctgggtatcttctccacgctggggcagtaggcagactgtcttccttttgcccagcaagttttaatcttcatttgtgagagggcacggctccctgcactgctttccacataagaggccttcgacacagtgctaaataactctcagaggacaagagggtcccagtgtacacacgattccctgttgaacctgaaccttgtataaacaggatatagggcacatgtggtgcttgtgggagggaaggcccagctccccttactaccacataatataacgttctgttgagatgagaggaacgctcgcccttgtcagctcttaaaccgctctgtaagctggctttggggtttgatttaaacttctttagcaaatgtatcgtaaaagtatgatttggccaaaacctttccaagaaaaaactgattttgaaaaatgaccagatttctgtgttgtctgttaatagccattctttttacttttagtactatgagatgtcctatggcttgaacattgaaatgcacaagcaggtaagtgcttttctcttttaaaaatatatttcattttttaaaaacttatatatgtggacttcttatgttctctcttgtttgaaagtgagcctgcttcttcgattcctcccccttctccttgaagagtgaatggatccagtccttgaaatgcaaggtctgaggctttgctgatttttttttagacatgttgagcttttagcatttgagcttgtgaaattagtcctggtcttggatctcggtggaggataaaggaccaaagggaaagttgtacctccaggatctgctttacaaactcctgaaagcccagaggtggctggctgcttttatctgttttaatgtaaaattctcaagaggaaatgcaggaggattttttttttctttctccttttttttttctttttgcagaaatgtgatgttctgccttgataagattaaacttcaagaaccttaaaagccaggctgagctgtcgaaatttaagggaacgaagccactaactgcttaaaaatatgaagccagaatgaaatacaacttcagtgccttgcattgacaaggtggctttctcatccctgtcttgatttgaaggcagccgagttcccattttacagagaaggaagctgaagctcctgggtgaagtaacttgcccaggggcagcctagccaggactttcgagatggctgggggttgagctcagctttgaaatcctgaagtcaaaccagtttagctagtgtggtgtcgtttgatggatatgtaaactacctggtattgtcactcttctaataacagtatacctcaaaccgagcaaatacaaacaccctttatctcagtgcatatcagtaactagtcccagtgctaggctgggctgtgggagaggcctgtttgtgtatttgtgttctgaggaaaggctgcctataatttggcttggccaacgtttagagttgacttggcacgtataaatggagcaggcaggccggttgttctttttaacaattggtgttcatgaaatctcagaaggctgttgactcattctagcctttggtgaccgtgacttgaatggattttctgctctaaattaacagtcgtttacaaggtttcaattttgctctttaaggaggcaggacccagggcaggtgagaagggcaggtgaccctggaaagtgggcagattcctacccactcgggtggcttcctatagagcctttgggatctgtagtttcctttcccctcctggagggagcccccagtgttgggtgaagggaagccagaaaggggcctgagtttattgagcaatgtgtgggaagccagcttgtggcttcctgagggattagttagtcccttaggaaggcacatgaaggctaccatgtttttacttcttgacacacagaaataatagacagggctttatacgtaaagatatttctccttggaaaaatagaatagagacaggttctgcaactggaaggggccaggtcccggaagaatgcttgaaatggaactgggggcccaggtgtttcaaggaccttggggtgtatgcagggtgccacttcctccctttgtctgccctgtcttaattttttttttctcaaatagtatcttgggtgtgtttaaagagggtaattgcacccaggtttaaaatttatagcagcagttattggaagagcttggtaattaaggtgtaatgtctcgttgcatgttgaggtctgcatgggtggtgttccgcatgtctgtgaatgaatggtgctttggcactaagaatccaccttggctcgcagcagatctgttctgtgagtcctggggatgctgtgaacgcaggaagagttaaatatcttaacgcatttggtggtggggtttatataaagagcagctgtgtacatctgggatttctggccattccccaaacaaggttcttaaggggagaatgcctggggtttggctacgttgtctcatttaatcctctcagctgccagtggtggatagaggcattctttgccccctgtttataggtgaggaaactgaggcttcagggaggccaggagggcagagctgggattcaaatccagccctctggcttccccactgggcactttaccttgcttgccactcacctttgccctctagcctgagttcccagcctgaacatgtgtgctctgaatgcagtggctttgcaagcttatggcagtctctgagttgggtgaaatcaccctgtggctgtggaggaacaaagaggcaaggaggtgaagaaacctgtgccgtgaaatgcaaccctgatctaatggagctggccactccctaggtttgcaagggttctgtagaagaaagccctgccactaattgtagtgtgggtcttgggtgcatttggcgaatggtggttaggcctgagcaaacaagtttatcagctgacctgtttagcggttgactggtgttttatcggcacacacaatcaagtgactggagtgcttgaattattcatgcagtgtcctgccctctagacttgactgttcgtgtgattacatctgcctggaacaaacaggctggattcttcatctttaagctggggtgggggtggggactgtctgtacttttatataatagatgatctatagagctagcaccttgggaagtgtggcagtcctcagcctgcgcgcatacacgcacacgcactccaccatcaccaccacatattttttttaaaagctctcctttgctggctctatgggaaatgccaattagctgggaacctcgagtcctgccagatgggcccgggtattgacagagggcagctgatgaggtgcgtccagcccatttttattttactgagaggttaaactcactgtggctggctccttctctggctgtttctctgtctctctctttttccaagctgtcaaaatcccagagaagtaataaatggtttctcctcctgctcttctgcctccctccctaattatggtaaagcaaagattacagaatcacaggcctggcccgggacttcaagaggtcacccacctccaccaagccccctgcttccaggcagaatgtcaagggtggttcagagagtctgggaaggcagtgatgactgaccggctcatcacttgccatcttgtttgtgcagaggctttccagtgtcagccacaaataacaaagccagcttaaaaccaggggccccagagcaattgccatgcattggatttgaggcactggctctctgagaagctgggtcaggcagccttttcacccactgttggtgagcactgacatttttgaaagtggacttgagccattttgattttggggcagtgtcgtgccgacacaatacagtcacctttttctgtgaactgaacaacctttcctgtaagtttctctttgaatcttggaactggaagagccctttggcttctcatgcaaacttttcaagttacagatgaggaaacggtggcccagagaagggaagcttatgtactcagtcatacagtcccacgttagtggtaaagctgctactgctgcttcccttccaacccaggactcttttctgtaagactcaagaaatgaagagtgctccttttctagtgtattctgtgtctttaattactattgcttctttctgtgttattatccaaacaggctaaggctacaaaactggccccaccaaagtccaaagtgccccatttcgggttgtataatcatatcactgaacccttattgtccacagtcctgttttgaattgccagctatttgcacaactaatgatttgatgtgtgtaataataatacataatgcataactagcaatcccagaggaaagattcacagaccgggaaaggtggtatatataacctgtgaactttttaccctagccatggggtgccataaacacagggctgaggtaggaaatggaaaatccccatttgtcactcccctcccctccccgctctggatcttctcatctaaatgataaggggctcacctggaagatcttgaggcacacagaagttttgtgaccacggtgaaggtgcaaggtacaggtggccagagggagctaccaggcaatgaggttacaaaggactctgccaaggagttgagcctatcttgataggagaatgtgggaccacttgcaaagtagaaggggtcaaaggtccttagactagggaagtgcctatttgtgtggcatctgagttgagctgtgaaattttttttttcttttttgccagagtgctagcatccaagaaccctcccacccggccccatgccctggtatctgtcttgacttttcctgctatattgatcttccctggaacagactgtaatcacgagtcctctcactgagtgggtgcctgcctcgctcagctttggggtctgctgggctccaagctccctgcatgctgtctagctagagggaggttgccccacccctcaagactgcctttggaccccttttctctagttgccagtgggagtggtagagtgggggtttcagtgcttttggggtcttttccttcttgtgcatttgtcattgaaatgaccctgggagatgagcaaatggccccttgtccttactttacagatcaacgggtgggaacctggctcctaattcgggactcattctctgaactctcttggaccaggagcccgtggcagacacggagttcttcctttccttgaactcctccttcccacctaggctgtttgtttccattttgttgaaggagtgagtcagtcaaggaataaatctccttttgctttctacgtgggagaatgtcattctgtctcattgtttgtacaaaatactgggacaccaggggcaaaaacgtgacaaagacctaagcttggcagtgttttcccctgtgatctggcactcattcctcatctcatttttgtaggtatgaaggaagcccctctgctgaggtctctatagcacttagtatgtaataggtgctcagtaaacatcttggtttttcttcaaaatttactcaggttatctgagagtagagttccgattccctgagccctgtgagtaggaagtggggattttagttgtgggctggccgcccgctctgcaggcttcctcctatggcccagcatccagtttcttcatcagtgaaatgagggggttggattcattcccaaagcagttattaggggactgggatgtgctgggtgtgggctggggttggttacacagccgaataagacaccattccctctgcgggggagtcggatgtctaaagaagtaattgcaatgcagtgaggtaagtgctaatgtggcccaagtgtcataggaggagcacccagcacagaacagcttattcttcttgggtgagagcagacttcactgagggctttgcttggcgcgagtctgaaagggagggtagggtttatgaggcagaagtcggcagccgaggcccctccagggtggcaacagctcgcggcaaggcagtgagatatgttctagaagccacacgtcttcggaatgatgtggggcggggactgcacttgggaagtgaggcgaggtggtgacattttgcagcagagcgatctccaaggcccctctgcccttgcagtcgcggctccccacccggtggctccctgcatccctgcatggctggctctccagggctggcctgagtccatctgccgcggggtgggggtgggggcgggggcgggggcccgctctgggccgtttgtggcctgctctgcctgctttcctaccgtaatatgctgctttgaactttattccccaaagtggcattgtctcctttctcatattggtaattctgtaatgactggttatgacccgccccctcccccatatttaattctcatcagcccagctctccactttgctattaatgatagcagccagcaaaatagctttcaacatgccattgacagtctggtttaagagagcacttgaagtagtgctagacagctgaaagcacccataattgtgtaccagagtgagaactgcgtgctcaagggccttgtttttatatgcttaaagggacaatatcttgttttcaacaaatgctctctgagactcacagccaagatgctttcttcctttttccttttcctttcttcttttggctttctcttctccttcaaaatacatatttaaaaaaaattctttataaaataattgttcccttcaagttggggttaaggagaaacttaaggaagggggaaacgtcctgccgccatgtaagcggggaatatttggtgggtttgttgttttgaagcatcgtcctttgcaggcagcaagctgtgggtcagccttgccctactgagggtccttaggaccttgcgtttctcaaggaggtaatgggagagtctgaattcgcatcagcattgattttgaattcttttctttgctaaggatgttgcacaatcggtgggctgcagagctgtcactgtgaatgtttaggcagaggccaccttttgggggagggctggaggagaggggtcaccgtgttggagagtcaggccatgaccgctaaggaatcagattctaggaggctgtttgctgcagagttgatggcccaagaggcccgtctggaaatcaacagggtgggtggggcaaggacttgtattcttaagtacaggttcacaccaggcttggagggttaaccagggggcccggctagtccacccggcagattttatctgagaacaaatacttttctccccttcacaccagccgacttcattattgctttgaaaatgcagtcctttggaagaggtttcctttgcctctctgtcaccaaagcctcccattgccaatgtgtcctgtgaagggagaagagagaagcaacttcccatctgtggggcctgagaggccagggaaaccctgttggggcctggagtatatgtcgtcatgttctctcccaggctggctgctcttggtaaagggtaggagcatggatgggcttggctcgtgtgtcttaggtggttccttccatcacccactgtgtgaaggataggatccagtgttctggctgctgccaccaccaaataatcccaggggaagtactttccagaggacaaactgtttgaaaaatttgatcttccagatattatagattataatgctacggcctcttagaatttctgtagcacttgattgcaaagcagattcgacattttcatcttagcagctaaaataatgggtatttgggtccaggacagacagacaccaggataaaagcatcagagcataccctgaaagcttggggtgtgaagatgacctgtgtactagagggctgtgttctcaaattggggttggggaggtgaggcctgtgctgtgacaggactgtgagttccgtgagggacaggaccattttgtatttgttttcactaagggtcctgaaccctgagcagtgcctggcccatactggatacacagtgtgcattttgtggggactcaaggaaggaaggtaatattccagctcagggttctctctgaccctgaatagtgttatggactctttgggaaggatagaagctttcttagttttctgacagaggcctgtaggctgcaaacgttgtgtttgtagaaagagttgtaaaggtgtcatgagcctttatttaaaagtgtctttaatgtatcttaggcatctttttcttttcatctcacactatggacagtttaagtgcaaaaggggaagaaggcagggtgggggtgcgaagagataactgggaggaagagatgacaaagcagagatgcggaagagacaagtgctgagtgggtgaattggtaaactcggcttgccatgccttggctgtttgggcatggagttccaagtgttgtggccttatctcatgagccttttaagtttgactattgttcacagttcttctactgctttttttgtttgttaattttgaatgaaaactaccgcaggccgatagaagtttctttttcgtttgcgctggaaggctgaccctttcctcaagtggagacccaaatgcagaagagctcttcccactagtgttttagcactgaataccaaatgcaatttgggtacaggagagggctctcccttcctggtcagccatgaagacttgaggtttagactccaccaccctgccagctatatgaccaaaaggttggaggaggcggcctttcacccacttcccaaatctttcccttgggctagccctcgacaggtctttgctgagtttggatctgaaactgattaattctgataatactggcaggggcatgctttggaaccggtgatgctttgtgatttctgctggggaaaatgagaagaggaaggcagttcagtgcagactagtggacaagggatgggagtccattctagctctctggtgggggtgaggtacaagaacttctattaaccttcctggcctctgtccaggaagaagtaggacactcagagggctcagaagcagcaggtgatgccagatggtctggagtgagggtctaactggtcgggtgggatagaggaaggaggagcaggggagacagaggaagtgagcctgttggcactgattggtcaataggtcttcagctcatccttaaacccttacctgcttcttttcctagaaggaggccccttcctctgatctctctctccagtgaagaaagctgaagtccagttcttattttgctttgcctaacaacagaagtcctggggaaagacaggaagaattgagattgatggtacaatccctgtctcccatccctcaatcgctgggttttcatactttatcccagagaaatgggggatctccatgaagccagacttgaaatgggggagaagcagcctggtttagagctcgaaagacatgcccctctcctgcagggtcctgctgctgttggcctggtgtcggtctccatgtcacccagtccttgtgtgtggcaggcacccacaggcctggtctgcaggaacttgagaagtgtctagatacccctttctcttagccttttgggttttctcactattcttttacctggttttttaccttacttctcaagagacccctacccagctcttcctcactatccatttgcccagggatattgggcaaactccctttttaaactcccaggatgttgaatgcccattgggcctactggatgatggatggggtgggttcccagcaagccagtttttcttggccagtggattccctttctccctcagaagatcacaagttcttgccgggtgatcctggagagttaggtatagagcaccagaagctgggagatttgtcttcatggctaagaggttggctttggagtcagacaaatgtgggtttgagtcccagatcagttcatgttggtgtgtgactttgagcagactgtttgacctctgtgatcttcagtttgcagtggagataataataacacctgcctgttgcggcagtgctgtccagtagaactttcttcagtgatggaaatgctgtatgtctgcactcttcagtaaggcagccaccagccacgtgtggctcttaagcacttgaaatatggctactgcgactgaggaactgagtttgaaatttaattttaattaaatttagctagccacgggtggctggtggcttcataaattgtacagttacagttatagggagtgccatgaaggatgcatatagcctgcttagcacaaaaccttgcacatggaaaggccgaagcaaggtattctcacaaggggacagagtccccaaattgtcaaggcctccgacatagaggacaagatccttggtgttgcatatgttgtaagatttctcagagccctttcccatatgtgacttgttggctctacggtcctgcagtgtaggcaccgtgggcgccacgcatcagatagcagcactgacggttaaagaggttgagtaacttgctcattgttgcacagcagaccagtggccaattcagaactggaaaccaggcctgcttccctcgtggacctcagtgatctttatccataggctatatcaagatgaggtcttctgtggtcttcccacatgtctacccccagaccaccatactacaggcatcagttccagtgctgggaagaaaccagatgaaacctttcagaattcagtaaaacatgagcatcagccacatgtggatcagggattgccaccctgggcgctgtttacatttgggactggataattttttgtggtgggattgtcctctgtgtttaggatgtttaacagcatttctaatctctacccactagttgttgttatcagtgcccaagttgtaacatccaaaaatgtctctagacattgccagaatcccttgggggaaacaattactattggttgagaggccttgttatagaggaaggagtctggctctaacctgggagatttgcttaccacctggtcttcctgtgtggtcttcctgtgtgacagcttcttgccctctctgggcctcatttgactcatctgtaaaatgagaggtcaaatggtgtggcttgggaggaggtcagtttgagaaggagcatatcatataaaataagtttctaaatgaccgatcttgatttttatagcctaagaaatgccatcactcctgccttccttatttggagaaagaagaccctctaaccctttttattttaatttacggaacaggtatgctctttggttgtgaataagatggtaggtagatagaatggggctctgtctctgcccctcaccttgttcttccctcatgccacttgggttttccaaagagtccctgcccttaagaagtcctagccagcatttcatttgtagtgctgacctgatggggggagacccccaaaatttaatgagctgtctctgcaagggtaatgtgacttttacagcctgttgaggggcaaggggagatttgcataatgttccaagggggattaggtggctgggggttgccatggcaacccccacagggatgaattgagaatttttcctcctggcaggagttggccaatggagtctgggaaggtgggggagggggcagggggttatctgaggggagggaggagggggaaggagagagggaagggtgggggcggtgtgcctgggatgaatgggcagtgttgggggaaggtataatctgaaaaagcactccctgttctgtctgtacaagcaagctctttgagagccatctccccccacaagtaggggtgggaggcaagcagagtttagtgtgtttgggaaccaagaaattaaagtgaacaaatatttaaagattattggatcttgttaacaggaagcccggtagatggaaactgaaagtctgaggaatgaaactctttagagtcctaaagccaggagggacttgagctgtcatctgggccctgtggtgtctgcctccaagtctctgttgggtctccatggaatgctcccaagggcagggcactcacacagcacctaattcatttttgagagctccgattattacactggactcagattggacttctttattcggaaactgaggcccaagtgcaggatggatctgggctaggaatgcaggactctagactgtatgttgctacctgtttctggggttgggttgcctggatgcatgctagcttggcctaaccatccccagttcccttacactgtagacccctggaagaaaagaggaggtgggattcctttcagggaagtgtgcagaagggtcgtcccaaccccagcaaccccagagtcccttgccgttgatcggtcctagctggggaagggtgagtgtgtttcctcctccctgccctggctcctcactgtcatcctcacccgcctgtgaagggtacaggggctggtgcccagagtgtcctcacaggccggctcaggccagcatccccttcccttccggaggagacagatcctcagggtcacgctgaggggggctgggcctttcttgtaccaagtcctcccagcataaagaattcagcaggcttcctcggagggcataaatatttaatggcgttgtagttatatataatttgatcaatatgtcagtgctaaaagggcctttaagaaggctcacctgtcattgagtgatctgtgatgtgaaccttcaccagcccctccagtagcgggaggggctacatttcccaaggctgctgcatagatcatttgttgaccctcctccccttcttacattgtagcactgcttcccctcagagcccatggcgtggatggagcagggcctgagaaccccaccccagcttttgttggctgtcccccggcccccccatggatttcttcctctgttgataaaacacccacttgttttatttcagtgttctctgagctcggcctaaggagaaactacctggcaaggactatcctcttttagtcacatcattgagaggctatccatttagtattgcctaggaaatgcaatgggatattttaagttaaaattgcccagacgtggtattctgaatctgggtgattggcgcctggctgctgggaggctgctgggaaggttggggccagggccacctctttctgcacagcctcccaccccagcctttccctgcagctctgggatttaaatcaagatgaagcagactctcttcaaactccaaggactcagtcagagaagtaggtaaaacctgattaaaatttaagaacctcagagctgactgagatgacacccccaaacacacacattttctagaggagtaacctgagacccagaggcctgctgggatgaaaatcgtcacttccccatggctttgcaatgtaattcacctttcaaatgggcaggtcccttcctcatctcatctttcacacacatccgcaaactggtctcagactcacagtaccatgctctttgcatgacactgccctgattttccgaagaagaaatcctcatttcacaaatgtaactagaagcctagtagcatgggatggccgcttgcctgtctcacagacgtggaattacttcccgctgaatgcaacaacttggagaaccctggcctggttgtcttagcctcaccaaccagtcttcccttttgaatcacagaaactgcacagtaggggcttgacacttagaagtatgatatcattgttcttgcctagaggctcttccacagtgaagcgcagttttgctgatggacagatttgaatggctcgtgctctgaagactggtccttgggacccagcccaggtcagccagctgcccagcaaccagccagcatccatccacatctcaaggtggcttggctcttctctgctggtcttttgtaaattcatgtgatgctctgttttatggaggaaatgataagctgcacgccaattcgggaatatttagggttctaaaactctaaattagggctcctggatcttatacgttatctagttaatcccttcattttgcagacaacgaaattaatgcctagagaagggaagtgatttgcccaaagccacacaactaaatggaggcagaattggaggtagaagccagctcatctctgcgtggcgttggagcataacacactctttgaaggggcagttttctcttctccttgcctttatttggctgaggttaaaaggaattgtgcattcagagtccacaggtacacacgacagggcagtttaaaactaactagcagacagactctctggtggaagtagctctcgacggtgtgttggacacagtcacctaaattaaaaataagggcaaggactggctgggtgctgcaagcccaggagcaggaggttgctggggggtacagatcaagagcaggctccgtttcccttaatttagtgtcttgggtcaagggccaaggatagtctgaagtagcagcaaacgtgaatactagactgtggttagagaaatagacttttagaatgctcaagtaccctcggtttacagcaagatgttcagaggtcctgctttaatgaggagatgatcatgcaaatgggagctactaaggcgcatggaacagattgctgtttgggaaattacacttgccccccactatcttgttttctgtcatttatttgcctaacaatcttgacagagatgcagggcagatgttactcccagcgcccagttggtagtgcagattccggatgtagcaggacctctgtccccatttctctgaactgcttctctgtctgtatctagtagattagttccttctgaggaacaatgtttttccaccaacaaagcgcctgctttgaaccatacttgaaaagaaactttcaaaggcggcaccagcctccctgaacaccttttccaaagtgctttccaaagggagccatcttcccacctcccaccacctctcagattcgcttctgaagacctggctcaaaagcagtggctttgtgggaccgagatggagggaaggatggaggtcggcctctggaaactacagccgccttatcgataacggattgcgccaagttgccaaaaggagttttccaacatacgatcgagttccagtttgtgatttgtgacctgtcccaattgttgaagtcacacttgattttttttttttttttccttttttggaactgatgtttagagcttgtttgagttggatccaatgctgttttaacagctgttctaatcagaagtgctgtcaattattaaccttaatggtggtttttctttcaaaaatatttctctaagctctcttgaaatgtcaaaatttggcttcttggtaggaagtcatttagtgaaatcacttaatggctgggcatcagtttccccatctgaaaagtggagatgttgacaagcgccttctccgcggggttattgtggatgcacacatggcgagttgggtgggtgatatcagcggtcattactgttgttaggagggcttctgttaagccagctttccatttccaggaacttcccctcccccaagcgccaccctccaaaaaataaacatttctttaaaatgttgagcgaacagctttcctgttcatgctttgactctgcagagtgcacgcagcccattctcagggttgggcagcctttgtagagatgggggaggcccaatccctgcttccactttgtggggagaccccaagagggtactagcagatgatggcacagtgacagctgggagggatgggatgtgcttgcttcatgtccctttcccaaggggggacaggagagccaacctccaaggctccttcctcagtgcaagatcagatgccagggcttgtcagacggagggtccgctaacaacaatcttgggtacaacagagagtgaaacgaagatttttccctgacaggtgtgggggccagtgggcaaggccccacctgacccccgtccctatcacagctcatcacctctgnnnnnnnnnnnnnnnnnnnncctttgtgctgcctcaaccctacacagtcctgtctggtgacgtgccaaagtccttcctgccttgcagagaggcctctcttcgtcgaacatgggcctcaggaaagacagcctgaatgccactaccccaggcttgtggaaggttctgcatctgtgtggcattgttgcgatagccctcagttgatgcttgtttgtggtgttgggaggcaggaactactttaggagggtggaggggtgagaatgagagaggacttgccctgagccacccagctgtggtcacctgatggcccggatggctacataaatcctgggagatccgttgtcctcataaccagagtgagctgggctccagaccagccctatgggaagatcctgtctgtgggaagcctttggccacgtgtttgctgaagggtgtggggaagggcaaggtcagctacgtttcttttttgtcaactcccgagaccctgacccttggcctgtttaccagtggaaggaggccatagccagaacccttttataatcaccctgcctccctgctctcccagagactgtgagagttaatagttgctgaggaggccagaatgactggggatgttctgaccttgcccctgccttcctggctgtggggaggagtagtggccagggacccatctaggtggcttgcgattggcctggcttggaggtgccaccccaccccgttggtgaagggcttgggccactggccaccaagtgtatgtcaacactccatccaccacggcccctcccacagatgctgcccatgctggggcaggcccagatccacagcaaggggtcactgcaatatgaagtctcaataaatgcagagatgccagtgatactattctttgggccaaacatttacggagcagctactgtgtgccagacactgctctattgttgtttaagataacaggccttggacctgtgagcttcctaaacagtaaggttggttttttttgtttatttttgtttgctttttgttttttacatatctttctattcttatttggtgcatgaactcaaaggtgagagaacttgttactctgccggtttggagtgagctgcagcctatgcttgtttctagaactcctgccctatccaacccggacttttttgcttcattccccattcctactatcagttgatttaggcgaggaaaaaataagcagagtgaggaaggaccctgtttgggagagctcttcccacttaactagattaacaatttatataatgattatttagtaatcctcctgggttccttagagtatgaatgacgggtgtctagtgggtggagaggccagggatgcttttaaaagccctgcagtgcacagaacgggctccacacagcagtgaattatctgacctcagatgtcaatagcatggtgtttgagaaaccctgatgtatggtgtcctggctagagtgccccacacatgtgtcaatgtggagtcccagtgggtctgagctgggcagtttggaagtgggggccattgttgacacagttggcctgggatatgagcgacagtcctttataacaggaattgtctctccccaaatgccaacagtggtgctggctgggaaacactgactctgttcctgaggagctagagtgttctaggcagaaagctgacagcagtgattcctgatcctctccctgccaggaacccccactgtagcggacaggctccgtaggttggcgagccctgccaccgtggctggcagcccaggacacaggcctgcaaaaacccataaggctctttagttgatggcctgcctttccacaaaccagaggcgtcctctttagtggccaagggtggagggggtggagggtgttagcccaaggaattctcccgaggtccagggtctatttatgcgccttcagattgtttttattttaagtgcacaaggatttctcatccagaatcatttgacatgcagatgatcacagatttttaaaggctgttgtcatggttttgtctctgaaagattgctatgtgctgatgaaagctttgaagccagctttgggacctcagtcctggcgggctcaggattcagaatgagataagaaaagcaattctgagagtcgtctgtcagtggttctaggcctttctatctggactcagttaacccgtatagcaccactcttgatctgagatctaaagtttacataggatgctggtggaaactgttgactttctaaatgcagtcttttctagggtgttgggagatgaggcagagaattgatctacctttctaagattgacttctgtgagggattagggatctaatgaattacatctctgagcagcttcttagacaaggcaatgctatatcctaaaaaatgaagtgttggctgggcatggtggctcctgtctgtagtcccagccctttgggaggccaaggtgggcagatcacttgagcccaggagtttgaaaccagcctggacaacgtggcgaaacccagtctctacaaaaatacaaaaattagctgggagtggcagtgcacctatagtcacagatatttgggaggctgaggcaggagaatcacctgagcccaggaagtcgaggctgcagtgagccaaaatcataccactgtacaccagcctgggtgacagtgagaccctgtcttaatgggaaagaaaaaaaaagaaagaaggcttaatggtaggattttagcctggtagcatatatgtgggggagggattgatcttggtgagggagaggctagtcccagggaaccctttgccacataggaccgcttatcagcttagtcccatttatctgagagctcatgtcctattggcactgggcaccagtgggcagagcaattcctctctcactaaactgtgtttcactcttacagtgggttttgctgggttgttgggggtgatttttatttcgttttgctttaattagggattccatccagaggatgcaaactatattctgaaccagacatgtagactacctctgatggaaattggagctccctaaaatgtaggcagcctggctgcaagggagttgaaagagatttcttcatgctgtggatttagctagagcctcctggtaggaggctgactgagggcagaaaggatggagccccgtggagaggggctgtggtctggggggagtttgcatttccacttgcctatgacatttcagtgacttgatttatttgcctgagcttcatgtggtctccttgcctttgcagacagagattgcgaagagactgaacacaattttagcacagatcatgcctttcctgtcacaagaggtaagaccttcttttattatttcttccttttctttccaaatcagcccagtggctggtggggtctcactggagcctgagccccagccccagccccagcctcagcccctgtccattcatactgactgagctgacaacctggagatttccagagccttctccggccagtctggaggcagggggccatatcagagggaccatttgctccttcttctcatagaattgtttctctgccatcacctgagtccagagattggagtgctggcatgcgacctaaccatcagtgggcagtgggtgcctctttcccatccaaactagcatccccagcccaaagtggacctcagttcctggtacagagtgcccttgctgggagcatgacccaggtggtcatgtcactttctacgcctaccttccaagggacctccatttgggacagcggctggactagtgggtgatttgagataaatgcctgcaaagaagccccctggtgccgaccagacagacgggccgactttagtgggctctgtttctgtcctctgatttcactccagccagggcaggccctgccctctactcccactcagtggctgggaccatgtcagctccctcagggactcctaatggtgacctgagtaaatgattgaattaatatataagaatcagatatggcaatgccctcggagcttgcagcccagtaggagagaaagctgtgtatgtggctggtactacctcaaggccaaagggaattaatgcaaccactttttaaaatagactttatttttttaagagcagttttaggttcacagagatttcccatatcctccccactatcaacatcctcaccagagtggtacatttgttgaaactgatgaatctacattgacacatcatcacccaaagtccgtagtttacattagggttcattttaccactttttctttctctatctgttcatctggaaacatactttgttttctctctatttagacaggtatggataaggtatatgtagacatactttttccccaaatcctttgacggtaaattgcagatatcctgacaattcaccactaactactataactgcatctcctaaaaacggataccatccttcatgattacagtattgttaccatgtttagagaattaataatcatcctgtaatatcatctgatatccagctcatacgcaaattgcatggaaaaatttgtgtgtgtgtggttgactaatagccatcttttggcatgctctttgttttagaacttaaaaggaagtttcaattacaaaactaatacatgctcattgaaaaaggtctaaaagagaaagtaaaatcgcctgtcaccctcccccctacttgtgccctgtgcctgttcagtgggactcctctgtctgctctgggcctctccgagaggccctgccagtgctgcacagcctgtgacctcctctgtccaggaaagtggctgcatctaacgcacaccctcttccctccagcaccagcagcaggtggcgcaggcagtggagcgcgccaagcaggtcaccatgacggagctgaacgccatcatcggggtacgtggactccccaatctgcctcttaccgtgtgtatagcccttttattcctctcatttatcataaccagagattgaccctgaccttagctggcctcaaagaatggcggccccagggctccggcttctacaagcaccccaagggcttggacccatgtagggctgtttcccccttggctcccagttgcctcctagtcctcaaactaaaggggagccagacacgcctcaaatccacctcttcagccatctgcctcatcttccactggcttttggtgtccttgccattgaggagggtgggggcctagggtcaccttcaaggccaggccagctggccagtacctggccacctcctcacacttaccccggggcctgtctgcctcctccctggcagaagtctgcccttctttggccacctgggatcagaacagtctctgctgtactgttgatgtgcatcgtgctgtggaatttgggtttacgtcttgctgtcccatgcgcgaagctgcctggctgagcattcatcatgtacgcttgtgaactccagctggggagctgagactggttttcctgactttctagaagtcccgtctcccctttacacaggaagacatacccaagagtgctctgtgaggcccacttccggactggccccttagtggaaaagggaagctgggtctacctggcttgtatctttaatgcatttcttaggttcaagtggcatctttctcctgcttgctgctttggtgtgaggctagtgacatttaagataagcacctgaggaagaagagtctttttagtgtgactttgggcaaggctcttacccttggggtgtacctgtccacctttcatctctgaaatgaagagggtggacaggatcactgcttcccagtccacggaggagcttctggacggtacagatacaggggcacttgccccagaggtcttttccataggtctggggatgggactggaaatctgtgttcctaacgatttctagatcattctgaagtgtagttaggcttgggaagcagtagactgattcaactctaacattctgggaacctggttggtcttctttcctctttctgttctcgtgggaagtcactatttcaaggtggaactgaaggccccacaattttcctctgcttggtaggatacatgatgactcttgacttttccgcctggggcagagacctggaggtctgtgttttagtcatggttctcccccgatgtgacctttggcaagtcccttctcttccttgggcctcagtttctgtatctgtaaagggagaacgtacaccggctcatctctttgggcactcctgactcctaccaggaatgctgggaggctggaatcacagaatgacacttatggacaccggcccttccatcacactgtcaggacccgtgatggttgcagagtcctttgatgaaggcagcacagtgggtttgtccttctgggctgagcccatagggacacttctcagtgctgcttgggcaggtgggggatgcaagcattggcctggtttgaatcctggcctactgtgtggaatgggcagagaggagtcttgaaactggaacgtgaagaagtgttcagtgctggaaggcagcaccccaagaggggaaatcatgatattttaatgtttaaagtatcatcagagatcatctagcccggggatcgtcaaccttgacactgttgaaatttggggccagatcattctttgccatcctgtgcattgtgggatgttcagcagcatccttggcctgtagccactagatgtcaataacaccctgacaccctgatattcataggaggcaaaatggcccttggttaagaacctctgatctagctcaatgcccttgttttacagagaggggaagtgattatgatgtttaggaggaaagccaggccagaggcccaggtggctgactcgcagcccagggctcttcccctggccctggtgcagccctggagggtggcctgtgtcatctgtctcagtgaccagctctcagcttggtggtggttctgctagtggtagcagggggctgcagggttgggacataccttgtgaattctgttttccgacatttctcctcttccagctcctcaccccatcccctttcaaccatcttcttgaggtttccaggccaactcctcctacccctgcggtggccacagcagggtcccctctcaccctctgcccccctctttggaattaaaatcctcttatgaaaataattttttttaagttttaagaaaggagtaaaactgggggagaagcactgcttggattagctgtatttcccttaagtagtattcaggaagctacaagttaggtcgaggcagctcgaggcagacattggaattcaattaaagccaacgagtggggcctgtgacccccattttcaaggtaattgcttctccagctccaagtgaatgcagccatcgccctgtcattaagcaggcagccgtctaatcgctgcgcctgacagagcctcacaaggcaggaattacggacagccgagtcgtgctcgcactggggagccgtgcttgactgcactcccgcgaaggagtccgctaatctagtcagggcgttctttatctcctcctcgaggagagcagagagcgagcctgcagctgagctgcctctgggaagcaaggtgaagaaggataacggggtgcagagccatgggctgagcaaaagggcaggcatcctggccccagcaggaaagggcaggagagagagggtcccaagaggctcttggcagctttcagtggctacccccactgcactgttggatttgctgctctggaaggagacacagcctggcatcctggtcttggacttagaggagggctttgggcaagtcactttgttcctccaggcctcagtttctccatctgccctaattgtttagtggctctcttgctcattggatttgaaagattctgaggttgtggctcggctcaactcaactcaaagagaaatcagatacctccggcatgggcagggaggtagctggtggcatatttatcatgaggattagagtattcctggggtcttccttcctggtgagaaagggcaggatccaaggtcagggtggcatgtgtgaaaaggggaaggaaagacagacagagggaaccaggctctcaagccaagcctacccactcccctgctggaccacagggaactcaagtgtctaccgagggaagagaagtggaagattgtctctcttctagctggggcctggcaagacttggttacagtagccctgtttctgttacatgcttcttggatccaattaacaggaggggctttagaaggacaagattcctgagcacgaggagggaaatttgacacttggtcagcaacctgcagaaggcagcatctatatttcccaagcagatttaagaccctttgagccgatatatcacccatttctggaaccctcttgttacattgctatatcatggcccaagatctttggactggaaagtggaggaggtctcatctgcttacctactgacaatttggtcttcattcccttggaaattaacagtaggggagatgtcacagagcattgacttgattttttttttaagtgggagggaggagaggaagagggacgttgtagcttgtcacaaaatacacaggatattttgaagccatacctaaggtattcactccaggatgtggatgagctgcattcagttgactgaattttgtgtgaggggaaaggatggccaagagaatgtgccttaggatccgtctttcagccaggcagccatggtggaaggaggtaacgctgagtttgagtctgggctctggttgctgatggcttcatggagctgttcagcctcccgagcctgttcaccatctctgaagtggggatcacaagggttgttgtgagcactaaaagctattaccaaccccagaagctcaatgcgtgtggagctatggtgcccactgagtgatgtgaaagagaaggagcagtcggaggcctggagctgttctcgctgtccttggagggcaggaagtgttcattttacgctgtcaggaccctgtctgactcctctggtgggagcccttggcgggtcttggctctggaaatgcttagacaacttcactacgttcaacccaaatcatgaacctgagaaacgcagcattaaatcacctagcgaaggcctaaggcgtgatgtgcataatccaattacacgtactctgcaagcaagatcttcccttcaacctctcctggaagtgactgcaccttctgagccaggccatgggtgcttatcacttgtgtggagtacatgttcgttgtcctatttgtgctctggcaggaaatgttcaaggagggaaaagtgaacgcccatgcatgggcttggttccaggctcctagcgcctctttggggttagggatgcaagagggaattattgacttcctttcatattgtggatggaggagttcccatattggaaggaatggtataagctggagacaggcggtctctgattgtggaattgattccatttctctgccatggggaaagctacccagttgaaaacagtatcagcctcccactcagacatcactgtgtttgagcacattgtgctctgaagccagcagacgtgttgcaggggataggaatacagcctgaggatagctgtgcccgcctgcctgcagaggtgctgagctgtgatagggacgggggtcaggtggggccttgcccactggcccccacacctgtcagggaaaaatcttcgtttcactctctgttgtacccaagattgttgttagcggaccctccgtctgacaagccctggcatctgctcttgcactgaggaaggagccttggaggttggctctcctgtccctgcttcccagagtctgctggaccggtccttgctgtgccttcaaaccaccccaaggagacctcgagggagtttctggctctttgcagcaggttgctcttgcactcagagatgaggaacgcttcagttttgcatgggagattccttttctcttttgcaaagaggacgctcctacctgacaacactaaggcagaaaaccagcctctcagccttggaagcttaacagctttgaaagccactgtctgccaaacagccgctgctgcctttgttccaagtttctgacgtcggttcactggttcatgttttgggcaagcaggacacctcatgaccccattgatgcttcctgtcccaactaactgttctagctgcgtctaattgggccttggaaggaaggcatggagctgggaggcggttggcacctgtggacaccatttctcagcctcttcatataccttttccaaaattttcactaatttacccacaagacatgtactgagcaaacatgccaggcactgttagaggtgctaggatggagaagacacagtctctgtttctggaactcacaggttgccaagcagtgcacaaaggcaaaagaaacagtgtacacctgggatctgtctgtttgctaagattgagcacctgctccatttttacctgtagtcacacatgtgatcctggcacaacacagagaggtcggctgacttgtccaaggactcatagctgataaaggatagagctggaagtctgccttattctgcctggctccattgtctgtgccgttagagctcttagaacagagaaatccattctgacctgaagtgggagggcattcagaggatatggcctttgaactgggcaaagctgagcctagaaggttgggtaggagaagagacctttcctggtaagataagagtcagggtgcgtggagctattcaactccatcttgccttgggtacaaatgttcagtgcacattttctctagaaacagacttgttcatgaaaggagttagctgtgtctgcaggcagcaaagctacttctttgaagccttctttcccctcctcttctttgtctcttcctcaagggatcttattggctctgcactataaaatgtggattaaataccttgctttcagtccttgctttctgggattttactaaatagttatcaccagcagaattaacgggcctaccaacaatttgtctaaacaaaggggccctactggagactcattttaaaaccaggtatccagataaagttgtattgtccgaccacaccagggaatactaggtagccattaaaaaggacaagaaaatttcttcagaacattcctaaattaaaatcaagctgtatagcagtatggttcacaggagtccatttctgtataaatacatttgaaatgtgtagattttcataaagaaaaacctaggcagatttaacagtagaatcttccgagggtaggattgaagggtaattttaaaaactttttaatgtctacttatttttagtattttcttaaaatgggcatgtattagttttgtaataagatattaaaaattacattttcttaaaaaagaaaaagtggaggagctcagagtaagcgcccatcctagaggagctggagtttcttagctgggaggggttggatctccgcattggactctgtgatgctggctccaggggcccccatagctttgtgtctgccatagtgtctcagtgcagatgtggggtcagaccaccctgggacagtgcccatgaactgcctagcaacagacgtcacagaagtgctctgacagctttgaacaacggccgcagtgccagcctttcacccagaactgacaaagggagccctctggggccaggagtgccatggcttctgtggctgccgttaactttgggatgaggccaggtgggcagtttgcagcttagctgggggagagtagggccctttatccataacctgaaatgcttactgcctcctcctgccagagccatgggccttcactgtgttctgttatctgttcgcggttgccagaaaaccatctcatattgacaggcgagctcccttagtaaggtgtgagatctggaagcttctcagatctattctctatggcactttccaccaacccctcttgctttggggatcttcttaggaatgagcattctttggatgaggggtggtggttgacagatttactagtggtgggatttggccaattactagctacctactccagccccctaagcatctattaaatggccacaacccctcccttgccaggtggttggaaggtgcccaggcattcattcaggcattcagtaaatgttagttttcttctcttgcactagttgagaagaaagatgtgtgcataggtggataccagcatacctaacttctctttcagtagtggagaagaagttgggtggggcgaagggagaggaaagagaagcccaagcccctgaggctagtgttgagtggggaagttgggcctctggagccagggcagcggagtccttgactggggaggagacagggagaattgcattgttgttgataatactgacttgctgcatggcaagtttttagaagggttcagcaatccattttaaactctttgtaaatgttagctactgccatgaggcttagtagctgtgcgccatgagctgctgcaaacattatcttacaataatcctctggggtctgctgctttccccctttacagataaggaaatttgaggctccaggacttgaagtaacctgccccaggccacacagctaggaagtgccagagctgggatttcaatcctgttctgtctagttccaaagcctccactcttccagttaccccgttttccaccactgatgtccggtgacgttagctctcattccactggcccccagctcatctggctctggggcctttgctgtgatgacctgccctgcccctgctctgtaaggcaggcttggagttcctaagaaataaggagccttccccagggtccagcctcagggtggaagatgctggcagctaatgctgaaggcatgtatgcatgagcaaacactgccaggactgtgagcttaaaaatggatccctctctactcagagggaaccccatgactctgcggttttttaaatgcatgcattatttatctcaggcttggaaacaaacattgagaaattatttgtgaaacgggggtgcagggagttggggggtgcttgaagacataaatctttacattacagtctattaacagacttccttcagcgagacattcatgtgaactgagctgggggcaaaggttttgggggtgcttccccctgccacccacccagtgaaggagcaagaggaatgggaagagccactccctccctccctcctgaggtggccacgcctcccctgccctccccaactcagctgtactcaccaccgacttcattgcagcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagaggtgcggctgggctggggcagagggtggggcggggcaggggtgggcatgggcgctcataggcctcacagtgagtggacccagcaagtgctgtcgtcctaagaccaggagttaccaaggatttggagtcatctgttgatacctggtgcagggaagccagtgccatccgcatcccatgcaccttttcctactccttggtgtggacctggtattctctgtcctgaagaccctgtctgttcatctggagctcgctcccatcttcctacaacacccttgcctgtccttcaggggccagccccagtccaacccttcaggatgccttcctggtcagactaggggctttttcaagttcctgtaagagtttaagagttgggatgccaaagctgagtccttgttactgtcgtcttacatcctacccctggaaaatgtcttgtgctcaccacgatcattagttccctaggacaggtgccaagttcttgggtgttttccttacatctatgtctcaccaatgcagaaacctgggaaaggtgcacagtcagtgctcaggtaaaggtttgttagctggctgcctgtaagtgggggtagtgcacaccccagcaagagatcacatagacttggagtcagaacttgttctctgaccctctctgcagcccctaccatgaggacccatgaagctgcaccgagcttggcctcaggagtggttcattggatcagaaaagagaaaagcctggctccctgggaggcccttttcaaaaattggtgccaaatgcactctgcccttagatacggtatttactggggcacgtagccaacaccttctgagcactagggacctggaatgtcaccatcctgccttggcccaggccacagggtggtagccggtccagggaactggaggctacatttttttgtcttacagtaggatggtccttttggcagaggaagaggggcctctccatagcagacaggagaactggggagctagtgcttagctgggcacagtttcagaggcttcagcttttaggggcatcctgacaaagaatcacagaatggtgttaatttcaaaaacaaaattaaaccactgttaaattcctttttttttttttttttttaacaataaagttcttaactcccaggtcctactggtattttatatggcatgatccttctcaagcttgtgatcttaagacccctagcctgctaaagagtaaacttggtgccctctggcatgacagggagaactgggtcaaaggcctaccctccccaccctggggactgggcctcccttgcccaccctggggactagaggggtgggggcagcattggaatttgggtggcaaatttccaaaccgagaaacgccacctaatggccctgccttggctgatccacggagacagcaatccaggccttctgctcattttaaaaccagtgcactagcaaatcacaaaagccagctggacttagactgacctttttcctttcttttttgtctttttgttttggggtgcctgaccttcctcctgtcctggccttctttccccaaagagagagaatccagtgcggtaagtgttggcactctggaacccggaggggtgtttgggtgctgggaggaggtgggactcggggctcccagaatcgcgggcctgagaccagtcagtcggtatccaaagctggcttctgggttcccgcttctgctctgtgggttgtaactagggattttgttgtttgtttactcttgctgagctgggagcttcagtgctgatgtcttagtccagagccagtggcagggtgaggggtagctactgtcataaaatgggagctgctgtcgtcacctgttgagagtgaccttcagttgtggaagcccttcctctctccaggctttaggtctgccatttgtcaaatgaagagcttgggctaaatgagctctaactccgtttcatatgagaggtgatactctgagaggtcagctgaccagccctggatcttccattgcgaggggctttgtggagtctctgggctaaacccagggctaaggacccaggtgtcccatgttcagggccaaggtttttaccacccccctgctaggatgcctcctgtatgatcttgcatcctcctcattcccttcaaacgcctgcagtttctccctgctctgggctttcactcgatttaagaaagtgctagcaggcgagcattaaggccaggccgcctgcgtgtctgccagctctgagatttgttgtaaatctttctgatcacactgaggctccgaggttctgtttcaagtgaataagccttctgaataagcgcagtggagtctggataaaaaaaatcctccagcgattagcaaagctattttattcctcatcgctgtccttgtatctggggccatctaatctgttaggatggctttggttattacctcgtgttaagtaggacttggaaggtcaggcagttaactaaccatctagacagcagcttccttgcgcagctctctccaatccagccctccttcccttcctggccctccccctacccaggctgactttttaaacctcccattagcagtgaggctggcgtccgtggcctcttgacccgcctacatgctcagaaatccaggaccacatttgggctgaggaatggctaggtacctaagagaggagtcattgaagctgaaaatccatgttcactgcctcggtactgatcctctaacagtggcattttttcggagaggcagtttgcctagataggcggaggcctggattggacattttaaggctgaggtctggtcccagctttatgaggccctgtgtagttctcttggcctctctgagcctcagtttccttatccataccatgggaataattcctgcttgaccaacctctcagctttgtttcggaagaccctttataacctgactgaggatccagattacctggctagcagggacccacttcagtggaattggagggggagtgggaagcccagcactctctaaagagcatgagtctttacctcatcctcatccctattggcttctggctttgtgccccatctgtgaaagttttctgctaaaagaccccccctgggaacccccaagagctgggctgtttaccatgctcgctgaggtccatgcatggcacacatgggcctcaggaaactccagtgggaatgaatcaagatgctgggcagaggcagcagtgggcagggccgaggctgtgcgcatggcatgtggcgtggtgacggtgtcagcggcggtgtagactgaaataatcaggctttggaaaccaggttgtcaacagatgaggcctacggcaggaaggacagggctgtgtcagagtgggaggggggatggggggacgggctggaagctgtcccagaggggttagtctggagtccaattagtggtagcttcattcatatttccttgcctagccgaagcaataaaaaatacttagttttttggccgcctgccagccagaggcgggctggatcgatgccgctaaatgcctgacatgactctccggtagcggcgagggttttcagcctgactgcatgagaagaaagagctcgctgttctcccgagccgagcaccgggtcgcgaggagaaacacgagcagccgcacgccccctcccctgcccgcccgcctgcaaggggcagccagtgcgaggggctggaagcatttctgcttagcacagggtggccaccaccgtcagaggaaatgaaatgaaatgacggtgatttttctgccggcgattgcagcagctaattgaattgtggctgtgcgcgcatcgccaccgctcctgcacggctgtggggaaggttgagctgcagttccattataacctccattttttcttcaaggcttgataactctgccattttaatttgcttcgggcagaaacttggccgggtagggctgcccagaacccggcttaggaaaggaaattaagttctgaggctggttgccgcactattcccaccgaatactgcccagccccgttccctccaagtggcccttgcccctgagccacgcttggcctctgggaaagtggagaagagaagggaagcctcattccacttgccttctgatgctcttctcttctgaacagatgtccctctgggtctccatatgacctcctgtgttgcatggggactgggacctgggatggcctgtccttttcttccagctccatcatagctggaccatgagctcctggagggcagggattgtatctcattcattctgccactcctggcctgcagcaccagggctgacccagggcagctgctcggaaattggtgggtgggtgaaggtaaagtttggactcttagaaaggagtaaacctcaccaatatcatagaggggcattggtcctgatattagtctctgggcacagaggtttgctggcaggtgcccttgccagttgcacttccctccctgctccccagctcggtggtaacagccacatggtgatttctgaccactatcaacccctaggactactccgtcatcttccctcttcccaggcctcccatcccaaaggcttctcatcctcatttgctttatagttgagggagaactcacgaaattttggggttccctttgtgccaccttctgctaggggagcttgggcacattcaccaacctcttggggtctccacttggtgatggctacagaggcagtgactgtccctgcccttgctcctttccctgtctgtcagagggaaaggcttcatgacgtggcatttttgttttttttacaaccctggtgtttctccagagttgctgacagcctcaccgtggaggcgggggtgttcacacagaacgcttggctgctcatctccactgggaagttggtggctgcctgacgccctccttccctatcaatctccccattcctgtcgggctcagcaaatgaagtattgctcatggcccctgcctgtcagctcagatccatcttacaagactcagtgcaaattccacttatccctcctttgagcaaatgagtgtggcaagcgcgagatgggtggtgaatgagacccaggtgaccctcgccctcacagagcgtagtcccacaggccagaaggcagacggcttactgcagggttaattatttaatagcagtgcagagctgcaaaagagaattggggatgcgcccagggcatctccccggggactcagtctcaggggagtggggaaggcttccctggcaaggctctgatggagccacgatctgcagggcagagaggagttcagcttctcttccctcccctgacctccgtgtcacctgcacttagctgtgtgcggatgtgtgaattgttacacgcagcagaaagttttaaccccgaaccctctttttccttccagaataactctgtgtcaccctcggaaagcctccgggccagtgagaagcaccggggctctgcggactacagcatggaagccaagaagcggaaggcggaggagaaggacagcttgagccgatacgtacgtccaaggcgccatggcaccactggggtttctgttgggtagggcagggggtgtctgcagggcccaagctgtggccagggtcttcttgtggttggcagtgagtcagagaagcacaggttggcgataggggaccctattgaggagagcagggtgggaacagggctagggtgaagttcacacacgctatgagcatgcgagccactgtggggcggaggtggatggggaggtcgtcctagcctccatggggtctcttcccacagacaggccaacaaccccatgctgctgtcatggtgctgccggaatcccacttggctctaaggggctgctcccagtgacccccaaaatgtggaccctatagtcctctcagttggcctgaggcatgcactcacttggccacccagtcatggcttttactagccttttaatgggatgcccccggcacgtgagaccctagtggaagcatggctgttgtgtttcccctgtgtcaggctgtgcagggctgagagctgggacagagggaaggggaggatatggtgcagggcctcagcggtcttgcacccagccctcttcagccacatggctgctgtgtggctttggacacattgagcacccaaaggacactcagctgtgtttctgtgagaggaggcaagttaccatcccacacagacgggtgggaatgaccaggtgagagcagcacactgactgtgaaggatggtggatgtaaaaccagctgggaagaaggttctggcttcagagagaagcagaagggcaggctgtgggggcaggggcttagaactgctatgatggagcgggtgtcagtgcggctgcccagtgggtacaggagtggagtaacccggggcctgggctaggggacagcctcacggggagaccgtgttgagctggagtggagcctgttgaagggcagggctggagtagaaagcatggactttggggtttggcctggcttcaggtcctggccagtagaaggacagggtggtttgggctcagtcaggggtggggaaagtgtggcctcttactgaccagttggcttctctcttggttgcaggacagtgatggggacaagagtgatgatctggtggtggatgtttccaatgaggtatgggcaggcccggtcgcaagggggctcttggtttggcatggtttggaattattcctccccagggtgggatctattctgtctgttctagtattactggcagcctgagcagggagacaaggcctccagtcttggggtctcagggggtcaagaggagcagggcagggctttgctgcatggtgtctgggcatttatgggcctggagggcctcctgcaatgggtctccagagagacacccccaaagatcccaggtaggggccatcttctattccccgtgatcctccgtccccccagggtctcagcctcaggggcctgaggaggagctggagagcatctacatttggccaaacccagccatgctgattgaagtcctgaacttgtgtttgacattgggaagaccatccttccaccctccctaggcctcagtcagaccagatggttaagagctagtttttcctcactgtggggcccccagtctttcagccaagctcgtcttcccatcgcccatgccctctctcttcccactcccagagcagggaagcctcgaggctggctgttgctttcagtgcatctctgcatcacttgtgttttcaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcatgtatgtggggtctgggtggaagggagtgggaagggagcggcagggactggagctggggtggtgccgattggcaggcagaggggtggagtgggagaagctgggtgggtgattggccccggtttaccttctgtgcctgctgggcctgtgctaatgagttaacgtttctgagcctcggttgctacgtctgtaaaatgggagtgatcaccccagtccctgccaaacaaggttgggcaaggattgagaggctgttcggcagaagcttcataagggtctggctctgggcttcacgttgggaccggcaccagttgtgcccggctcctaggagaatggaagcctcatggcctcccttgttctgcatctcccctcttcagaacgacaaatcctccacccctgggctcaagtccaacacaccaaccccaaggaacgacgccccaactccaggcaccagcacgaccccagggctcaggtcgatgccgggtaaacctccgggcatggacccgataggtataatgggtaggcaccatgggctgggttaatctgattggggggagggggtctgctcttggccagggcaggggtgacacacacgcatgggatagagcacaggcagtgtctcccagggcctgcccctggggacttcacggtcagatttgaggaggtgacaccagggtttctgggacccctgctgggccagacatgaaagcagcatcagacgggtcagggctcccaaaatctgttcccacccctgtcattagtccagtgaggctctaagcaagcccatttgggcctccatatcctgctctgtaaaaagaggtgggtgcatctgccaagctctaagcttctttggctctgaaggcagggatcccacttgggtgggttcagtctgagaggactgcctggagcaggcagcttaagaatgcagggagggttattgctgggtgaggcggccatggccatgtcccaatccacctaaggcccacctccctgacgcccacccctcgcagcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgtacgtagaccttttggctcctttcttggggactgggcgtggtgtggggagccagtggttggacgggtgctccccacatgctaaaggggcccctcagggtctcaaggccaggcagctgcccctgtgggaaggtgtatcggaaacaattgagacttggctggaagggtacactctttggggccagcagacctgagttccatcccccactggcctgtgagccgccctgtgacctcatgcaaggcagcctcccttttagtctgcaaaacggggctgacacctggctttcccagctctggggggtaggaatcccagggcgagtcaggtgatgtccatggagcaggggtctcgtagatgggactggttgtacaagactttctattgtggtgaataaataataagagttaggggtcgagcgcagtggctcacgcctgtaatcccagcactttgggaggccaaggcgggtggatcacctggggtcaggaaatcgagaccagcctggccagccaacgtggtgaaacctcatctctactaaaaatacaaaaattagccgggcgtggtggcaggcgctattcgggaggtgaaggcaggagactcacttgaacctgggaggcagaggttgcagtgagccaagattgcaccaccgcgctccagcttgggcggcagagcgagactccatctcaaaaaaataaaaataaaaagaagagttagggttggcggggagaggggccctttttcaggagacagttttcctttttacctcctggacctggggtggcctcctctccactggcaggcccactaggaccacaggagaggaaagaagtagggcagggccagctctgccttgcagaacagggaggatgctggttcacagtggggtctgcactgtcaccccttccctgccacgggctgtcctgggcctgtgtctcctctgaatcaatgggctctgctctgctcagcttgtctcttgggttacaaagtggcagagccgtgcaggtaggaccccgggtgggtggtggaggaggcaggggtgggggtgtgtggcagcacggctgatggagggctgtcttgccttgctttacaggttggttttgaccctcaccccccgatgcgggccacaggcctcccctcaagcctggcctccattcctggaggaaaaccgtaagctttggctatacttactgcatgctttgtagggtgggcaggagagagcactctacccccaattccaacaacgcccctcatcccctgaccaagggtttgccctggtgcacctccctttggaaaggtatctgtccctctagaggcaccgagggctggttgcaaccccaggaaactgtagccaagccacacttctgagcacccacagaagctccctccgacagaggagccatggagttagctaagtacatggccactgggctgggagagaaggaacactcctcaccgagtcacctggagctgtggtgggccttgccgactcctttgggttcgacctgctgggaaggccccagtgccgctggtcgcaggcccttccctgtcagcagtgcttccctcccctggagggcacactctccccggcccttcacttccttgggttgctaggaaactaaaagattgagcctacagataatgccgagacactgcctgacacagtcctctaattgtccacgagaatctagatgctgattgagagggcacccaccagagcctgaaacagcaggcaggccaggctggctcaccacaggctctgacatggactttcccatttgctattgcaggggcaagcagatcccttccctaataccaccggctcctaaagcaagaggtggcatttcagccaggccctttccagggttggcatgttgggggaatgtatggatcgtgggaaagggcattccaggacacctgtgggtttctggtctgatttgaagcaaggatatataactgggtgtaaaaatcaaagctggtctgttaatcactgtctacctcgatggagccatcccagtacatggggttactgggttcgaatggtttcagagcagagggggctagaggcagggcagccagtcgggggcagtgcagatgacctgggccaggcctatgggaactctgaggggccggggtggatggcagcagtgacggtttctcaccttttcagagcgtactcattccatgtgagtgctgatgggcagatgcagcccgtgcccttcccccacgacgccctggcaggccccggcatcccgaggcacgcccggcagatcaacacactcagccacggggaggtggtgtgtgccgtgaccatcagcaaccccacgaggcacgtctacacaggtggcaagggctgcgtgaagatctgggacatcagccagccaggcagcaagagccccatctcccagctggactgcctggtgagaatcccagggctgctgcgcctcctccagctggtgtaggaggatggggcagcctgggccacaggggagagccccagggcccggctcagcatcgtattggctgagcaactttaggcaagctgactaacctctctgagcctcagttgtgccttctgtgtgtggggctgattctgacctcctggtattcatgaaagatcaaagggttgtgaatttgaggaatggggacagcctggcagctgctgggtatagggggaggctgtaagcaggactggtgagggtgctcggtgttgctggacaggactctcctggtgcccaggaggggaagtaggcagcactcagccctgccccttctccctccagaacagggacaattacatccgctcctgcaagctgctccctgatgggcgcacgctcatcgtgggcggcgaggccagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggtgagccggcaggagggagcattagtgcctcgtcctggggaagtttttacccatcctgcctggtcttgtttgctgtgaccttggccctgtctgaggcactgtggggtggccagaaccgttgggatgagggatgcacaggtgaaaagacagctccgcctgccttatgcgagggacagaggagggagggccattgggcccaggagttggagagggctctgggaagaaagtggagctggagcatgtctggggaagtggaggtcagattagtggagcaagcagagagtctgggagcagagccccagagaccagattagggagacccgactgggaagccacatcacgtggtagctaaacaagcctcaggacaaaactgctggctttgaatcctgcctccactatgacctagtgcaagtcgctgaacccctgcggctcagtttcttcctgtgtaaaacagtgacagtggagcatcttcctctgactgtgccgcagcgcaaaggcagacgggtgcctggcccagctgactcttgtatacatgggctgtgtgtgttattcagcgtgttcatggatggcctcagccccatagttcatgcaggatgaagagatagattaagagggcaaattgagggcgtgtggagtgcgagttaaggagctgtgtcctaaaggcagtggggccctgcattctctttatcagtcatctcacacgtagcttccccagggccttcctgccttcctcaccttcctgagcctccagctccacctcctccagaggcccaccctggagggactcagtctcagaaggctagtgcaaggtccctttttcacctcccccccccatttcccaggggacttgtccctgggcaaacccttccgtggaactggaaagaggcctggaactggaaagaggccggggctagctttgctgcaagctcgctaagggaccatgcgcatagtgcactcttctgggcctcagttttctcttctgctcagactgcccctgggatggccgccacctggcagtctgtggttcccgggactcaccctcctccctgcttggctttcgtaggcagttccagggccacacagatggggccagctgcatagacatctcccatgatggcaccaaactgtggacagggggcctggacaacacggtgcgctcctgggacctgcgggagggccgacagctacagcagcatgacttcacttcccaggtgtgcggcccaagactcctcccttcccaaagagcagtgtgttccctccctccggggccccagtggctgggtcagggacaaagggaccctcacagagtggccacggccaagagacttgggaccaacctgagccatctgggaaggcttcctggaggaagcagcagtgaaacagatggagatgaccttggggttggacacatttggcccaactgtggaaattcgattcattctctgctgctattgagcactttgtcctcggcgtcctcattcacaagatggaaataatagtagcaccctcctaggtctgatgtgggcacctgaaatgatccctctaaaaggcgtagccataaacccgactcacagaaagcattcagtaaatgccagggattattatttcttatttgcattcctcactttaatattttaatcttaaatttttaatattttagttttttttttttaactcacttttttcttaaggaaagatgaaagtctcagagacagagtaactgaatgcaaaatgtctgtgctttctcacctataaaatggggatggaaaatgacctcccatactcctgggttattgggtgggtggggagggaccctgagcctcagaggacctgagcagcacctttgggagccgccctcctcttgagggcagagaatgctgagctcagtccatctgccctcccaccacctgcagatcttctcgctgggctactgccccactggggagtggctggctgtgggcatggagagcagcaacgtggaggtgctgcaccacaccaagcctgacaagtaccagctgcacctgcacgagagctgcgtgctctccctcaagttcgcctactgcggtgagccttggatgggcccaggcctgatggagtggggtggggaacccagggcagcctggcccaacaggacagaagaggggcccaaagcttatagaataagctaggccctggaaccaggcctcctgacccctgagctggtgccccttcaacacccttaagtgatcttgttccacatccttgtttctcggatgcagatgtcaccatgagttattgaactctcaggacactaggccagagccagttcttgcaggcttggggcaaaggaacaggacagtagcagtgcaggcagttcctctccatggttacaaccacttgctttggcatctgagagccttggatgggaatgtctgctcctccactgacaagctgtgcagtcttgaacatctcaccctctctgaactctagtggatttttctctctggtcgggaatagcatggtgctcatggctttcagggagcataagggctttaacacttgtagagccctggccgagttcctgcttggaggaaggtcgcccactgactgctgtcttcagccaggtctccagactcccagggcttggatattttcagtatttcctgttgccttccagtagtagaatttagaaaggccagtcaaccttagtggctttaacaagaatcttttgaggcagcgttatcactgcaatgaacttcaaatcctaccttttcccatcctagccccgcccagccctccccctggatttcagagaaaggccttctccaggtgtccgcatgtcccatttgcaaaatgcctctcgaaattggagagttatactagttagcagttctcactgcttttctatggcagctggccatgtctagggcaggtcttgctttagagggcagtgagctacaacctgatcatgcctttgcctcccacctgcaggcaagtggttcgtgagcactgggaaagataaccttctcaacgcctggaggacgccttatggagccagcatattccaggtactgcccaccgtctgagtcctcctctgggttctacccagagttgaaacttggtgatggtgatgggagtgaggatagcagcaggaagaacaggaggagcctggagccaggatcagacctgccctggtcccctccccacccctacctgataggggagcaagattgggttctcccaaggacctggggacttcagcaggacacacaatctgctactgatggcttctgacccccgagggcaagggcttctaagccggggcgcttgtcggatttggagagtgaggaatagcataagtgtttttgctctgggctggatgctgagcacctgcgggaggtgcgctgggcacctgggcacccggcagccttgcccagagcagtgttgcctcctcaagtgagtgagtgtttccacctgcattcagcaccagcagggacatggacaggaaagagaggaggaaaggaagaggctttttataatctaccaggatctggggcctgccatactgcactgattggcacacacacgtgtgcacacacacacgtgcactctttcccatacacgatcaaactcacactcatttactcacgcacacttggtctcccccacacactttcttcctctctctctcttgcgcttccacacacacacttgcattctctctcactccctcagccaacatgccgctttctggacccaggctgaaatgtctggtgtgcagcgtgtcaaacctcattgttagggtctctagttacagcacatgcttcaaacatcaggtggcaatccttttcctaactcatcaggctgtgggcctgagctgctgacgccagctcctagcttggaaatgcttcttcctatttgtaaactcggaggagaagctcttgctaaagcgtcctgttctgatcattatgacttactgtaaagatcacgtgggagactgttactgagcttttccttatggaaaagcaggtgggaggggagctctacctgaaaatgcttcatgggtgctttaaagcctcccccacctcctcttcaccgcactgtgctccaggtcggagcatcagagaggggcagaggagggcaattgttgccgagagaaccgagatggtgttgagcactggaaaatgaattcctgtcttttttctccctgcaccccacgccttcctgctgcttctcctcgtcttcctcctccagtctaaagaatcctcgtctgtcttgagttgtgacatttcagcggatgacaaatacattgtaacaggctctggtgacaagaaggccacagtttatgaggtcatctactaaacaagaactccagcagggctgtcaaactctgggagaaaccgactcggctctgacagggagacccccaggcgaggggccccgaggatggcggaggatgggccgcaggcagccgagcgttcagggctgcgctccggccggctgagagggcacgtgccccgtcacagtctggactcctgggcctggattgatgtgtctcacagactcggaagggttctgctcctcctcctccccctgaacaatgctggcagttgctacaaatagatttattggaggcttatggctccggttcccccacagacccgctcatgagtctctgtttgttcttcccttttcttttgccctgtccctcaccttgggtcgggggtgctggagtggaccacaatgttgtgctgggggatgggggggtctctctttgccgattgtgcagtgcacaagatttgtgaaaaatgtaaataacagactcctattgcggactgatcagtgggagaggaggccccttcccaccggaaactctgagtgtgtatttcgcctgctgtatttgtaatccactcgtggtggtggctttttttttttttttttttaaataaacagatgctctcacctgggaagaggagacagggaggggaaccaattgaagaaagaggagaaaagtcttagagtgtggaaaaggcaaccaggttggccgtaaggtgcctgctggaatgcgtgtgcctccacacgggtctgggcatccggactgataaccagccggccagactgagggatggaaggcactgagatgggggcccgtccaggcggacacccgcagaaatggagctttctgtggtctcttgcactctggctgcctcttgccctctctgtgtctctctttcttggtctctccctctctcctcctcagcctggtctttctctttggtgcacacttagttattgttgtgagcaatggaagttcaaaggaactccctctccagctcttctgaatcttgggacacagcctaaaaaggacaaaaagttagaagacagcatagcaactcagctcagggagctaccagagaaaaatagcaactgatgtgggtgctttttttttttttttaatttgaataaaaagaattagaagtgatgtccttttataaaatgccttctcccccttcccgcctacagtctcttcctctccccttagaggggggaaagtgtataaacctacagggttgtgagtctgaaaagaggatccccctcacccccaccctgggcagagcagtgggggttggggggtgggagagggggacacagatcctggcacactgtggatatttcttgcagattgcagtctcttgtggcccaaacaggttaggtagactatcgcctctggcaggtgccaccttttggtaccaacatgttctgaggtgttaggatttgggttgggttttttttgtttgttttttttttccttttggtctttttttttttctccttttaaagaaaagctaaaggccgctgtgagtcctggtggcaggctctccatggatgtagcatatcgaagataatttttatactgcatttttatggattattttgtaatgtgtgattccgtctgctgaggaggtgggaggggctccagggaaagccacccaccttcagtgaggttgctccccagctgagcgcaccgggcatgggatgtggaggctggcgacacaccctgtgcctctccaaggctgggcgcgtggggcgtccagagtctctctgggtctcagatgtccatctgccacctcttgttaaggctctagccagaagggagggtgagggtagaagaaagttattcccgaagaaaaaaagaatgaaaagtcattgtactgaactgtttttatatttttaaaagttactatttaaaggttggtttgattgttgcgtcttaattgcctctcctcccagtttgccagtcccgccccccgccccccgggaaaacagccaggccactgttgctgtcacattctggagcctgggccagggccatttcccatcgatgtgagctcttctcatctcacagcattccctgcgctgcttccacccccttctccccttccagatacccagcatcgcagcagggatttcacaatcccatactgtgtcgcctcccatccaagcgccagggagggtggggggtaggagctaagacttcctctggacagatgggcagggcagagttcactgaggtgaaggaagaccacaggttaacaccaaagtattgtacagctgtcaatgcaaaacttttttggaaaaaaattaaacgtaatgaacttgaagcgaaactgcaaagtgtctgtgaacatctggaccttggaaacctgcacaattttattttaagcttaacacgtttaggtgggacgaggagatcttcaatctctaggtcacaaaggtgtgtttttggatgatacagaaggaagcatttgcagaagaggcagacccagaaatgcaggtcattgtccccagggagggagtcgggggctgggcgggaagaggagaatgctggtgcccattcccggggcggtccccaggctcttggatttcatgcacccattagcaaaagctctcagggcactggagattaacatggtttccaactccttattttgtcaaagtcattctcagcacaaacaattgcctgctgtcatttcatacaagaaagggaatctcacatttaaaaaaaaaaagaggaacgacagtctcagcataaagcacagtctttatgactagaagggacaactggcctctctccacacagaggggtcatttagctggagagggaggtcctctcaggcttatggaggagacaatgccagcaggtagaagggaccagacaggctgcagtgggctacagctctgcctcaaatggttgcaggggtgtgagtcaaacagctctccttggaccatacctttctcgtgtgtccatctctgggcattgcaacagagggctagggggctgggagcaggctctggccagaataagattgtgtgtttgtccagagcatgaggttacccatgggagccaagatcagggtggaattggggcttgcaggccccagtttggcagaagaggaaaatgtccatcagggaatactcacccccccaggcttgtcctactggaaagcaaggccaatgttactctttgaggagagactgaaactctgcaagtctgttcactgagatttcctgggcacactcaaggatggagagatgaccaagagtcagtccctgccacagaagctcacagttcaaggtcggggagatgatacagccccttacttcatttgacctgtgttcccactgctgctgtccttaatgccggcacactgggcctcccctgcactgagcctctctgcacgtgcttcctcctgctgcgtctccccatccaccactccactgctttccacccaaccctggctggcggcacgaaccacatctgggagcgtgttagaaatctagaatgagcccctcagtcctacccaagcagaatctgcattttaacatgctgccgcgattcctgtgcacatcagtatttgtgaagcattccagtctgaaaggaggggcccactccatggtaaacctattcccatccttaatccccccatgttgccccctttttacttaacagggtgacaggaggctttgatgccatttttctggcctttatcaccctccaagtgttcctttcctcttatgcagaaatccaggcttgtagcaaccatagcgtttacaacatgttcctgcacctatttgcttgtctcttcccacctagactagtttccctggagggcagtgcgcaggacctcatcagcccagggcagtgctagtgaatgatgagctttcaccagtttgagattatcctaattcacagtgtctggcgtgatacccagggcatccgatactcagtaacccgagcccagagaagtgaaatgatgtctggagtgttttcaattctattgtgctgtttttgctcaaagcaagatctgttttttaaaaaatggagggccacagttgtcagaggccaggtttaatgttttagttgccatcaaattataaacaaatgggctgggcatggtggctcattcctgtaatcccagcactttgggaggccaaggtgggcagatcacctgaggtcaggagtttgagaccagcctggccaacatggtgaaaccccatctcttctaaaaataagagaattagctgggcttggtggtgggcgcctgtaatcccagctacttgggaggttgaggcaggagaattgcttgaacccgggagatggatgttgcagtgagcccagatcatgccattgtactccagtctaggcgacagagcgagaccgtctcaaaaaaaaaaaaacaaaaaaaaaagaacaaatatttgggtcatctttggcaatagctgacaaagccaccctttctagcttccctctgagtcgcagcccccaggtggccccaaccccagcgtgggcagtaattgtctaacttgtagggtctctgagaaggtatggagacagagatctggacgctggagccagaaggatccttagcaagactgctaaatgttaggtactggccatcaaatggcccataatgatgcaagtgtaattttttttcccaataacttattcagtgtttacaaatgagcatcatttttaatataaagcaaacaaatctgaacttttaaaaaaattgtatgattaatggagcatttttaaacattataccaaagttggaccttttatatttgaagagacatctatactaagcccaattttatagatggggcaattaaggcccagggagggcaagtgacttaacatgactcacagagtccaagccaacattatgatgaaacatccccctcccctaaacccttagcacactcaggatggaaagctaggagggaactgcccagcctacaggacttgatgttgcttggaggattaatatccagggaatgagtcttcctgctcctctaccaacagtactggtaaggaaattactcatggaaaggagatggcccagaacagtcatggaaaccagcctcctgcctcaagaacttcctagaactcacccacccacccatcttgcccatccttctatccatctatccacccatccattacccacccacacatttatccgtataccccttcattcactcttccatccatctatctagccatcctattcacccgtccatcctaccaacatttatatagtaagaatctaatatgtgcctggcatggttctcgatgctaagatgcaaagatagtaagatgcagtgcctgcccttagagctctcagccaactgggagaaaacagaaactgacaattcccactccatgagatatgtgaaagtgcaaaccagatgtcaccacacatagctgaggcattgacttgagtatggaagggcagagcaagagggtcctggaaggaccaagagctaaacagaagtgaagaataccatgggcatgccaatgaaaggtatgaagaaaagtgttccaggtggaaggaacagcatgtgctaaggcctggggtaaaagagagcatggtcccaacaatgcatccctacctaacccatctagttcttgctcctccctccagctccatccagccttcttacatcccagttcttgctgcaacttcccgacccctcacccccaccagtagcctccaggccagaagctgggctaggattctggctgagcaggctggtgaaaccggaggagggagctggacagagaccacaattccagcctgaaccaggagaggcagaggaatggggagaagatggaaggaggctgcaattcagtgtctgagaatgcccatgataatgccccagggctctgagtccccaacacaattggcatcagaagacccggggatctgtgattggatcatggtgcatgatcagttccttacctgggtaatatacctattctaagctcccaccacattcacacagttacttttataaactgcacatctggccccatcattgcccatcttggagcccctcactggccctcttcacagcacaactcacccttaactcatctaggtgtgggccctgtatctctaaagtcatccctccccacttatcttgcttcccttcacacaccagcagcacagtacttccaatgccctgaaaagcaatgctctcccattttaggttttgcatgtgcttctctttcagcttgaatgtggtgcatccttctttgaatttctgctcattcttcaggagtaggcctcaatgtcacttcttccaggaagccttccctgactgcccacttccctactccttggtactctgagagtgttctctcccaactttaggtagcacataccaagcacaatgttagtatgattacagatggttctacttaggacttttgattttatgatgagtttattgggtattaaatgcatttttttttttgagacggagtcttgctctgtcacccaggctagagtgcagtggcgtgatctcagctcactgcaaactccgcctcccgggttcaagagactctcctgcctcagcctccggagtagctgggattacgcgtgcccgccaccatgccgggctaatttttgtgttttttagtagagatggggttacaccatcttggccaggcttgtctcaaactcctgaccttatgatccacctgcctcagcctcccaaagtcctgggattgcaggcattaaatgcatttttgacttagaatttttcaacttacgatgggtttattgggacataaccccattgtaagtcaaggaccatctgtatggtttaatgatatcctgtctcctgatgcccacctgaccctcccaccacacagtgggctctcagagaacagcgactttgtcttatatctccagtgcttagtgcattgtaggtactcaggaaaatgttacttgaatgaatcagtgagtgtgtgattaagataatacactaatatttctagagtgctagtgcatgtaaatcatgtcagtcagtgcttcataaatattgtttaatactcataactgacctatgaggtcattgctattattatactcattttatggatgaaacaactgaagttcaagttccccaaggtcacacagcttgtaaggtttgtatgacactgctgctgaatggttggatggatggatggatgaatggatggatggatggatggatgagtagatggatgcatgaaaggatggatggatggatggatggttggtggatggatggatggatggatggatggatggatggatgaatggatggatggataaatgggtggatggatggatggatggatgggtagatggatggatagatgaatgggggaatggatggatagacgaatggatggttgaatggatcgatgaatggataggtggatggatgagtggatgagaggattggcgggtgagtggaggataggtggtggactgcctgcctcatgaggactggagtagaagcttggaaagaactgatcccacgtgtagaggagatcagtgatcttaggtggaagagtatgggaagaagagccaagagacagaagctcccctggctaaatcagacctttcttacatccatttgagtacctctgtgaatgcccagaaaaccccacagtgtgctcaacctgacccggacccagttcccctctcagacaggtcagaagtgggccctagggagctcctgactgctgaggcaagagagggagttaggatggggctatggccttgtccctacagggtatcacagatggaagctgccctgtgcaaatgtttggtggcaacaggttagaagatgaaaagatcgggcctagaatttccaattcaggaaaatgaaacagcaagctaataaggattcactttgaccatgtgaacacagacatattgtataaaattaaaataaaacaattttgctaatctacatgaaagaaaggggaatcctttaatgtggtaaataaaagactttaaaggtagagtggagatccctagctcagaacaatacccaaaaactacataaagcaaaaatggacagaattacaaggaggaatgggaagttttatcataccactaagaggaactagtagatcaagctgtgagaaatttataaggttataaaagatatgaacaacataattaacaagcttgagacatagaaccctacaagcaactattggagcccgcaaattattttctagaacacctggaagtcttagaaagttttaccagtaaaaagaagcagatagagcattttacaaaattcaacacccattcatgactcccttaaagttacaaaccaggaatcaaagaaaactttaatctgacaatggatagctatatcagacctgcagccaaataatagataacagtaaagtttcagaagcatcatattaaagtcataaaaaacaatcaatgagccaggacagcagtgtgtacctgttgtcctagctacttgagagtctgaggcaggaggatcacctgagcccaggagttggagactagcctgggcaacatagcaagatcccatctctaaaaaactttttttaaacacaagaatattcattattactgtctctgttcaacgttgtgctggagggtctagccaatgcaataggacaacataaaaaataaaaggataaataaaagtatcatgattgaagtgaaagaaacaaagttgtaattatttgcagataatatgactagatatacacagaatataaaactgtttaataagggagtttagtcaagttgctggatccaagatcaaatttcattaatcaatagcattcctattcacaagcagcaaccaattagaaaatgtaaagaaaaatgcatttataatagtaaaagctacctatgagtcaatccaagtaaagctacgtaagatctttaaggataaaaatacaaaattttattgaagatttaaatgtaaaaagacctctgtatatcacaaactatgccatagtcatttatgagctttttcatttaagaagctgtattttacaactatttataaatacaatgttaaacaaatccaaatggaatgttttctgtgtaatttgataatctgatactgatatttatatgaagagtaagggaccaagaatagcaaatacaattttgaagagaaatgagggaggagaacttcgcctgccagatatcaagacttactgtaaagctacaggaagcaggaaagtgtgctcttgctgcatgtgcagacaaatagaccaatggagctgaatagagagtccataagtagactactatataggtgagaatgtgactaccacatagatggcattatgcatcagtggagaaaagcactattcagcaataagttctggagcaacaggccatcttcatggtgggaaaatggatccctacctcacacagtacacaaaaataaattctcaaaggattaaggtttttaagcttatagtacagaatattggagaacaacctcaggactcagaggatgggaaaaattattgaacaagacagtaagcaaaagctataatgaaataaagatcaatttgatgatattaaattttaaaatacctgtacaacaagagatactataaagtaacaaaacatgaaaaaacataaacacaatgcctacaactgaccgaaaaaagtggtgtctggaatagataatgaattattccaaatcagtacattgaaagccaacaactcgagaggaaaatgggtagaggacataaataggtgattcacaggagaggaagcagaaatgctcaacaaacacgtgaaaatacctcatctcaccagctatcagggaaatgcaaatttacaaaacaaaatgaaatggaacgacccattcccattagactggcaagttttcgagtttgatcatatgaagcttccatgagggtggtgaatgactagtattgtcaaacactgtgggagcataaattggttcaaccactttgtggttgccaaacaactattactattactaataggttactcttgccaggcagtttggcaatcatgaaggaggaaaagcacaaccctgtgacccactaaatctacttccaggtatgcaccctggagaaactcttcaacaactccatgaagagatatgtacagaatcttcattgcctccttgtttgagcaaaaataattagaaacaacctgtccattaatggatgaatggattttaaaagatctatgcattttcctataataaaattgtacataggcattaaaatgcataagctatatctttctgtagcagtttggataaatctcaaaaacaatgttgtgtgaaaagagcaagttgtggaaggaaatacatgatatgatactatttatataaaatagaaatccacaaaacaattctatatttgagcatatatatacatatatatatgagtagaaagaacaccctacaccaccaggataatggttatctgtggggagggaagaaacggaaaggtcagcgggagttcagctatacctatcacattttattactttttagaaactctgtagagaatgttaaaatgttcacattttaaaaatctgcgtggtggctttagaagggtcgtgttattttctgtactttgtgacatgtttgaaatatttcataattaaagatttttttttaaaaaggcagaaaagtaaagacttaagaactcgcccccgttatagtgtctggtgactcaaagggggcctggggtgggggtgcccatgcccagtggcagatagcaaagccccgggctcaccacatcaccttagtcacgtcacgggatctctccagtccttgatcttttcatcctttatgtgatgcttgaaggcaggtgaataatcaatccctgggtcctctccagcttggatgttttgtggttctaatgattttgtgagtgtgcaggggcagtgctctcatgcagagacagcatggattagatttgtttagcttttcattatgaaaaatgccaaacagagaagtagagagaacagaataatgaatctccatgtgcccatcaaccagcttcaacagttatcaactcagggctaatcttcttttatctataccccacccatctctaccagtcaccaccactggagtattatgtagcaaattccagacatttcatcattaaattagcacatattttactatttccaaaacgtaagacctgttttgaaaatgtaaccaaataccactaaacctaaaatataacttcttatatcatcaaatatccaatctgtattcaaagatccccaattgtctcataagtctttttacaaagtgtatttatttgaattaggatccaaataagatccacacagagcaagcaaaattgatatgtcttttagattcctgcttcatatcacatcctctctctcatacacatccatacacacacatatttatttactggaaaaaaaaccaaatttgtccttagagcttcacatagtctgaattttgctgattgctaaattgtagttagatcttggagcttgattagatccaggcttgattttggagggaggcagaatacttcatagattcattaggaaacacatagcagctagatgcttctccttttgtatgttagcagtcaccgatgatcattgtgtagattcattaactcattaggggctacataagggtgattccaattgcaacatttgcttgaatattgttataaaaagaaactgccccacaccaaccatttggttaccttgaagtacagttcatacaggaaaggcaagatgaatgcttgattcatttgctttatttgccaattttcaaaataataagttaattcttcagtatcctcagcaattgaccaatgaggtattcttttttaaaacattatgaatgtgtgaatttaaacatatttgatatgtttgagtcaagtggagttatctttattgcttctgaaatcatcctacttggggatcctcttgaagatgcctcctgagtctttttaatacgaccatactagtctttgagagcttccatgctttctggtaaaagacaatgtccctggctcatcttgtacattttccatcctggatgtggagttggccattttttccaatgaaccttggttctgtttagtggaaagtggtatttggagaccataatctgggtgcttggggtgcttgatgctaatgaaatgatcattgtttctgggccttttcagtagcagagctaagaaatgtgtatgtgcatatttatatatttgttaatatataaatagaccgtgaggtctactgaggcttctaattcaaattcagggttacagg

SEQ ID NO: 1461 - DNA, 2357 bp, Homo sapiens
gaatcacgacccctccctgccatgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggtggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgataggtataatggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacgggggggtggtgtgtgccgtgaccatcagcaaccccagcaggcacgtctacacaggtggcaagggctgcgtgaagatctgggacatcagccagccaggcagcaagagccccatctcccagctggactgcctgaacagggacaattacatgcgctcctgcaagctgcaccctgatgggcgcacgctcatcgtgggcggcgagggcagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctcacaagtaccagctgcacctgcacgagagctgcgtgctctccctcaagttcgcctactgcggcaagtggttcgtgagcactgggaaagataaccttctcaacgcctggaggacgccttatggagccagcatatcccagtctaaagaatcctcgtctgtcttgagttgtgacatttcagcggatgacaaatacattgtaacaggctctggtgacaagaaggccacagtttatgaggtcatctactaaacaagaactccagcagg

SEQ ID NO: 1462 - DNA, 2319 bp, Homo sapiens
atgtatccgcagggcagacatccggctccccatcaacccgggcagccgggatttaaattcacggtggctgagtcttgtgacaggatcaaagacgaattccagttcctgcaagctcagtatcacagcctcaaagtggagtacgacaagctggcaaacgagaagacggagatgcagcgccattatgtgatgtactatgagatgtcctatggcttgaacattgaaatgcacaagcagacagagattgcgaagagactgaacacaattttagcacagatcatgcctttcctgtcacaagagcaccagcagcaggtggcgcaggcagtggagcgcgccaagcaggtcaccatgacggagctgaacgccatcatcgggcagcagcagctccaggcgcagcacctctcccatgccacacacggccccccggtccagttgccaccccacccgtcaggtctccagcctccaggaatccccccagtgacagggagcagctccgggctgctggcactgggcgccctgggcagccaggcccatctgacggtgaaggatgagaagaaccaccatgaactcgatcacagagagagagaatccagtgcgaataactctgtgtcaccctcggaaagcctccgggccagtgagaagcaccggggctctgcggactacagcatggaagccaagaagcggaaggtggaggagaaggacagcttgagccgatacgacagtgatggagacaagagtgatgatctggtggtggatgtttccaatgaggaccccgcaacgccccgggtcagcccggcacactcccctcctgaaaatgggctggacaaggcccgtagcctgaaaaaagatgcccccaccagccctgcctcggtggcctcttccagtagcacaccttcctccaagaccaaagaccttggtcataacgacaaatcctccacccctgggctcaagtccaacacaccaaccccaaggaacgacgccccaactccaggcaccagcacgaccccagggctcaggtcgatgccgggtaaacctccgggcatggacccgataggtataatggcctcggctctgcgcacgcccatctccatcaccagctcctatgcggcgcccttcgccatgatgagccaccatgagatgaacggctccctcaccagtcctggcgcctacgccggcctccacaacatcccaccccagatgagcgccgccgccgctgctgcagccgctgcctatggccgatcgccaatggtgagctttggagctgttggttttgaccctcaccccccgatgcgggccacaggcctcccctcaagcctggcctccattcctggaggaaaaccagcgtactcattccatgtgagtgctgatgggcagatgcagcccgtgcccttcccccacgacgccctggcaggccccggcatcccgaggcacgcccggcagatcaacacactcagccacgggggggtggtgtgtgccgtgaccatcagcaaccccagcaggcacgtctacacaggtggcaagggctgcgtgaagatctgggacatcagccagccaggcagcaagagccccatctcccagctggactgcctgaacagggacaattacatgcgctcctgcaagctgcaccctgatgggcgcacgctcatcgtgggcggcgagggcagcacgctcaccatctgggacctggcctcgcccacgccccgcatcaaggccgagctgacgtcctcggctcccgcctgttatgccctggccattagccctgacgccaaagtctgcttctcctgctgcagcgatgggaacattgctgtctgggacctgcacaaccagaccctggtcaggcagttccagggccacacagatggggccagctgcatagacatctcccatgatggcaccaaactgtggacagggggcctggacaacacggtgcgctcctgggacctgcgggagggccgacagctacagcagcatgacttcacttcccagatcttctcgctgggctactgccccactggggagtggctggctgtgggcatggagagcagcaacgtggaggtgctgcaccacaccaagcctcacaagtaccagctgcacctgcacgagagctgcgtgctctccctcaagttcgcctactgcggcaagtggttcgtgagcactgggaaagataaccttctcaacgcctggaggacgccttatggagccagcatatcccagtctaaagaatcctcgtctgtcttgagttgtgacatttcagcggatgacaaatacattgtaacaggctctggtgacaagaaggccacagtttatgaggtcatctactaa

SEQ ID NO: 1463 - DNA, 31527 bp, Mus musculus
tatcacctaaccatctctgccccagcaaacactggatcaaatcgacccctctgaatatactttatacttggagatcattgcagcttttcggaggggactaaatatatgagtcccagaaagggcagaggtaggcaggagcgactgtcagccttcctcttcatcagcccacccaggattgcacgggagggctggcacaagtcactgaccctgcgacagggtcgggagcttataccgcagagggtctcttttgtctggacgtcagggctttcctggaatgcaaacttctagtgtgcaatgtggggcagtcccaggggaagcaggctgcttggtcactgtgcatagccatgtcacctggtgaggtgagatcttgaaacagatttctggaaaagcgtcaagggtgctcatgaagcacgagtgttacgctctacgggtctggagaagcacttgcacacactcggggcagctacaccaagactgcggacacgtgctcatggtgcccaggcactcggagcgagttcgtgggggtgtgctttcaaagcaccaaggaccccatggactaaatttatggttgactgaggtggggttttaattggtgagctgtgaactggatgggaagaaagggggatcagagagcagtctgaagacagggtgtggggaggcttcccccacgagcaggctttgacagtcaggccattacagtcagcctctgtgtattgtgggtcagatatttatattacaaacctacatctatcgcttgtaggctccctctcccttctgctcctcttcactttctttccttgcaaggctgggaatggaagccagacctcacccaagccaggcaggtgctctatcactgagccatctccccggggcttttcagccactttatttccttggcgattatttggggctagcacgtaggtttccatggctttcctgcccaggtggcctgcagagaatcttacacagtgccatgcatggtctaagtgcctcaccaagggacccttgtcctgagatgggttttgtcctgtctccaccttgcatgtgctatgagcatgagcccaacaggttgggcaatctttccagccgcaccataagggcaagtcacatcaggaaatggcacacactgtctggggtacagccatactctggccagctatggtttgattctgagaacttgaagcacgtgggtttcccaagtacataggatcccaaggtgctgtaataaatcatatccctgagggtggagtcagggaagcttttgatctataaatcagatggaaatacaggtgccttcatctttttcatagggatttcggcctgggtaagctgagtgccaccccagcctctttcccttctgagcagtctggtctcacctgcttgttatccttgttgaatctgggccaggccggggagcaccacgttctgttctagctcggcctgtgggaggaaggggcctgtcaggagccccttgggccttcctgtatgggaactagctgttacaaacacattgccagccagcgaaggctcccaggatgacaatccctacgtaaaatgatgtgttagagagccacgtgatcttcagctcacagtctacatggagattgtgggtagattccctccacttcccctgccccattcatgtgtctgttgaatttgggtgctcagcactgaagtcagggccccatgcaggccattgcctgtgtggcgtttagagggtaattctgtggagttcagttctctttctccacctttgcatctgtctcaggcttgggaggcaagggctttctccatagagccacagggcgagcaccctgcattctttgtttctgaggagttttacacttataggaaagctgtgatgagggcatgggcagtttccatttctcgaggtgagttctgagggggcttcctgctgggtggggcccactacggtccatcagtttggtttttgtctgacttcccttttcagtggtaaagagtcacattgaaacgggctatgaggttatagcttctccaaccgaccctggtcctcacctgcatcccttcccctgcacgcacacaggcccatctgcagcctcttctaactgctaagcaatctctccagaccctaaacatattgtttctagcctgctgtgctgttacacatttgtagtcccaaatttggaagactgaggagaagccgtcttgaactacttcgtgagttcaaggccagcccgggttccataagaagactgtatcacaaattttacgtgtgcttttgaagagtggcactgagcacttagtgccacagatagccctctttgccagttactcggagtcatcatttctggcttctttgtgctttgggtttgaactgtgagttagagaggcgggcgggggggggggggagaatcccagctacctttcttttcccttcttcttcttcttcttcttcttcttcttcttcttcttcttcttcttcttcttcttcttcttcttcttcttcttcttcctcttcttcttcttcttcttcttcttttaattttgtgggttgtttgtttgtttcaagacagggtttctctgtgtagccctggctgccctggaactcactctgtagaccaggctggcctcaaactcagaaatctgcctgcctctgattcccaagtgctgggattaaaggcgtgcgccaccacgccaagctctacatctttcttagaagagaggaaagggcaagtactcttcttgcttgaggccagcagtgagttctggtgaccgtgaaggaaagagcaggtcttgaggctgatagagaagtctccttgctctctagcaccccaccacagcctctggccaacacagacaagctgagagtggtgtgtggggagactagagagcagtggggagagaagagaaagtggaaggctaggggaggagaaaatacctacctgacagacactggcattggggaagtaccgacacctgtctcagtggggaaagagatccgtgcctggcctaggtaggggctgtttttctagagtgcccaggttcaattcccagcacccacttagtggttcacaactcgtttcaaaggagccaagcacacacacacacacacacacacacacacacacacacgcagacaaaacacccacatacaaaacaacaaagacaatttttgtttgtgagacagggtctctctatgtagctctggctgtcctgaaactcgatatgtagaccaggctggcttcaaacctacagagacccaactgcctctgctaggattaaaggtgtgtgccaccatgccagctaaacaaatcaaaacaaactagagaggggccacagccgccctgtgctctgaccctgtggcagctgtggaaatgcaaacgcagaaagctcatagcatttaaagctggaagggtcatttaaggtcttccagattaaagcctttatttttgcagagcccagagatgggttgggccacacagctcctaattcccaggattgcagtccctgttcctgcaatttcacaatgccgccttctgaaagctctggacattcctgcaaacacattagctgcagcctacggtctgggctgctagaacaagacgcctggtaccaggtgattcatgcatttattcctcgctgttacagggctgagaaatctgatgctggcagaaacactcgaggactgccctccttgatgaccttaatgtgtcctcacaggatgcaagaggccaagcccttcatgccctaggagaacaaagccaaccacagggcacagcccttgagatctaattctcctaaggcccagccctgcaccttcacctcttgggggtgggggatgggtggcggcggtggcggcacgggggtggggtgggggtggggaccaggctttagcatgtagcgtgtgaatttggggtggagagacgcaatactcagaccatagcagcccctgtcatctgtgattagctttcatgttcttatccaattgaaatgattaatacttagagacagggcctggagaagtggctcagtagctaagagtgtttgctgctcttgcagaggatcagggtgtggttcctagcaccaaagttgagtggtcacagctgactgtaaccccagcttcaggggatctgacacactcttctggcctcaaagggcaccctcaaacatgtgcacacacacacacacacacacacacacacacacaatttgtaaaaatattttttaaagttatagtactataaataacataaaaacatgcatgatttgttgaaaagtctaagtttatccatgtgttgaacagaaaattgtttttcctcaatttgtattcttgtgtactgttatgccctgagttcacgggaaacccaggtgagcccaagaattgcaaagtccagcggggcgtggtggcgcacgcctttaatcccagcacttgggaggcagaggcaggcggatttctgagttcgaggccagcctggtctacagagtgagttctgggacagccggggctacacagagaaaccctgtctcaaaaaaacaaaaacaaaaccaaacaaccaaacaaacaaaaaaagaattgcaaagtccactgcaactcgcaaaagagtcttgtattttcaagtttgaactcggtttgcccacctagcacacactgcataaatgctggcaagcgatcctgagtccagaaaacattgggtttatatatagtataggaatagtgtgaatattcacagaacaggggagtagagggtggaatagtactgaagcgggaagggggctaatgggtgtctattcaaggactgtctgtgacctgacctctgtttaccttttactttttccatggtctcccttgagcttgttatttctctaaggtctcaaggacaggcacctagaaagttatcaggaggagtgttgggtgttggttttggacacacagaggtgcaccattctaactctaggggagggggagggagccagccccaggctgctgcaggaggatgtagcacagaaaccagctgtctgtgtatcatgcttgcggcaggctggaaaaatgatgggagcttctggcagaggggttggaggaaacgcaggggcaaactgtctgcacacaacaacactgaagtctctctagtatccttaatttgggggttgcaacagtacaagtctgaaactctccctgtttgaaacattgtggtactctgaccacacacagggttcccagcccagttctcatcttattcttccatagctgcctgccatctgccccgggctgcagtctgtgctgttggcagcatccacagagtccctgccactatcaatgtatctctccagcactcttttcttcgagttatttactgaacatatactgtgcattacacagttttgttttgtttttctttctttctttctttccccttcccattctccctcttgctctggccctgcttgcttcagcctataggttctttatttatttctcattatggatggttgtaagccaccatgtggctgctgggaattgaactcacgacctttaagagccactgagccatctcaccagcccttttacaggttttttttttttttttttttttttttttttttttaatgtttggaattgaaatagaatcccatggcttccccctccctggacccccttccttcccccctttcaattggtggactttttttttttattattattgttacacacatatatgtgtgtgtgcgcatgcacagatacatataaatgaatctgtttctgttgtctgtgtgtgtgtacagttccaaggacaaccacttggcattagacaaacaatccctgggagaggctacctctccttctggcagttgttagttgccttcgttctttgtctagaggaaaaaccctgacaacctttccttattccatgccagctcgtccgctgatatgacattgttcctgacttttcctccttatgcagccatttctagagcggctgttcacagcggatgccttggtcctctggctcctcagatctttcagctccctattcgtttgcttttcctgaaccatagacaaaggtgctgtgtgtccgtgtattccctgcagctgggctcctcatgacctgttgatttctgcattgtgtccagttgtggttttccgtgatgggctccatttgctgtgaagagaggccgctctgatgaggggtgggagctgcactgacccaggaaaggtaagctgagcacctactctaaatttttgagacagtgtgtcatgatgtcgtccgattcttaccaagaacctttccctttatttttctctttgtagaaatctttactaataacttcaaaacattgtcataaacccagatttcaaaccgccccaagtaatcctcaagatgactcactcacaaaatgtctgacccaacatcctcccaggccagtcttggagtctgcgggtggtgcagagctgctccttattacgcagtggcgtaccgccctctagtgggaagcttgtgtcagtacacagacgctcccggaggcgagcctggagattcttcagtgaacagagctaacgatgctagcctttagctaagagaaggaagacaaaaaagtagcaaagtcaggacaaaagccaggagcttgcccaggaagtgcactgtgggcccagggcacagtgcaaaaggtccctcccttgagatggcacacactgttaatggggactgacagcagaagcagattgggcaagaatagtgtgagccaggtcctgcaggagccagatggctgcccagagcagggtaggctcatctctccgctctcggttgattcctgccccacctcccatccccacccgatgaccccatactgaggactgaactcagggccttgtgtttgttggatgaactctataccgctgagaggaacccccaaagccaaccatttcccactttggtaattactgatttgtcctgtaaatcctcccccgccttttttattatggtggtcattgtggctgaacactctcacctagggcctctctctatactcccaggacagctcccccgagatacagctggcatggctgaatacttcagggatcatttggaatctctgtgtaagtcttaataacaggccttactgcatctttatttaacaaagctttttttttttttctgccttctctattgcaggacttacactggccacaagcagtttgatgttcagctagaaaacaatcacagatatcacgacagaattgatttacactgttctctgaacatcttggatgaggcccctcagagcagaggtgacaaggttggaattccgccttgcaggacaagttgtgtcctctggataaacataatagagggagcatgctgttgccttgagtaaaatcctgggcagaagcagctcaggaagaggtgggttcaactgtttcacagttcatcagccttggaaagcagagactttacagcctggcatggtgttgcatgccacaagcaggtggatctctgagtctgaggccagcctggtctacagagtgagttccaggacagccagggctatactgagaaaccctgtcatgaaaacaaaacaaaacaaaaccaaaaagaaacttgatgcttctggtcactttgcacctgcagccaggaaacaggaagagataaacaaatgtgtgtgcttacctagccttctcttttttatgtagtcctagactggtggtttgcatgagaatggtccccagaggctcatatatttgaatgcttggtccctacttggtaggtctgttctgggaagttattaggaagtgtagccttgttggaggtgtgccactaagggtgggctttggggttttaaaagcccatgccaggaagagtctccctctctctcccttctctctgtgctctgtggttcacatctcaatctggaagctctcagctacggttccagtgctatcacgcctgcctgccaccatgtttcctgacatgaggataataaaggactcactctctgaaactgtaagcccccaatttaaatgctttcttttgtaagttggcttggccatagtgtttcttcgcagcaacagaaaagaaactaagcaaggaccaaagaacattgttgcccacttttagggtgtgtcttttccattcgattaatttaacataaaccctcacaggcatgctcggaggctgacctaatctacgctgtctctacaagtgtacccaaaggcttgaccccctaggtgattctacatcctgtcaatcaacagtaaccaaggtggggtaaggcacgaggtagggatgcaagtggaacttctaacaactggaaggacaagtaccaagttagtcttgagaagctgagaaagtgtgttgtgtttggagcgaagagtaagagctctttgtctagaaagaagatgaaaggttgtgtgtgaagcaggctggtcaacaaactcaacataagcatcagtacacccatcacatacacaccacacgcctatacaccacatatcacaaacacaccacacacacaacatgctacacatatcacatacaacactctacacatcataaacaacacacacagcacacacacacacaacatactacacacattacatacgacacacacacacaaacataccacacatatcacatacgacacacacacaaacataccacacacatcacatatgacacacacacaccatataaatgacctcaggcatttgtagctccttatataatttctgagacctaaattaatcctacccctttgaggtgtgacaatgtccttgaatgctaatttaaaagttctcctggctggcaattccaattagcttatactaaattcagcgcacaaaatacatttatttttaacataaggaggcttctaattcttattaataggacattgggttctttttcaatcacagcatgaacagatattttaagaacaatgacccatttatgcagcagattattagctttctggtaatgcacattaccccccacctgctctggatggaagcctttagctccccttccccaagtcaaagcggggccatgtcactggctatgtgagctcaagtcagcaaactgcatgcagctcccggattggctattagggaacacctttttttttttttttttcctaacacacttttttggtagatgtcttagaagtacaatttggcagtgtggtgactctgttctgaatgcttccatactcagtccctaagctttggatacgtttctatgttcaacaggtctctcagtttaatgttcagagatctagactatgctaactgtgctcagaaaacacatgtcaactctgcgttattactatgaatatcctttattcttattattttttaattagttctcttctgggcagttgggcctagtttctctctctctgtctctctctctctctgggcgtggggtgtctttctcgcgggtgggggtaaggcagggaccctctacaaagctctggatgtcctcaagctcacagagatctgcctgagcgcgccaccaagccgggctggaacagggattctggctctctaggtgtgaggactataaagtgctcggtgcactcaccgcaccctcagggtcatcaaatcctcaacacacaagggcttaggttcaggacccgagtgcagaggagtcggaaaagggtggggtcaaagtggaaaggtcaaaaggccagtgtctccagtccagagcctcggacatccgttaccatagcgacttcagccaaggaatggaattaccgaggccccaacaggctttgcgatcccaaatcccaggggttttcggcgcggctcgtattccgtagagcagctagacgcagacaccaacgccgacgcggttgcctagcgacacgcattttcccaggatgcctagcagtgttgtgttttctcagccaatcagagttgagatgcaccttcgctgtggaccaatagaatgcgaggccgaagcccgcgacggttgacccggtggccggttgctcgccgactcaggcaggcagacgaggggctcgggtttcggcgcggttggcctgcagcgggcgagcctgggctccgagcggcgcggtggtgtggttgccagggtggccgctcgccatgccgtcccgggtggaggactacgaggtgctgcacagcatcggcaccggctcctacggccgctgtcagaagattcggaggaagagcgacggcaaggtgaggcaccgggcagcccttccacggcgggcttagggagaagcaagcgtcgcccacgctggggaggggcagggcggccacctgaactctcgtgaaggaccgggctgtagcctcctaagaagggacgggctcgtggagcgggcagccacggctgggaaccggtggaggcgcgaatccgcggcgagcagaaagacgagctcacgtgacctgcttcgccgctgcgccacacgccgtcccggactcaagcgctggggatggtaccgcccacatttcgggtgggtcttcccactaaattaacccggtctcgactccctcactgacacacccattgagttgttagtgttttgtttttcaactttggaaatttcaccctttgtctcacaccttggaaatgttgtatttcagatcctggtgtggaaagagcttgactatggctccatgacggaggtggagaagcagatgcttgtgtctgaagtgaacttgcttcgggagctgaaacatccaaacatcgtccgttactatgatcgcattattgaccgaaccaacacaaccctgtacatcgtaatggaatactgtgagggaggggacctggctagtgtcatttcaaaggggaccaaggataggtaaggtgaaagagccccacggttcgtatctaataataattaacttccatgtttgtacgctctgaatgacttgccccagattgaagatggcttttattcagggttgtgaaatgtgctttttctccagacagtacttggaagaagagtttgtccttcgagtgatgactcagttgacgctggccctgaaagagtgtcacagaaggagcgatggtggccacactgtgcttcaccgggacctgaagccagccaatgtcttcctggacagcaaacacaatgtcaagctgggggactttggactagctagaatattaaatcacgacacgagttttgcaaaaacgtttgttggcacaccctattacatgtctcctgtgagtattttagaattcaacttttttttttccctgagacaggatttctctgtgtagccctgactgtcctggaactcactttgtagaccaggctgtccttgaactcaaagtgatcctcctgcctctgcctcccaaatgccgggattaagggtgtgagctaccacacctggcctagaattcaactttttaatatcttaggtgaagcattcagatgcaaagaactgaggcttgggttgctagtaaatccagtagctcagaattcacaatacaatttaagtttgagtttgactttgttcccctaatgttggggattgaacctaggccctcaggcatttgaggtaagcactatgccactgagttacaccccaaagtcttttatatgtattatgtatttaaaaatgtttattatttatgtatatatagtatatgtgtcttgtgagtgagtgctatgtgtgtggtgagaccagaagagggagtggacttaccctatcccacacactcacgctcagggttccaggcaactgtgagccgtctgaccagatgctggaacttgaactcaggacccccgggaagagcagcaggtgcttaatcgctgacccctcctagatttgttttcaaagagacttcctggcaaacagttctctgtattcaactagagctttcaaaagaaaaagaaaactaaggacttatttatgtgtatgggtgtttggtctacatgtatgtaagtgtgccacctgtgtgccaaatgcccaagggggtcagaagacagcattggactctttggagctagagttatggatggattgagagactggaaaccatatccaagtcttctgtaagagcaacaagtgctgttaaccactaagccatcttcagtgtcccccattccccaatgtcccccatcccccagagtttcactgtagttctggctagcctggaattcacaaagatctgcctgccgctgctgggattagaggtgtgaaccatgttgctcagcttttgttttgttcttcaataaccacaaaatgctaaattatagggttacaaataatgtttaaggcaacaatgtttccaaggggaatagtgtttgtttgttttgttgttttttgttttttcaagacagggtttctctgtgtaaccctggctgtcctggaactcactctgtagaccacgctggccttgaactcagaaatccgcctgcctctgcctcctgagtgctgggattaaaggcgtgagccaccactgctcagctgggaatagtgtttaaaggcaacaatatttccgaagatgtcagtcctaaagtggtgacttcagactccctgggagtgtttattttatttttttaacatacggagtcctggacccaaagttaaagcaccgctggtcacgctgtctcagcaggcagctgaggtgaactgagatgctcaggtacttgctgctgctcatgagtttaggacccagacccagggaatggtgcctccacatttagagtgagtctccccagctgagctaagtctagattcccttagtgatatacacagagacttgtgtcctaggtgattttagatgctgttaggtggacagatttagcattacagtaactgaaagtttggtgaggctcaggtcttctcacagagggatccagtgttttagtgttaatttctgcatgtcctgtccttgctgctcttctgcatttacagggtgttcccaaatgtctcactatcataaggcaccctaggtgcatagccttgtatgaattagtcctcatttctgattattagattgtagaacaattgttagggcaaaaacatgacaggtttttaatctgtcattagatgtcaaggtcagggcctgctttttatcccagtctgatttgcatagtgagatcctgtctcaaaaaacagaagcaaagcacaagtaaataccaaccagccctcaagtctgtaaggggcagcacacacacacacacacacacacacacacacacatcctccgtccactgttataaaagcacagcagtatctaacactctccttacttctcccagctgatgtctcagggaaactgagcccattcaggcgctagggcagtggagggcagtggggaaggaggcaggaaaggccgtgcaggggttaacatctgggtgatttcctttgtacttaagcgttctgtgtgcaacatgacaccatggaaaaccgcccagctctgaaaatagtcacaagttcactaagttttatactgtcaccaggtctattagtttgattatttatctggaaagttctagaaatctctgtgaactactgaagaatcctctatatgacagtaactcatgtacccaagcttcctagaacttgtatagctgagaacaactttggatttctttttagaagattttatgtatttttatgtgtataagtatttttcctgaatgtatgtacaccatgtgtattcagtgcctgggagagcacagggcattggatcccctggagctagagttatagactgtaatgagtggccgtgtgggtgctgggagagaagcctgggccctctgcaggaggaccaccttggctgctgagatgtgtctctagctctagcccgccatcgttttctggtcctcatgctctatctcccaagtgctgagatgacaagtgtgagccatggttactttttttgagatccagccctgggctttgtgcctgctaggcaggccctctgctgaccaggctgcattccagccctcaggttgaaacaaagcaagctctcacctccttggtattttcttaccttctcctttaggaacagatgagctgcttatcctacaacgagaagtcggacatctggtccttgggctgcctgctgtatgagctgtgtgcactaatgtgagtgcgtggagacaggcctgcttcaggcaaacactctgggtcctgttacaatagcaacaaccaaacacctggcttgtacaaatttagaatggaacatgtgggactgggtcctgcttttttgttcagggatctgtgtttgcagtgggagggcagtttatagaccaggccaacaaagcagatgcgtcagggtcctggggaaggtctggggttgggagaacaggacgggctctgagtttgacactttcctcctgcgattctaagccattccccagaaccacagttgaacagggatggaggaaaggcactccatcacactggagacagtttgggctgtccttccagatctagcaggcagaagccacgctgctgcagaatgtccagagcgtatggacacaccccgagtcagagctgttcaaccctaaaatacagcagcaccgccttgccacagtacggtgggtgatgctgctaaccaccccgctaaccatagccagggaagagtcccagatgaggaagtagagtgtgagacagaggccggtcacccatttattcctgtcctttgtgtttatctgacatttttataacttctccccttctctctttctcgtccctcctttttctttccttttctctcttttttttcttttttaaatcctaggcctccctttacagctttcaaccaaaaagagctagctgggaaaatcagggaagggaggttcaggcgcatcccctaccgctactctgatggcttgaatgacctcatcactcggatgctgaatttaaaggtaatggttgcaaggcaccatgtgacagacatgacatgacagagactgagaggcgtattctgtgtaaagaccaatgaaacctaaaggagcatcggtttccctggctacagtcctattggcacaggtgggcggatgctcacaggcatggagacatgccccctcggcaaccgtgagcctcacttgcagatttcctttccatcttctgctacagtgaaggatggttagtggtatggaaggactgaggaaaggccaatttcagccctatagtgggaagggaaggagccaggatgcactgtgttcctctcccctcaccatgagggatgatggattatgaagggaaggtcaacagggaaagaaaagatcctgaaatggtcttctagctggtgggtggcctttgtcagctgaggaaagagtgaatccgggagctgtgggtttgtggaggatgcaggggcagggatggggaacaggtaagatggaaggtcatgaggatgtccttcttggtatttagagaaacaggtctcacttccccagagcagcccagtgatgcccagtgatgcccagtatgcatggaggagggaggagttgtgcccgcctgagccagctccttagaaccagagagaagggagaaacaggcagccaaactcaggtcatggtgcagacccagcaccttgtgaccagtgcacttgctttttcaacctgatatctctagatgcaggaactgtcttttgtcttgtttaccctgctaatgtagctgcttttcttaagatgaatctgatctgccagccacactgtttctctaggactaccatcgaccttcagtggaagaaattctggagagccctttgatagcagacatggttgcagaagagcaaaggagaaatctggagaggagaggacggcgctcaggcgagccttcgaagctgccggactccagccctgtgctgagcgagctcaagttgaaggaaaggcaactgcaggatcgagagcaagcactcagagctcgggaggacattctggagcgtgagtggtgccccgagccagggagtcagccgggcgcagtggggagatgggaccagggtctaaacagaagagcgtatattcacaggctgttagaaagagcctttatttctttttagttgtgggttctggggattgaacccaggatcttatgaatgccagtgagctacatcccagcatttttctctcaaggcaggatctctctaagttacccatgttgaccttccatcctcctgctccagcggcttgtgttaccaagcctgacaacttttataaaccagtgattctcagtctgtgggttgtgacccctttgggaggctcaaatgacccttacctaagaccaacagaaaacatttatttcccatgagtctccactcctttgtccatctccaggtggtacacacacatgcagatacacccaggcatggtaacatcatgacaactctatcacatataccctgaacaaatatatatatataaataaaacttcattagaaatattccattagaaaaccatcccaacaacaacaaaaagtaaggagaaagaagcattgtaagttctgtcagttttgtaacggtgagcacttaaaatagtcggtgctccagacagagctccgccatgtcttacggaagttaaatggctgtcagagggaaagggttttaaatgagtttttgagcttcacgatgaactcagaatgttcttagatagcaaggctgctaagttctaagcacttttcagtaatgaaagtgagttgcagacagtaacttacttggttgtaatctttgtcatcttgaatgagttacatttatgactgcaaggaccaaatacaacattcttcagtttatgtcaaaggatccgattattccaaatgaaacttcagctttggcaaaaacccaaaaaggatgaaaataaaatttacatgctgcctaccttatatgcttttttttgaggaccatgacattgaaccagacaaaaggattacaaagatagtttctgtgtgagaacacttgcacatgcttgcagacaagacatttcattgtattttccaagtctacatgatgcctgccccatttgcattgccagaagtccgttcattcagtcagagctgaagctcttcgtgagacagcacaagaggagttgactgaacttgctaacggcgctgcagtgagagccgacttctccacagtgccccagctacacaactctggatcaagtgtttgcagctgtacctgctgtagtctttaattttttaaccctgtttttaataatggttctcaagtgctttaaactgccttctccagcccaccacccaccagaggtagtggaaaaggaaggtattagggtacaggggcagtggacctgtttagcaattgttttttggagcaaatctcatttgtgttgtcaagaagtcagcagttgaatcatcagtggtggggctcttaatgcactggcagaccgtcagtctggtcctgttgggatagcagcaggatccagcagcagtggcaccgagcagagacgtgtgcccttgcatagactgccctgagaatttctgatctggtgagaaagcaccaacctccacttttgcattaaagtttgtttttactagtactgtcgcaaaatgtagcaccatgcttcaagacaaaactacatttatttgtaattaggagtaaatatttcacaatatataactaagtatatttttatgactaatcactgagctttaattatgttcaatttgtaacaatgaaaatagatcctgcatatcagatacttatgatttgtaacagtagcaaagttatagttagaaagtagcaacaaaaatagtgttatggttggtgtcaccacagcatgaggaagtgtactaaagtaccccagcattgggaaggctgagagcactgcagtgcagggaccttcccagcctgcaggtggcaggaagagagaaagataggatggccaggctgcagtagataggtttatggtcagagctccttactcattggtttcctttttcatccccttttccaagagaaggaacgtgaactttgtattcgagagagacttgcagaggacaaactggccagagccgagagcctgatgaagaactacagcctgctgaaggagcacaggctcctatgtctggctggtggcccaggtatgcccatgaactgcacacagctccacctcacatgaggatgtgcaccacagtgtggcccctgagtgggttagagccccagatttcaggatgacgtcattgagtctgtgctcctgagtggactgaggctctgctggtgcagtgactgagtccctggccgagagacctgataggaatggcaatttcatttcagcttcactcagcataccaaaagcggtggatggtatttaaatatttgagttttgaaatggaaacattttcaaaactatacatttcaagtttttcacaggtattatgttctttggctattgtggtttgaatagctacagcccccatagactcatgtgtttgaatgtttggcctatagagagtagcactatcaggaagtgtgaccttgttggaggaagtgtgtcactgtggggggcagattttgaagtctcctatgcccactgtggaagaaagtccctccttgctatctatggtcaagatggagaactctcagctcctcctccagtaccctgcctgcctgctgctgccatacctcccacgacgatgataatgatggactaaatctctatacctgtaagccagccccaagttaaataccctttgtaagcgtcgccgttgtcatagtgtctcttcccagcaatgaaaccctaagacagttatgtgaccaaaactatatttctctatattttcaagcaaaaatcctggtattttaaaactgtcacacctcagtcatagtaggaactgtggcttaacagccatggtagtataagtctgttatcccagcacttgatttgctgtgagtttgagaccagcctattagacatagtgagttcaagacagtccaaaagaaaggggatggcacttggctagagagatagctcgtcatttaagagcacacactgcttgtcttagtcactgctctattgctgtgaggatgcaccatgaccccggcaattcttaaaagagaaagcatttatctggggctggcttacaatttcagaggttcagtccatgaccatcatggtggggagcacggtggcgggggcagtgctgatgaagtcgctgagagctacatctccatctgctgggatttcctccagcaaggccatacctcttcctccttttcaatcagtgccaatgcctggtgactgagcattcaaatatatgagcctatgaggccattatttaagccaccaccctgttcttcctgaggacaagcagcagcattggagttaagacttcatgaattatagctactgggtaaatgtaaaatcatgtactatgaaatcaactactgcaatatacacgagtgcaccctcccacccaccatgggaacctaatctggatgctggtcagtcctttttaaatcagctgtgactgatgtcagtactgtgatagtaacagccagtgtgagtccctcctgcccggcacacacacacacacacacacacacacacacacacacacacacacagccctcctgcctgcaactccagctccgaggagtccctgatcacttgtcccagagagcatctcacaggaatcagtggataggtcagctctttgatctgtgtgatgtagttgatctcaggtaactcagatccttttctttctctttgtaaagaacttgatcttccatcctcagccatgaagaagaaggttcatttccacggggaaagcaaagagaacaccgcaaggagtgagaattctgagagctaccttgccaagtccaagtgcagggacctgaagaagaggcttcatgctgcccagctgcgggctcaagccctggctgatattgaaaaaaactaccagctaaagagcaggcagatcctgggcatgcgctaggccggcaaggcatggagctgggtcagtgttgatactgacaacccactagagattggtattcagctgctgtcgttttgtgtgtctggttctgtgggcaggaacctttgtgtgtggtgagctcgtggcattgcttgtggtctgcaaatggatgtgtgtgtctgcttcctaatgtccctgtgtgaaaagcaagctgtctttgctggttggttgggcttttgatcctgtgtgtgattactacttggaatatgagatggggcactatagatactatagatcttaggagaaaataatgttagggaaagaatatttaacctggagggctcagagaggctcacacgctgagtgataccgccttcactgtggtttccaagtgaggcctcagcgggtccatgacctcactgctaacgggatgcgtatggcagggcccacagggttgcatgtcagaggtgttgtaatgttacagggagagacccagcctctggcctgacctcctgatgagaagccactcaccagcattcccattccaggacgctcactgtgccagttaacatcagattagaagtggaggggaggggagggcgagggctgaagcttttaggatttgccttagggaagcgcgtgccatggccctcagcacgctgctgtcctgcatcctaggcaggcactggggacaggaggctctgggagccctgagagccccctcctgctgtgtgcagggcctgtccccgtctgtctgtatctgacctctaggtcagttgatgacattagttaagtgtttctgtacctacaagtataagccaaaaggtcggaaatgcctcagagtcacacatgtggtccccaaacatttaatttctgaagagaactgtcttcagaaagttggtctatttaaggtgactggggaaaaggcaggtttcctttgctctctgtccacagtcccttgagatggcttcagaagagaacagtgttcagtgtgcgttattgagggccctgtatgccttcacctgtgtgagggccagattgctgtttgtctacggtttcttgaagacctcagctcagcagaaaggagttcatttgccctaacaagtactgttggctgagaggggaggtcagaagcatgtaatgccattcgtttcatggctaaacacacagactccttgcattttaaaattctgtgcctttacttcctggagctataataacgtgcttgggtgtgtgacttgccgaggttggctttcgcaatgctttatgtaaactctgctgttggcacttgcagctgtagaagctgtcggagggattacttacttacggttatagcatctggggtctcttgcagctgcaatgcctgggatcttttgcaactctgactttttcagtagcagcttggaatgttaaaatatggtgagcctcttctctgtgaaggaagggcctgacaatctgccagcagggaaaagactgggaactcagtgcagtggttttcctgcctttcccttctcctttggtctatagtgatactgacagcaatacaaagtaaaatctgtgtatataaaaatcctaagtatgaggtcttaaatgttctggaattttagaaaaaacttaattggatgcaattgtttataattaacaagtcatcttatttataaattttccaatataatataaatctattttgtggaaatttatcactgtgatgtttgtattctctgtgtgtgtgcacacatgtgtacaaattcacgtgtgtgtgtgcaggtgcaggtagcatagcacctagagggcaacctcagatgtcattgttcaggaaccgtccaccttgagttttgataaggattctccctggtacaggatacaacagttttgccaagcttgctgtctcctaagtcccagggtacttccctctgcctccgcctccctaatgctgaggttacaagcacattttatattacctaacttttttttttaaagatttatttattattatatctaagtacactgtcttcagatgtaccagaagagggcgtcagatctcatcacggatggttgttagccaccatgtggttgctgggatttgaactcaggaccttcggaagagcagtaggtgctcttaaccactgagccatctctccagccccagcacctaattttttatatggttctgggccctgaattaagcgcgccccccccccccccccatgcttgcatagcaagtacctttctggctgagtcatgtccttagcccatgatgcaatttgtttttattccggatgtcatttgtgttccatttttctacagttatgtattcattccactgtaggctgtagtggaacgtactctgatcatggaggctagcactgcagagacgatcgaggagcactaggcaatgttgagaaacattccttgttctgctttgtttttccaagacagggcttccctatgtagccctggctgtcccggttctcagtctgtatagaccaggctggcctcaaagttagagatctgcctgcctctgcttcgtgtgctggggttaattaaagggccaggactctggttcaagaagaggagggaagtgttttctctacagcctccctgattcgtgttacttgctgttaaatgtccttagaaacattggggaactgttagcatgagttttatcatttgtcttcattctgggcaatgtcagttttaagtggaaatgctttgggcttgatcctgtgtggttggactgcacagctcactcactctggttcattcctggagagtgcctcaagcaaggcaggagagactgcactcagccttcaacaatgtgtgcacgtgtgcgtgcgtgtgcgtggacagctggaggaggacctgtgacttactctcccttccccagccctgtgcagtgcaatatcaggactcaggtctagcctaccaccctgctttcttaggtctgctgtcacatggattgtgactagccctgttctgagatgcctaacacctgttcccaggcccctgctgagtgtccttataagaagttagaaactataaccgaaggtgtaataccttccacgacagcagtctgcagtctcagtcacccataaaacttcattttgaagtctggagccagctagacgtggctatatctatctcagactaaccttaattcatgtactgtcaatggacagtcattgagggcctaccatgttaaaacctgacattaacccattaccctggagagcccgaagtctccggcattagatctgtggggtcaggcaatggggagcaaaataaagctggttaaaagagctaggaaatagttgtgtgtgaaccctttttggaaaaggggacattggggttcaagttaggaagaacagcaggtagggggaccctgtggggtagggcaggaggaagggggcttgcagggcagggagaagaagatccttgaaagcgtggaggcacacagccgacttttgcgtcctgccactgaggcgtcgacgcaagccagttccggtccatcgggaccgtatgctggaccagagaggaagctctttgaaggaaggggctgctctgagaggcgattcttctcattaggctttcagcaggttcaccagcgcctcagcaatggtagaaagtggcctcacggtggcgccaaggcgccgcgagtccagcagctgggaggccatggcccagctgagcaccaccagctcagttactttctgtcttaacacccctgcgaagaggtgtcagaaaaaccgaggcacacaggtcgcagatgagtggcacagctggtgacggactcccaagtcaccttggcttggtgaaggatcaggctcccaggaaggaagcgccctgcctgctcctctgcctcccagcatagcagcgacctctttcccacagtgggtgttgaagctttcaattcaaagggtcaagagatgtttattctggagccaaaaatgagtgactgtggcccaggcacacagattcaggttaccccaaaaaccatgttccagcgagctgacaatttcatggagtttttatagtaacaaagtcaggtgcatggaccatggcagggagcccctgctatagccctcagatgccctctgagagtctcagagttggggctggaagaaaatagagctagatgttcacaccaataggtcccacacagaagtgggcaacatgtggctgtctactgggttaaaatggcccaagaccattttgctctggacctgcaacattccaacgctccacaacccctgcctttctgatcacattcagcctggtcggtagcaggctaccacagtgtgacttcttcccagagcttagcgtgggttaaggtgaacgcccaccctgagcattgcctgttgcttgtggttccagcgctgtagtggctgaggcaagataattaggatataaggttatccgcagctccgtagccagtgtgaggccagcctgggctacacagtgtgaagccagcctgggctacatgagaccctacctcagaaaaacaaaaaacaaaataaacctttaaaaatcggtaacaataaacccccaaaccgccgggcgtggtggcgcacgcctttaatcccagcactcgggaggcagaggcaggcggatttctgagttctaggccagcctggtctacagagtgagttccaggacagccagggctgcacagagaaaccctgtctcgaaaaaccaaaaataaataataaaataaaaagcagaagagtttttaaaaaaaaaacaaaaaaacaaaaaaaccccaacccaagacaactgggcagtttagcaagatgggccagagtggtgtgatagagtcaggtggcccttagacctggcgctgaaagaggtgactgggcaggtttaggtagggtagagtagatttagctgctggttttaaagcaagaccccgggaggatgggtctagaatgatttttcttcctccagctttcctcgatgttgtctgccatatggaggcccgggccagatgcctgagacacccaggctgctcagggcccttccctgaagtctgtcccacttacagacaggtcttgttgtgagaccaaaggcaaggctcccaactggattgggctttgaaaggaatgaagagaatgcgaggtgtaccaggagtgctcagtgacttggaaaatgaggacccgcattgatgggtggatttctcagaaagatgttgaaatcagtctcaccccagggaggttcatgctggctgatggcctgcaaatggacctaggctgttcttacccttttcccatccagaacttatctttcccaagtgccagggttcctctaccaccagctgaatgtagtcagagccacgggcatctgtgcaaaacctcaggccagaacacctctgacccatgcatccctctgcttcctctcagcagccaattgaccttttgtttgaagacaatgtccaagtggctgctgggctgactctgcaagtggagatgccctgggggtggggggcacccagcagctacccaggctggttcattgtctaaccctctgagactcagttcctcaccggtaaacagaacattagtcctggaaaaggtgaactgtgtttaagggcctagaccagtcctgagcaaatgtattccatgtggccctgaggaggatccaaaagggcttgggttataatggatgggctctaataaaatgcaaatatttaaactaagggggggggagcatgagtgaaaccaagaataaatccaacataattgcagtaattacacccggagccaagccttgagggagcagagcattcactgaggtaaggcaggagagacatctcagggtgtggcataggcctttgctgaacctccgcctgcaatggaccgggcagtattgtctggacatcttgttaaaatatagattcaattcaacagatgcagggtgggccagataatctgtcctaactgctctagggtagactgctcgctgtttggtaatttcccaactgtacaggaggggctgagagcccaccaggctcagggagctgtgcaaagcaggtggttgaacaggggacaaagtagacccctattggctgctgtctctgccccagactgaagtcccatgtgatcacaagctgaattaatagagaagaaaggctttagaaggcttttcatgcccagatcccatttatcactctagtatatgggagagcatgatttgacacccccagagcccttggcatcctgtgatacaggagaactagagagccctcctgctctctgtatctgcctggaaggggtttctggggcaaatctgcctgggcaggagagggccatatatgggtcaggggccaagtgggccccaaccatgtttccaggatcgatcagaggaagtggccagtaggttgtctaaagcaaagtgacactcaccctccatgccagcaacagatgtcctcaaggtgcccaggacagactggtctagggcagcccatggaccagccagactcagagcatggagctgtgagccagccaggggcatagttcacctatggcaactttcgtgatgacacctactagggggacctgggagggaaaatggctcattaaagttgaactttggagttaactgaacatttaaaccagttaattaacaagcaaggactgtttccctcacaaaccaggtagagatggtgggaacagctgtcattgctccctgggtagaacagatacgtttcagcagaggcaacccaatctatagaggctgtcctcacagccactgcacgaagctcagccccacgctgcctcaatggatcaaagatgcaagaacaggagactggatttactaatgtggggagcactgggggttcccttagaaaggagaaaacagcagtatccaggagaggcagaaacattccagctggccgaggggaagggctatgagatgggctaagggaagcagggatgtggctcagtggttgagtgttttagtagcctactggaatccctgggtttgatccttaacaacacacacacacacacttcaagttcatgtccccagtgacctaacttccttccactccttcctttttgtttgcttatcttttgagacagggtttctctgggtagccctggctgtgctggaagttgttctgtagaccaggctggcccagaactcacagagatcttcctgcctctgcctccccaatgctgggattaaaggcatcccacccaccaccctttaataataccatgatctgggggcttggagagatggctcagtggttaagagcactgactgctcttccagaggtcctgagttcaattcccagcaaccacatggtggctcacaaccatctgtaatggatctgatgccctcttctggtgtgtctgaagacagctacagtgtactcacaaaaagtaaataaataatcatcatagtgatgatgacgataataataataataatacaatgagcagggaggaagcctttagcacatgagccttaagggaattgttcaggtgcaaactgaagcaatggcttgagagtgttcaaagcacttgtaatttctcaatgtgctgttctgttcttggccctggggagacagaccagtaatggagcctgtcagtgtgggggctgtagagcatcctggggagggctagctgccctgggtattggggatgctgttttcagggacctatattcttttgctctcttctcccggcccctcccccaatacaaattgtaagcgacgcacacatgcatgttgacatgtctgcccttgaaacatgctgtgcaagaggacaggaggtatcgggtgctggaaacgggacagcttggaacgctctggagtctcttgtgagggtgtggcttaattaggacgaccttcaggtgtcctgctgtagatttgctgtggcagtggttagctcttactttgcagtagggacttaggggtgtgggagggctacaaaagtcacacagagccagagagcccggcacctgaaaagcagtcactctgaggctcctggctgttctcctccatcacacagggcaggattaattattaatgtttacgatcccatagaagctggtctctgtgaaccacaagcctaacacttcttttccaacctccaaccacttaatcatggttttggctgggtcagcgtaacagccccataacctcggaaacagagtgctgtgaagtcctttatctgctgttcctgggggcaagggccaagttcactgggtgcagctggcggcatgggagctgataatgctctcgaagaaacccagatgtctttgttgcctttcagagctgggcctcatcacgcccctttcccggtgtgagtcttcccttcccttcttgttgcttagctgcggtcggcagagccttttcacacacacagtctcagtagctccctaacaaggctgcaacaggcctagacgaattctgttctcatacagaaaataaagatgcagagagctaagatcactgacacccaagaactccaggcatcccagtgttaaggcaggacgctggtttacagactttagtgtgctcgggactgtccatgacttccttgaaagggtcagtgggtggatttttctggtagcctacagacttcatcagactcttcacatctgagtcaggagaagtggttgctttcaaatcagcacaaagacttaccatgcctaccgatggtgccacctgctgggttctcagattggatggtagagtcatggccaagggtgtggccaccctggggaccttgctgctcttgaccatggaagactccagacggcaagcagcaagcctggagacctgaagttgaccccacactgtctttggggagcacaggcggcttccatggcagagagagatacacatatgacaccaccacaggtttgttagatcacaaggaattaaccactctgaaatgagaagtagccatactttcatagcacgcctgcaccatgctaacccatccattgtgttgcaaaaaagattcccctgacagtgacaactcagacgagtgaagatgtagggagtgtgaagcactcacaaaatccacattcaactgactgtagagcacatcatggtgtattcattaatactgaaatatccagtttgtcttgtctgtgtctgcatgtgtgtgtgtgtgtgtgcacacgtttgtgtatgtgtgtgtgcaagagtgtgcgtgtgcctgctcgtgtgtgtgtgtctttgtgtgtgcatgagtgtgtgtgtctgtgtgtgtgcatatgtctgtgtgcatgcacatatgtgtttgtgcgtgtgtgtatgtgtgtgtgtttatgtgtgtctgtgtaattagggcagaaaagtgccattcagcagtagagtgctctcctagcacacatacagacttgggctccatctcccaagcctgtgcagcatggcttacaactggtggctgcttggagcaggccccttttcaggctctgcctggggctaatctggagacaggtggggatggcttgctgcaaaccagctaaagtgacagtgttaccattccagggctcgaggaaactgtgagagtccaaagtctccggtgtcacgagccctgatgtcaaagattccctcagccagagcccagcttcccagaaacctcccaaacaatcagcgataggcaaattagctacaagaagctggctggcagccagcttggggctggatgccaggcctgagtggaatggacccaggagacttctgcccccggtggcctatgaggtcagctcctctcctcagcagatgctacacaaagtgtaggcacaggtagctagatcacttgaggctagccaaggctgctcagggataagctgggctgaacaagctatgcctcagcctggggcaggtccccagcaccttggcctccgaggacgcccagtacaagcttggtacatcctctgacatttagacagcagaactcacacaaggcaccttatatggccatgtggggcagcgagtgacctctctacatgccgccctgttttcactctgggctgtggtttatgagggagcatgtgaggacagcctctcaggtgggaagacagtggaggaagccacagggcagccagtggactttgagctggggctgtgtctcaggtgtaggtgcctagtctctcatcttccccataggggctgaggtttcctctagtctgtagttgaggaaacaggcttagagtcaaccagttaaaccctggctgggacgtttcgagctgaaggtagtaagactcgaagccacatgtatgagccacatgttaggctgcttgcccggctctctgtcattatgggacagttgtcacggatctgccactgaaaccccaggccagttcttgggcccagtgtcccccatcacccctgtcttgcttctttaagcacattcccagggcctctctgttctctcaggagttggtctttgagaacatggccatagccctcttgagcaggggtggcatatgacttgtccacaacacagactctccgagcccacacccacctagaaaaccaggtggatttggaagtcagcgtttaagaggaagagcttgtggggctagggctcagttggtagagtgtttgcttaacaaacacacggctccccagcatgatgtaaatcaggtgtccatgtggaacacgtgtctgtaatcccagcacgcaggaggctgaggcaggaggattggaagtctgtaggagtgacgataactaaggactcctcgccattctcttgcttccctgggcaccacctgagctggagggaggtcaggcttgacctttcatctccttgtgactttctgagccagttttccaagccactctcatctcaccacggagacccgaactggggcacagtctctttgacttgaagaaaatggaacgtattattgggatttttagaattcttcaatgagttgtcacaggaaaatgcttcgctgtggacttggtgtgagactggatgctgagatgatatccgctgcatcagctgggagggtagtgaagtctgcatgtcccagctgccccagcaaagaggcctcttcctcccacaattcactgcgcgcaacagggctttccgagaaggaaggctcacctgattggcttcactgcatggtgcctcacttccgagtgcgcatgtctacatcctgatgtctcctcaaccctggagattgaagcagcccgggaacagcctgcactgccggctctggaaaacgctggggactgggatctactggctttgttttttatgctgaatcagttttgaaacattctgccttggtttttttcctattactttgataaaaccccacgaccaaaagcaacttgggggaagaaacggtttatttcatttacaactctcaggccacactctaccactaaagaagtcagggctggaactcaaggcagagactgaagcagaggccgtggaggggcactgcttagcggcttgttcacgatagctcgtttgcctgctttattccacaccccggaccccagcccagtggtggtaccctctcacagtgatctgggctttccatatcagtcaccaatcaagacgggtcaatcttgtgggagtaattttctcaattgatgtcccctcttcccaaatgactctagctttatgtcaacttgggggaaaaaagaaaagaaaaggaaggaaaagaaaagaaaagacccccagctcacctctttctctcttcccagtaa

SEQ ID NO: 1464 - DNA, 3130 bp, Mus musculus
cgggtttcggcgcggttggcctgcagcgggcgagcctgggctccgagcggcgcggtggtgtggttgccagggtggccgctcgccatgccgtcccgggtggaggactacgaggtgctgcacagcatcggcaccggctcctacggccgctgtcagaagattcggaggaagagcgacggcaagatcctggtgtggaaagagcttgactatggctccatgacggaggtggagaagcagatgcttgtgtctgaagtgaacttgcttcgggagctgaaacatccaaacatcgtccgttactatgatcgcattattgaccgaaccaacacaaccctgtacatcgtaatggaatactgtgagggaggggacctggctagtgtcatttcaaaggggaccaaggatagacagtacttggaagaagagtttgtccttcgagtgatgactcagttgacgctggccctgaaagagtgtcacagaaggagcgatggtggccacactgtgcttcaccgggacctgaagccagccaatgtcttcctggacagcaaacacaatgtcaagctgggggactttggactagctagaatattaaatcacgacacgagttttgcaaaaacgtttgttggcacaccctattacatgtctcctgaacagatgagctgcttatcctacaacgagaagtcggacatctggtccttggcctgcctcctgtatgagctgtgtgcactaatgcctccctttacagctttcaaccaaaaagagctagctgggaaaatcagggaagggaggttcaggcgcatcccctaccgctactctgatggcttgaatgacctcatcactcggatgctgtttctcaaggactaccatcgaccttcagtggaagaaattctggagagccctttgatagcagacatggttgcagaagagcaaaggagaaatctggagaggagaggacggcgctcaggcgagccttcgaagctgccggactccagccctgtgctgagcgagctcaagttgaaggaaagccaactgcaggatcgagagcaagcactcagagctcgggaggacattctggagcagaaggaacgtgaactttgtattcgagagagacttgcagaggacaaactggccagagccgagagcctgatgaagaactacagcctgctgaaggagcacaggctcctatgtctggctggtggcccagaacttgatcttccatcctcagccatgaagaagaaggttcatttccacggggaaagcaaagagaacaccgcaaggagtgagaattctgagagctaccttgccaagtccaagtgcagggacctgaagaagaggcttcatgctgcccagctgcgggctcaagccctggctgatattgaaaaaaactaccagctaaagagcaggcagatcctgggcatgcgctaggccggcaaggcatggagctgggtcagtgttgatactgacaacccactagagattggtattcagctgctgtcgttttgtgtgtctggttctgtgggcaggaacctttgtgtgtggtgagctcgtggcattgcttgtggtctgcaaatggatgtgtgtgtctgcttcctaatgtccctgtgtgaaaagcaagctgtctttgctggttggttgggcttttgatcctgtgtgtgattactacttggaatatgagatggggcactatagatactatagatcttaggagaaaataatgttagggaaagaatatttaacctggagggctcagagaggctcacacgctgagtgataccgccttcactgtggcttccaagtgaggcctcagcgggtccatgacctcactgctaacgggatgcgtatggcagggcccacagggttgcatgtcagaggtgttgtaatgttacagggaggagacccagcctctggcctgacctccctgatgagaaggcactcaccaggattcccattccaggaaggtcctctgtgccagttaacatcagattagaagtggaggggaggggaggccgaggcctgaagcttttaggatttgccttagggaagcgcgtgccatggccctcagcacgctgctgtcctgcatcctaggcaggcactggggacaggaggctctgggagccctgagagccccctcctgctgtgtgcagggcctgtccccgtctgtctgtatctgacctctaggtcagttgatgacattagttaagtgtttctgtacctacaagtataagccaaaaggtcggaaatgcctcagagtcacacatgtggtccccaaacatttaatttctgaagagaactgtcttcagaaagttggtctatttaggtgactggggaaaaggcaggtttcctttgctctctgtccacagtcccttgagatggcttcagaagagaacagtgttcagtgtgcgttattgagggccctgtatgccctccacctgtgtgagggccagattgctgtttgtctacggtttcttgaagacctcagctcagcagaaaggagttcatttgccctaacaagtactgttggctgagaggggaggtcagaagcatgtaatgccattcgtttcatggctaaacacacagactccttgcattttaaaattctgtgcctttacttcctggagctataataacgtgcttgggtgtgtgacttgccgaggttggctttcgcaatgctttatgtaaactctgctgttggcacttgcagctgtagaagctgtcggagggattacttacttacggttatagcatctggggtctcttgcagctgcaatgcctgggatcttttgcaactctgactttttcagtagcagcttggaatgttaaaatatggtgagcctcttctctgtgaaggaagggcctgacaatctgccagcagggaaaagactgggaactcagtgcagtggttttcctgcctttcccttctcctttggtctatagtgatactgacagcaaacccaagtaaaatctgtgtaaaaaaaaatcctaagtatggggtcctaaatgttctgggaatttagaaaaaacttaattggattccattgtttataattaaccaatcatcttatttaaaattttcccaaataaaaaaaatctattttgtgggaaaaaaaaaaaaaaaaaaaaaaaaaaaaaaaaaaaaaaa

SEQ ID NO: 1465 - DNA, 1332 bp, Mus musculus
atgccgtcccgggtggaggactacgaggtgctgcacagcatcggcaccggctcctacggccgctgtcagaagattcggaggaagagcgacggcaagatcctggtgtggaaagagcttgactatggctccatgacggaggtggagaagcagatgcttgtgtctgaagtgaacttgcttcgggagctgaaacatccaaacatcgtccgttactatgatcgcattattgaccgaaccaacacaaccctgtacatcgtaatggaatactgtgagggaggggacctggctagtgtcatttcaaaggggaccaaggatagacagtacttggaagaagagtttgtccttcgagtgatgactcagttgacgctggccctgaaagagtgtcacagaaggagcgatggtggccacactgtgcttcaccgggacctgaagccagccaatgtcttcctggacagcaaacacaatgtcaagctgggggactttggactagctagaatattaaatcacgacacgagttttgcaaaaacgtttgttggcacaccctattacatgtctcctgaacagatgagctgcttatcctacaacgagaagtcggacatctggtccttggcctgcctcctgtatgagctgtgtgcactaatgcctccctttacagctttcaaccaaaaagagctagctgggaaaatcagggaagggaggttcaggcgcatcccctaccgctactctgatggcttgaatgacctcatcactcggatgctgtttctcaaggactaccatcgaccttcagtggaagaaattctggagagccctttgatagcagacatggttgcagaagagcaaaggagaaatctggagaggagaggacggcgctcaggcgagccttcgaagctgccggactccagccctgtgctgagcgagctcaagttgaaggaaagccaactgcaggatcgagagcaagcactcagagctcgggaggacattctggagcagaaggaacgtgaactttgtattcgagagagacttgcagaggacaaactggccagagccgagagcctgatgaagaactacagcctgctgaaggagcacaggctcctatgtctggctggtggcccagaacttgatcttccatcctcagccatgaagaagaaggttcatttccacggggaaagcaaagagaacaccgcaaggagtgagaattctgagagctaccttgccaagtccaagtgcagggacctgaagaagaggcttcatgctgcccagctgcgggctcaagccctggctgatattgaaaaaaactaccagctaaagagcaggcagatcctgggcatgcgctag

SEQ ID NO: 1466 - DNA, 32835 bp, Homo sapiens
cgccacacagcccttagcgtgttgcactgttgcagtggacaagctctccgggatctggcaaggatggtgaagtctggtcagaggctagatgccaggcctcacagcacagctatcacaacagaacctaaactggaaattgggtttttgctgttgtttttttaaaaatcccctgcatctttgttgttgttgttgttgtttgagacggagtctcgctctgtcgcccaggctggagtgcagtggtgcaatcttggctcactgcaacctctgccctctgggttcaagcgattctcctgcctaagcctcccgagtagctgggactacaggtgcccaccaccacacctggctaatttttgtatttttagtacagacggggtttcaccatattggtcaggctggtcttgaactcctgaccttgtgatctgcccccctcagcctcccaaagtaccaggattacaggtgtgagccactgcgcctggccaacatcttaaactaggtaagccacataagctagctttcaagatcttgaatctcgagtagatcccagctggtcttcagtttttatctgccactcaccaccctgagtcaaatacttaaggtctttgtgcctcaagtttctcattggtaaattcctatgggctgttgtgaaacagaataagatgatgcttacccagtgtctggcctgagagctcagtaaccagctgttctaagaactagaggaacaggctgtagctttaggctttcctttctgccctgggatgttctccctgtcaaaaacaacagcactgagactgctgtcctggtgggttccaccgaaggattaacactgaacagcaacaaaaaagggtgcgggctcttcctcctggaccgaatgcacactcgagtttgttgcaagtacctgagagctcattgcctgccttggctgtggaataggcccatgccggtgcttatgtctttctgttctatcccctgaaagtcaaaacaaaagtttcttgtcttgaggtaggaggtgggactcgactccagaggtggggcttggacaccagactagattgaggactagctaaaacagagccggggtgaaagcagctttgaatcagacatgcccaccactgagacatgtcaatttactgtagccatggcaacacctgggcattaccacccctttccatggtaatgacccaatgacccaaaagtgcctacccctcccctagaaatctctgcataaactgccccttaatctgcatgcagttaaaagtgggcataaatatgactgcaaaactgccctgagccgctactccctgcctaagttagccctcctccgcaggagcagtcatggagttgtaacactgcttcttcaataaagctttcttctacctctggcttgcccttgaattctttcctgggcaaagccaggaacccagcaggctacgctccactttcgaccttgcctgccctgtatcactgacttccttctgaaccctcctcacactaagcagatgctcagccacctgtcgccttttccccactcccttagcccttcccaaggtctgggctgggttgcattcagattggtgtgatcaccactttcatggtggcacagcttgcttggggaactcaccgatggcggataaggggaaggcgtgagttgtgacatgtcctataaggtactatgtcatgagcatggaatatgaaatcagctgcaggctgatgccatgtgggtggtgccctcctatgtcggggtgggaggcctcctgggcaggattctttttctcctggggcacaggaacaaggtgcaaacaggcagaagggcaggtcccacagctgctctggaaggctgaccaggctgtccacacacactctatcaacccccctcactatcttgtcccactgtaacttctgctggctggcttcagccccactcaacttgcaaatgctcttagggaggttgctatactctccaaatgaccaaacgagtgtttacaactctgcccttaccttatttgctctttctgcaacatctggcatcatggaccacttctgcattctggaaaccatttcttctatgggaacctgtgtgacaattttttccatattctctcctactcccctggatgcttcccttggtctccttcactgagttttcttcctctgcttgcacagaataacctccagggttccttcctttctcccttcctgctctgccactcttggggcatattcatcttcaaacgtggcttctgttatcacctcccagctctctgtctctggcctagaccaatctgttgagaccttgtatccaactgcgtgttggccagctagctcctcataggcctttggggctcaacatgaactcagtatcagctttacccaagctgctcctgccccagcatttcctcctgtggtgaactacgctaccatccatctggtcactcaagccaggaatttccctccgtttaccttatgtacagttgatcaccatgtctcatctaacccaccttccaggcatttctggactcccctcttcattcccacagccattgcctcagtttagccagtgtcatttccccagggttgctgcgatagcttcccacgctgtattcctatgccctgcattcactctttaccagagaagtctttctacagcacacatctagtagtgctcgtctgctcaaagcttccactgtgagtccatcaccttcagtagacttcctcaactcttgggtcttcctgctcacctgtccatccacctgtcttacaggtaacgaaccacaggtaccctttggtccaccaacccaacctgcagctcacagcaggcctccatgcttttacccacagtttcccttctcctaattccaactgctcctttagatgggattcaagtgtcacctccccaggaacatttgccctgacccccatgccctgccatctttatcagaatctgggtcctcctctttgcattttaggcaaagctctttcagagcaattatcatactacatagagagagctgatttacacagcagttccagtgaagttttggtgagaggggatggaatcacaacatttagagtaggaagggttcaacaacttcattttacagagcccagagaagggatgttgaaaagctaatgcagacatagctacttaacaaaaattgtcattcggggtcagaccaatgactaaacagcccagtgttccagtgaggtgaaatggattccctcggtcacataactcattaagacagaactaggccagacacggtgactcacgcctgtaatcctagcactttgggaggccaaggcaggaggatcacctgaggtcaggagttcaagatcagtcttgccaacatggtgaaaccccacctctactaaaaatacaaaaattagccgggcatggtggtgggtaactgtaatcccagctactcgggagactgaagcaggaggattgcttgaacccagaagacggaggctgcagtgagccaagatggcacccctgcactccagcctgggtgacagagtgagcaaacaaaccaacaaacacacaaagaagacagaactagaagagcctgggaacctggagctcaagctcactgctcctaccatcactgtgctgcccccgatggaaaaggtaggcgtgtcctctaaaacctcctaagtcccttagaaacacattatggtcctgtgcaaggtggttcaggctgctataataaaatactttagactgggtaatttatgaataacagaaacttatcgcttacagttctggaggctggaaagtccaaggtcaacgtgccagcagattcagtgtctgatgagagcccgtttctcatagatggcatgctctatgtgtcctcacatcatggtagggcaaacacatggcaaacaaactccctggggccttttgtattaatataagggcactaatcactcccccagaggctccacctcttaataccattaccttgggggttaggtttcaacatacgaatttagggaggtcacaagcattcagactctagcaggcctcaccgtccataattagttttaacatttgtcttatcacatttaggtgatgaatattcttagagataacaaatatcctgaatttacaagtaacaggaaaaaacatggaaaattatgaatgtctgtctttgtctgaaagtttatccttatattgaaaagaaatgtttttccctaatttgtacccttgggtataaattcaaaactattgccttttaaaatgtgatggagctcttaactaaacactgtttggtttcaaagataactttcttctcatcatatcctccagctgcctgccatttagctgaagctgtctctcagtctacatcttgtcctgtttatctcacgtggtatgtggctgttaagaacagtctgcctaacacctcattctttgttctagaacgtggttatttgttgagcatatagtatgtcatgcatcttttttttaaaagcatctcttagcttctgattgttataaacaaagaatctctccttttttctttctagaaatcttttttaatcactcgaaagaattgccataatccctgacttcaaattgcttcaagtaattgtggagataagacttatacacaaatgtcttgtctgattttaaatcctacacatgcaaatctggggatttcctgtagggacaggcggagtagtgctgccgcgcaggcgccagctcctcgtttattatgcagtgatgtacagccctctagtgggtctttaatgcaacataaaaaaacgaagctgagggcaatgaagtatggctttgttcattcatccattcatttgatgtacaagtgctgggttcctgctttgttccaggcacattttaggtgctgggaatactgcagtaaatcaaacaaacagcaacaaaatcagatacattagttactggagactaagaagatggagaggagaacaaatttgggatgaagatcaggaacttgatttttggcacattaagtctgggatgctcattaatcttcaagtagcttcttttaaacattaattaggtgccggatgcagtggctcacacctgtaatcccagtactttgggaggccgaggcgggtggttcacttgaggtcaggagtttgagaccagcctggtcaatatggtgaaaccctgtctctactaaaaatacaaaaattagccaggcatggtggcctgcacctatagtgccaactactcgggaggctgaggcaggagaatctgttgaactcgcgaggcggaggttgcagtgagccgagatggcgccactgcactccagcctgggtgacagagtgagactctatcacaaaaaaaaaaaaaaaaaaagaaaaagaaaattaaaattaaaattaatcaggccaggcgtggtggctcacgcctgaaatctcagcattttgggaggctgagaggcttgagcccgggagttcaagataagcctaggcaacttagtgagacctcatccctacaaaaagttaaaacaattggctaggcatggtgatgtgcaccggtgatcccagctaactcaggaggctgaagtgggaggattgctttaagcccaggaggttgagactgcagtgagctgtgatcgtgccactgcactccagcctgggccatagagtgataccctgtctcaaaaaataataataatagcaatcagtgtctctatggacatgtacagagtgcctgtgggagaaaatgcaagtgcaaatactctcttatttgagatttcaccaaatttaaatgaaaactgacaacatgagcacagttagcaagaaaagtgtgaagacagtgaattagaccatgggtgtggggagagtggttatcgagaagttcaagggttggccccactcttatagagttgctcatcttctttctctgtttaaatggaatcatctcagttcttcgtttgttttcttcttaattcttgccacaatttgtcacagtggagtttctctgtgtacttaggttacatccatctcttccacctacaggactatatgtctgtcctattcactgtggtatcctcagcatctggcacctgactcagcctctatttatacttgttggaggatgaattttccatttaataaggcagagaagatacatgcacatgagaagctagtaatatggcctagtataattctaaatgagtaaaaacacagttgattactcttaagagtaattagaagatagatcatagtgggttgaagtcaatcaggaaaaatttcagagaagaaattgggcatgagctgagacttaaagaatggatggaatatgaaggaaaaaggaaagaagttataggggaaaggatgttccctgtaacctgtccctgtttgactcccacatgcttctcatctcccagtgtctctttctattctggtgtctagtggtctctgctgggctgtcctgccctcactcatgatgcgggctaactctggccaacctttagggtttgtcatgtgagtgattcctatgctaccctttttttttttcttttttttgagacggagtcttgctctgtcgcccaggctggagtgcagtggcgcgatctcggctcactgcaagctccgcctcccgggttcacgccattctcctgcctcagcctccccagtaactgggactgcaggcgcctgccaccacacccagctaatttttttgtatttttagtagaggctgggtttcaccatgttagccaggatggtctcgatctcctgacctcatgatccgcccaccttggcctcccaaagtgctgggattacaggcttgagccaccgtgcccggactttttttttttttttttttttttttttgagacagggtctcggtctgttgagcaggctggagtgtggtagtgcaatcttggctcactgcaacctctgcctcccaagttcaagcgattctcctgcctcagccacccaagtagctgggactacagacgtgccaccacacccagctatttttgtatttttagtaaaggcagggtttcaccatactggccacacccagctaatttttgtatttttagtagaggcggggtttcaccttattggccacgctggtcttgaactcctgacctcaggtgatccgcctgcctcggcctcccaaaaggctgggattacaggcatgagacaccacacccagcctcctgtgctactctttattattgtctttggggctccactgtctttttttaaatgaaaagccagcatgtcaatacctatcatacctgggccatagcaagtgctcaataaatacttgttaaatgagcatatgtgcgtaggagccacattccatactcttgggatggctcctttccagatatttcgtctctgcctagagctggggcatttggcaattgagtacttgagggcccactcaaaatccttgcataattattaataaggggctttcgcagatttttatttaacgaagctttattgcatgccttctctattacaggacttatgctggctataagcagttcggagttcagctactgtgagagccatgtaaacaaataatgataagttttgatttatgtataaagtggtctatgaacactgtagatggaggattgactgtccaagtacgccagagaggcttctcagattacaggagaaaaagttggaattgaatcttgaaggacacgttatgtcctctgggcagacatgactggagtggataagggagtgggttggacagtattctggacaaatgcaatcacaggtgcaaagatggtggtggtggtgaggaactgagaaagtgtgcgtttagagcaaaagcagaagtggccagagagaaggtgcaggactggatttggggcaggataaccaaacggctcattttttttttttttttttttcttgagacggagtctcactctgttgcctaggctggagtgcagtggtgtgatctccactcactgcaacctctgccacctgggttcaagcgattcttctgcctcagcctcccgagtagctgggattacaggtgcctgccattgtgtctaatttttgtatttttagtagagacggggttcaccatgttggccgggctgatcttgaactcctgacctcgtaatccacccgccttgacctcccaacgtgctgggattacaggtgtgagccaccgtgcccggccagggctctgtcttatacagtttcatgttgctataataggatgccacagactggacaatttataaacaatagtttatttggctcacggttctggaagctaggaagtccaagatcaaggggtagcatctggcagcagccttttctctgggtcataaaatagcagaaggcatcacatggtaagagaaacagcaagggaaagccaaactcatttttataaccaaccgactctcaagataacccactcctgtgattacgttaatccattcgtgaggggtagccctcataacccaatcaatttaaaggtctcacctcttaacacttttgcattaagaataaagtttccaacacatgaactttgggggatacattcaaaccacagcaagctctatggataccaatctgtaagaggcacaaaaataaaaaaatgatgctaattaacacagccacttgcagtgccttacataacttttgaaacctaaattggtcctattcccctgaggtaagacagtgcccttgaatgttaatttaaaaattctcctggttggcaattccaattatcttatgttatattcagggcatgtaataagtcccttatttttacataaagagcttttaaattcttattaatagaaaatcaggtgtcttttaatcctttgctgaacagatatttaaagaaaactggcctgttcatgcatttccaaattattagctttctggtaatttacatattcctctaacaagccctggatggaggcctctaagtcctccttccctggtaaacatggggctgttcatttggctgggtaagctgagaacgttggtgtgtgggtgcgtaaaagagaatctgtgttcaatgaagtattgtcgatagggttaattgtgtatttggcacacataaacgggacaagacgtgtaaagtacttggtaggagagcgacagtatttctccttttttttttttttttggagactgggtgtcactctgtcgcccaggctggagtgcagtggcgcacggctcactgtaacctctgcctcccaggttcaagcaattcctcatgcctcagcctcccaagaagctgggattacaggcctgcaaccccatgctctgttactttttttttttttttttcatttttagtagagacggggtttcgccatgttggccaggctggtcttgaactcttggcctcgagcaatccgcccgcctcggcctcccaaagtgctaggattataggcgtgagccacagcgcccggcctaattttcgtattttcagtagagacgaggtttgccctgttgcccaggctggtctgaactcctgggctcaagcgacccacccacctcggcttcccaaagtgctagggttacgggcgagcgtgagtcaccgcgcccacccgggagtctgtatttctaatttgtattcagctctcagcatatcctcaacgtgaccccacccaggttcagggtactggaacctgagcgaggaaggcgtgtgccggggagagtaggtagtgtgaggggccagagtgcaaaggtcagaaggcatctggtggaagcggtgtgcaaagaagcctgaggggaggtccttagatctcggttaccttggcgatctctatcagagggttagagttgccgagaggcgccagctgccgcttcctctctcccgccctccgtttggcttagctcgccgggttctcccacaggttaaaagcagacgccgacgcggttgcctagtgacacttttcccaaaatgcctagggtattgttgtgttcttcttagccaatgagagaggcgaagcggcccaccgcctgccaatagactgcgagatcagggcccgcgacggttaaacggggcccaaggcaggggtggcgggtcagtgctgctcgggggcttctccatccaggtccctggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaaggtgagcgtgggacctaccctgcgcctgcccctgcttaggtttcgtcgcctcggggcgagcgccctgcgccaccgaagggaaccgacagggctgaggaaatgggtgcccggaagactaaaccgtctttcctgggtctgcatctgacagcctgtcctgggtggcttaaaggatgggagaccgcttcttttgatatatgtatttccatcttttcccgtttctctccccatttctctctttctcctgctttggcttgctaaggaccttccattggtgacaggtaactaattcctgagctgtttttagagctctaagagtggccctctcaggcacaagaaaggggcaggactaccagaacccgaagctttgtatctgcagtcagactccctcaaaatatccattattaggattattggattcatatttcccaatgtatataggtagaacttttacagaaagtaacattggacaggaaactgcctggctgctgatggagggatctttaccaaggtgtctcatcctgggaaaacacgactggggtggaatggggcagggactttgaccaccttcaccccaattttgactatagtaccttttagccaacttcccactaaccaactgagggtaggggttgggggagtcctcatgtgcctcattcccgtttgtctccccacaacatacatttactgcttagaactggaggaagattatggaagtaaactcacagctccttaagttcattgaactaaattagataatgaccttgattgtaggatataattaaaagggaggtaatttgttaaatcttggaactttcattctttgtttttgagcataatgagttcattcataccttggaaattcttatttcagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggtaagcataatcttttaaaaatgtaagctgaaattggtctagtttcatttattttaagcatcttgttttaggatcagtaatatggaagagtgtatttgtatttgtttggtaggtccacagtactttagaaaattcctggtgaatcaacacccatattttatatcaaaataacaatttataggctgagtgtggtggctcacacctgtaatcccaacactttgggaggccgatgcgggaggatcacttgagcccaggatttcaagaccagcctgggcaacatagtgggaccctgtttctacaaaaattagccaggtatagtgacatgtgcctgtagtccaagctacttgggaggctaaggcaagaggattgcttgagcctgggaggtcgaggctgcagtgagccatgatcgtgccactgcattccagcctgggtgacagagtaagaccctgtctcaaaaaatataaataaataaataaataaattccctatttgtacactggataatttatatcatcccatcttggcaatgatttttttagaagttatatgctgtataactgctttggttttaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcctgtaagtatttcagaatttagctactttttaaaacatcttttatttttgttttcttgtttgtttgtttttgagacagagtctcgctctgttgcccaggctggagtgcagtggtgcgatctgggctcactgcaatctctgcctcccaggttcaaaggattctcctgcatcagcctcctaagtagagtagctgggactacaggtgcatgtcactatgcctggctaatttttgtatgtttagtagagacagggtttcatcatgttgaccaggctggtctcgaactcctgacctcaagcgatctgctcacctcagtctcccaaagtgttgggattacaggcgtgagccaccatgcccagccaaaacatcttttaatgttaagcattctgaagcagggaaattgagttttctgttcgtttagtaatatctagtagccaagaattgaaaatactgttatatttttccacatggaccaccagaccaataaagtctatatcagtttttgtttgctgcatgagttatgtgcattaatgtaagtatgatgaagacagattcctagtctaaggtttgcgccgtttgtcatctctcactgggttcaattttttgagcattcatgcaaattaaagcatattcagttcaagcttttatggaatgactatgatgcattaaactcaaggattacaaaaatgaaatggattttgtccttgccctcaagagttgtttcccaatgtgtaggtcctagttatctgcatcagactcacttggagtgtttgtttaaaatgcagagttctgggtcccaaacccaaacccaaatccatcgagtgaatttcgatctctgggtgggttcttgaactctgtttttttttttttttaatattttactttttattttagactttgcatttaagaggctctgtaaatgattcttgtgtatgcagaatcagagctcaggaagtttgctcacttcagatagcatgtttttacaatgttaactttttgtacattttatttttttgttgcctatccctgaaatatcttgctgagtccactcaccaattacctctattgctggatattttgtttccaacatgtttcaccattcttagaagtactgctctgcatatctttgtatgaattattctttcttcctttttggttatttccttggagtgtagctcataaaatgaaattgctggggtaaatgtttatggctgttattagatattgtctgatggcttttaaaaagtttaagtcaattgtgatagcactaatgtgttagtatataacatctgaacagataaagatgaagaaatatttgttagtattttagtagttcacctttctaggattttccaaatatttataaattatgttaacagatcttactatagtataaaactttgtaaattaatgattttggttttgactaaaaatagccagaacagtaccattttctcactgtatcaaattccaaatagaatgtttttaacataaaggacaattatccagaagtggttcttgggaaatttgaaacctattcttttgttccttttccctcctgcccttgtaattagagtggttcagctttcctaaggcactgattgtcaaaaagtggcatcagactcaccagttggactttaaaacactaaccagccactagagattgcttctattccctctgttgagaataggagctctggtaggctgttgttactgtagatgtggaagaaaggcaaacaataaaataggtaaggataatattagttactactgtgatttatggagtggactaagacaaaatataaatggataattcaattagctatttatgtctatatccatttaaatgtggactagatacatattttgactattcttaaatttcctctagttcttttaaaatggtgtttcttaatttgccttgagagtagaagtctctcatattcacctctgtattgtcagtgcctagtctatactaagcactttcatttgtgaatggaaaatgagtgaatgaattatgtatgatggagtgtattggaacaagatcattgccttttttccattataaatttcaagataaagtataagctaaaaactttgaggttctgtttttatctcaggagtaatttaatgtgttttttaagtttcaaaacaaaataaactcttaacaccttccactttcttaccctttttccctgtataggaacaaatgaatcgcatgtcctacaatgagaaatcagatatctggtcattgggctgcttgctgtatgagttatgtgcattaatgtaagtatgatgaagacagattcctagtctaaggtttgtactgtttgtcacatttcactgggttcagttttttgagcctctgtgctaacgaaagtatattcaagtctgaaagaattgtaccctgggtaaaattaaggtagatagatgaacaggctaaaagaaactattcacaaattaaaactataagccatgaggctgggtcttgactgttcaagggtcttggctggttaggtgctttcttattagattgacacttagctcaagggagagcacataggtcaggcaggtaaggtaaagctactgtaaggatgtggaagaaatgaaacaagactcgggtagaggtctggggatctgtagagcagggaagagctccaattcttttcctttgttcttcttttcattttctttccctttgaaactattctgtagagcagtgattctcaactagggataagggaagcaaatttgcctcttatggggcatttgatgatgtttggataaatttttagttatcacagctggggagtgcttctggcatctagagggtagagggcagggaggctacaaaatacctataatgcacaggacagccccccacaacaaagaattatatgacctcaaatgtcaatagtgccaaggttgggaaacttacttataagaagaaaatcccagaagtagaaacttaaatacaaactggagcttaagctgtgcttttgatttagttcctattgtatattttcatttttacaatttgaaaatgtcttcgtcgtcttcttcttcttttttaaccctaggcctccatttacagcttttagccagaaagaactcgctgggaaaatcagagaaggcaaattcaggcgaattccataccgttactctgatgaattgaatgaaattattacgaggatgttaaacttaaaggtaaagatgataagatgatatattgtctgtttctagctgtcagttaagtgtcagagcatacattctctcttgtagatcaatggagactgaagaaacgttaaatatactttcttagctaaatttactgtgttaacacaagtgaaaacatatgtaaatttggcaaattgcacatccttgctggcccaccttctgcgctttctttatttctcctcccactctgtcatgctaacagatggtcggtagcaaggaaagattgcaaaaagaattcaaattctcgttccccttgtccttgcctacctcacagtggcaggtagtgagggaaggggccagaaataagagtttattactctgcctctagctctaattgagagattaaagaccagaagaaggggaggggtgatggagggcggacggaggacagctaaaaacagagggaaaatcaataaagagattatgtggaaaaactctggctatagaatggggaaggagatgttctggggaccaggctgacataagagaagaaggaaaatgccgtaggatcacagagaaggatacagatgaagtgacaggattgagagtcagtgagagagtatcttgctaaatgtagtttagaaatgcaagggcagtacttcccctaaaacagaccctagcaatgctaccaagccccagcacaagatgtgccaatcttcagggattgaaccttcttagaaaggtgaaaaggggaaaagggaaaaaaggtaagttaacatctgcattaccttgtggacccagaacctcatgagttaaaaccaccagtgaacttatttttccaagtgtttaagacctagccataaaggagtcctttcttttgtcttggaaacacatttttgtccttttattttaactgctgtcttaggaggactattctgttatgcaatctgactataatactgagtattttttccccaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcgtaagtctgaatgggggtcaaagcaaaggagaactaccaagtgggttattttgatgtgtctgaatatctctttgagcagaatattttatacatacagatcttattagaagcttttgaaaaatacttgagaaaccaaaatatgtattttagactttttaataatcaggcttgctggcaccttcatgttggacatctttctctgagatcagttgctagttatatattattgggccttaactgtgatggccctaatacgatagccttgtattttactctagagttacttttttctttttcgtctctactgtgaataccctaatgttttcccactgtaaaggaaggtcttaaaattgctgctttccataataaaaaaccatgacttttgtcttttgaaatggccactccaacagaattccaggtctaaaaccctacagtatgtagatgagatatgttcaggcaattcttttctttttttttaactttttatttttgaaaatgagatggggtctcactatattacccaggctggtcttgaactcctgagctcaagtgatcctcccatcttacctcccaaagtgctgggattataggtgtgacctaccacacctggtctgttcaggcagttcaatagagaatctagatacaagatattttaagtctataaataatactctggtgggtattaacattgacttatgagtattaactgattagatgctaatttagttttgatattgaaagtgtgtctactccaccaagatgagagctactcgcaagcatttagggttatgcaaggtagctacagagtgaggttcttcattttaacatcaggagacgagagatggggtcgtatttgtgacctgtcaccctcatgactcacctgattttacttctgcagctttatgcccaatccaggctttaaataatgaaatattgtatagtcctgtgagatatgcttactgtataggtacaacctatacttacttggaaacctctgtaaaaaataagaaagctttttcttataactttccccagtgtttcataatttcttttcttttttttttttgagatggaatttcactcttgttgcccaggctgaagtgcagtggcaccatcttggttcattgcaacctctacctcccgggttcaagcaattctcctgcctcagcctcctgagtagctgggattacaggcgcctgccaccatgcctggctaatttttgattttttagtagagatggggttttgccatgttgacctggctggtcttgaactcctgacatcaggtgatccacctgcctcggcctcccaaagtgttgggattacaggcgtgagccactgtgaccagccataatttcatatagcaactgaaatctgaatactttctgaatttggggccatgaataaatagtaacatttgttattaatactaatcctatgaactaccacctaactgaattgtgttttttttcttttgtttgggtgtggtcattcaaccagaagaaggagatttttgtactgtgaggccagatcatgccctgaaaattagctgttgcttatcttcagtgaagagcagagatagctttagttttttgttttcccaaatgagttactcccacaaaagatgaccaaaggttgaagctaactttgtatttgtttaaacaagtcctttcaagaaaatctaagataacatacagcctactaaaacactcaattaaaaactaacataatcaggttgactgaggcatagtgagaatcctttccccaaacattgcttatcagtatcaggcatgctagtagtgataagattgccaaatgtaaattgttttttagtcaaggtcagttgttaatttttttttctttgtccattctctttttaaagagaaagaacaggagctttgtgttcgtgagagactagcagaggacaaactggctagagcagaaaatctgttgaagaactacagcttgctaaaggaacggaagttcctgtctctggcaagtaatccaggtatgagaatcaacttggtcaacagaagctggtgctacaaatgaagaaatgtgcaccagtgttgctcccaaagtggcttaggtagcccttttcatttacaaatctcaaattttaagatggatttcattgaatatatgcatttcaatggaaacaaaattctgttatagcagtgatttatttcctgggttcatagacctgaggcaatgagtcatagaatttcatgtttgattttctttaccttatcaaactacatgtttagtaattgatacttatttttattatcattatttatttttttattttttttgagatggagtctcactctgtagcccaggctggagtgcagtggcacaatctcggctcactgcaagctctgcctcccgggttcacgccattcttctgcctcagcctcccaagtagctgggactacagacacccgccaccaagcccggctaatttttgtatttttagtagagacggggtttcaccgtgttagccaggatggtctcgatttcctgacctcgtgatccgcctgcctcggcctcccaatgtgctgggattacaggcatgagacaccgtgcccagccgatacttatttttaaaaattagggcatttacaaaactattgtatgtttcagatttcagagagataaactgcatttcaagtaaaaataaacattttaatattgccatgcctcatttttcatagaaagcatggcttaaaaggcatgataagccacctgcagaataggctgtcacgtttggatctttgctaacaccctttcaagttgaaagacatatttgttgaaatttgattgtttaatatctacatatgttctctgcatttccttctttatttaaagtctggtatatagatattcagctttctcagggccctgcctttgtgtggcattgtcccttcactctgccgcactgagatgtggttatcgtatataccagtgaaccattgtctaacattctccattttatagaaaccctcaatctaatttaatcgactctttaagattatgtaaaatgcaaactgtgaaacatctttttgcttgatttatgacacaaactaactgttaaaagttgttggtttcaaaaatcgagcatctgaattttcaataaaattcagagtttttataactcccttattccatgtaggacagcatatatgaaagctattattcccatctttaataaattgagatgtagtgtgatcaatttagtgagcattggcagcattttgtaaatggaacagacaaaaaaccctacttaagttagattgatgatcacaataactttgtagtgaataagtgatggaaagaaatgaaactactgatagaagtaaatgaaacaaggattatatgaaactttggcttcatctctgttaaaataccttcttttttcccaatattgcagtctaccatttcaatattataaaaatatttattctggcttttcatagattccacactgtcatccataaagacaaaatagacttaaatcatgattagggtgataaaatgaggagaaaattttacctggatgaatttcatgcatcaaacccattgcagagaattacttaagaccctgttggggatggctgttcggttaaagagtttatttacatttgccctgatagtctttgagcaaaagatgaaaatagctaagtaaggatgatgtgttttactttataggatacacagataagtatgggaatctacttatatgtgaatcatggcaaatatttaaaatgagccataggaatcaagtatccactggggcaagcagacattttagggtattgagtgctgaaagtagtgaacacatcagagctataagataagcatcatagcagtggggagcgggtaccattctgaactcaggacagttggaaatattctctccccatccttgggctataaaatccacacgtgaggaagccatcacaagtatattgaaatcatcacagcaagcagcagtgtcttttttaaaagctgttcttttcgtatttgatgaaatattcattcttctatttaatggaagaattttaaaaatgtttttaaaacactttctttcttataaaactgtcccattaagagccaagtgtggtgacgcacctatagtcccagctactctggggctcaggcaggaagatcacttaagccgaggcgtccaaggctgtagtgcactacagctgcacctgtgactagccactgcactccagcctggaaaacatggcaagaccccatctcagacaaaaacaaaaacaaaataaaactatcccattagtaagacaatgttgacttacaaatgtaaaggtatttgtggtaataagaaggtggatagagttgaaacagtggagataaggtctaaaagcaatccagtttgctttgaagcagaagcgacgtatgaagcgggaagtcacaggacccttggaaggcagtgcatctgtgtgccagcctttcctatttcttctgcctggagcactcttcatccagacagccctgtggcttcttacttcagaaatgctgtatgaggctttgtatcattacacccagcacccagcacccagcatgtccctgtttccagagctatttttcctaatagcacgtattaccatcaaatattccccaccagtacttgtttgtttgtgtttggtttatctcctcctactagaatagggcctttgtttggttcacagtggcccatcctatgagctcagtaaatattcgaacatatttcctttaacacaaaaaataaaaggattctagaatctgtaagcctccagcccccagtaattctgtcagcagttaatagtgttgccactttaagtaaatatgattattatttattttttccatgtaaagaatagtttacagtttttactactcttacttgatttaccttttccacactgaatttgtttagattttttggaaacagatttctcgtccattaagatgctttgaactaagtgttcttgaacatttaaccaaaactgtaggtgttctctatttaaaaaaaaaaaaaaaacaaagacagaaaaaaacctctgcttctacacttttctgtaggtaaggtgttctgcatagaatggcacttattttcaaggacagagataaataacattgatttccaaaagttttatgttgtccataatactcagtgtgtttaagagtaaaattgattgttggttgttaagagaataaaacttatgttccttgaattttggcacattccaatattattttttcaatgctgtggattaaaaggctgatttctgcaagtcctacacccctaacctcctatcccagagaaaataaaacaggcacctagatttcaaatgtgagccataagagcaaatactttttgataagtataagtatgaaggagttgaactctgttcaagtaactcagagccctttttctttttccttctaaagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatgttaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttcagtttccctgtagttatgtgtcttgcatttgttggtctcttagttgatgggagttgtgtttatgatttgtaggtcttcattgtagggtacagaaggaaacatggatctgatgctcaagggagtggcattccagtcctaaactgtatggcgctttacctcccatctcattaatccatgtatgtaagccagtggtccttaacagggtgattttgctcctcaagagacgtttggcaatgtctgggggcatttttgattgtcatgatttggggtagggtgctactggctgctagtgggtacaggccagggacactgtaaacattttacaatgcacaggacagctgctgacaacaaaatgtccatgggtttggatcataatcctgaatgatacaatctcaaatgcgaaaatcctgaaagaccaaaatccctaatgtcttaaatcccaaaagatcagaatccctaatgtgtgaacttccaaaatcacaatcctgaaagattaaaatcccagatgttaaaatcctgaaagccgaatttgaggttagggattagtgccgtttcagctgtatacaggataattgcatcatgttaggcagaactattaccttgttattgtcttcatttggaaattaagtatggtttaagagatgtggatggatatcgagttgataaggggtgaacttgttgatttatgtgtcaacttgactggattaaggaatccctagaaatctggtaaagcattattttagatgtgtctgtgagggtgtttccagaggaggttaatatgtgagtctcagtagactaggtggggaatatctttcctcaatgtttagtgttttgaagatcataaaagcgacttttcaggtgaaaagtacaagaaatctctcctgccaaattattcagttatgtacaaattctgctccttcatgaatagtgccacgcttgccttaaaaaaatgccctttgtcagagaataaaattcgacaagctgaacgaccttgtgaaccaaagacacttgctgatactgaggttcctccagtgttacaaaactcattaaccaaactgttcttggttagggatttgactgtcgaagaagatagactgcttatatttaccactaaatctaacagaaaaactatcgcatgttttcattttggctagtggacggcactttcaaaactatccctactggtttttatcaactatacatgattcatgcccctgttggttctgaagattctagaacttatctagtcatttaaacaattatttgaagatttgctgcactttgcagaagaaaatagctttcgattgaatccccaaaccataacaacagatttggaattaggtgtgatcaaagcttctaaaagtgaatttcaaagtgttaccaataaagtttgttttttttccattcagcccaatgcatttgatagaaaattagatgagtagataggccaggagatacagcaatgacaaaaacttcagtttagaagcaggaacccgcatccaggaatagagccctttgctcctccctcagaatgaatggagatcaaaaatcagatgcttatgcccaagaaaaacaggatttcattcagcacttctcccggattgttagggtgctgactgaggatgagatggggcacccagagacaggagatgctatcgcccagctcaaggaggtcctggagtacaatgccatcggaggcaagttatcaccggggtttgacggtgcttagcattccgggagctggtggagccaaggaaacaggatgctgatagtttccagcgggccctgatggtgggttggtgtgtggaactgctgcaagctttcttcctcgtggtagatgacatcacggattcatccctcacccactggggacagatctgctggtatcagaagctgggcgtgggtttggatgctgtcaatgatgctatgcttctggaagcatgtatctactgcctgctgaagctctgttgttgggagcagccctattacctgaacctgattgagctcttcctgcagagttcctatcagactgagattgggcagaccctggaccccatcacagcacccccagggcaatgtggatcttcgcagattcaaggaaaagaattacaaattgtcaagtacaagacagttttctactctttctaccttcctatagctgcagccatgcatatggcaggcattgatggtgagaaggcacacaccaatgccaagaagatcctgctggagatgggagagttctttaagattcaggatgatcactttgacctctttggggactccactgtgactgacaaagttggcactgccatctaggacaacaaatgcagctggctggtggttcagtgtctgcaatgggccactccaaaacagtaccagatcctgaaggagaattaggggcagaaggaggccaagaaggtggtccaggagaaggcactatatgaggagctagatctgctggccgtgttcttgcagtatgaggatgacagttacagccacagccacattatgggtctcattgaacagtatgcaatgcccctgctcccagccatctttctggggctggcgtgcaaaatctacaagcggaaaaagtgacctagagactgcaagggcagggagaggaggctctcaataaattactgtgtaaccttgaaaacaaaacaaaaaacttcagtttaaaaatgcactttccagctgggcgtggtggccaaggagggaggatctcttgaacttagaaatttcataacagcctgggcaatgtagtgagacactgtctctagaaataatttttttaaaagttagccaggtgtggcgtgtgcctgtggtcccagctacttgggaggctgaggcaggaggattgtctgagcccgggaggtggaggctgcagtgagctgtgatgaagccactgtactccagcctgggagacagagagagaccctgtctcttaaagggcaggtgggtggggggtgggggaagagtgtttccttgtgtacagtatgtattaagagatggggaaaaaatgtatcattcgcctgccttggaattccttccagctgatgacattctagaaacttttaatgaattaaagccacatttgcctgaagacgtcagcaaagttactgactgttttgaaaataaatatgtacatggtaggataagaaaatacacaatggtgttgctgtttgatcaccagtactgtttctgtcaaatctgtggcctaatgagtgcatgcagaacagatttctgagtacccaaaacaacacagaagcatgacacagaaaatagggaaatttagtagggaatgctcctgtcagtgtatatggaatcatagaagaatgccaggaagaacagcaccatgtagaaaatgaatgtgaacatattctccaagtagagccatgccctaaaagagaaaaagcagctattcctcatgatgcaagactttaaaatatagttaatgattgtggaggttggccagctcttatggactatctccatgcaattgcccataatccagtcctgtaatacacttttttgtatgtcaaattatcttttttttttctgttttatgtttttttttcactatttaaaattgttggcattcttttttacaatttgctatgctatataattcatcttcaaatcatttctgatactggaggcataatttgtgtagagacttagaaagttctgtttttttgcaaatttgactccatgaaagtacattgtcacagcattgactgtgtgtaagcattgttcctgtacataaaaacattgaagcatcctcagtaagtgaagaggtgtcctttttgtacatctgcatttgtgaaaggtaaaatgtttgaacatcttggctctttaggtggctgcatatgcagtagtgacccatcctgtttttgatagatctcatcaaaagaatcttaggttgttatggtatttcagatgaccaaaggcataaaactgggtgcacacatttaccaaccatggggatatgcatttacatttcccttcttgacctatttctttttttttctttcctttttttttttttttttttttttttttttgagatagagtctcactttgttgcccaggctggaatgcagtggtgtgatcacagctcaatgtagccttggcctcgtaggctcaagtaatcctcccacttcagcctcctgtgatggagtctcactgttttgcccaggatggtcttgaactcatgggctcaagcaatcctcccaccttggctgggattacaggtatgagccattgcgcccagcccctttatgacctatttctttatgaatatggcttgtctgttcattactgatataattatgcaactttcattagtatatatgaatgtttatgcttgcacaaaaatgtatgttattattgcctattttattgcataaagtgacctatgaagtgttctgtgttttcatatgtttctcaaataaattccctttaaaaatgtaaatacatgtaaatgtaaaaaaaaaagtaaataaatatcttttaaagaatttttaaattatattttccggaattacatttttggaattctgctctttcaggattatgattttcaggttttagactttatggattttgaccttttgggacttcagcattatgacattcgggattatggcattaaaaattgtatctcctgggactatgatcggctcccaatgtcaatagtgccacttttgagaaacctgatctaagctcaaacttgttgggacatatctcagccttgaaggaaagttattttggattttgatggatatttaaatatgtatatatctgacttttagtataaattagcagtctatgctgtgccttttcctttgtgagattttcctggcaatgctagtccttttagcttaatgaaataagaccaagttttaaagggttaataataaatgagaggaaatagctcctttatatatgtaggattattacacagctggcagcatagttccatcaagtacaaatgatactatccaaacacaatcagaaactgattaccagatctttaatcctaacagaatcaccttgacatgaatgttgagtataactcctggccagctataaaatttgcaagacctagtgcaaaatggtaatgcgggactcttgttcgaaaagcaggaaacaagtaccctgaaaggtacctacaatgcttttccctttcttccaaggtttctctctctctctttctctgcttattgtgatgttatttgctatttaatattctaagtaaagaaaaattaaaaatttaaatgattagcatgaattttaccatttatgtcgtgcaatgcagattttaaatgcaaatagcagagcattcagctgagatagggaatgaatttcacaattcatattttgtgactcttctctgagggtgcctcaagttgaccagaggagacagacacaccagaccctcaggcatctgggaacccctgactctgacacctgctcagttcccctttcctccagtcaccagacctatgcaatgccaggccaggaggagcagagcctggcatcttccttttgcacaggccaacggccccagcccatggcagtttggccacctccaaggatctttaaacctccaagctgggactttatacttggaccagggtacctcgatggcccttgtcaagacatggccaccagacatgccatggggctgccatgggggagaggggaaatggcttcagaacagctgctgccatgacctgcctggggatgcattggagcctagatactcaatgctgacccttcccttgcctgtgcccaggccccttctggtcatgggaaggggaggttgggtggggcccagtgcactagagggtagggaggggtctgagaatcatcctgggagtctatggggctgatgggaggtgggatcatgcatgaggggaggccctgagccaccacgcaggctcccattgtcccactggactccacttacaaaaggcaaattcaaagacacaagtagtagccaggcgtggtggctcgtgcttgtaatcccagcattttgggaggccgaggtggggtggatcacctgaggtcaggagtttgagaccagcctggccaacatggtgaaaccctgtctctactaaaaatataaaacaaattagctgggcttggtggtggacgcctgtaatctcagctactcaggaggctgaggaaggagaatctcttgaacctggaaggtggaggttgcagtgagccaagatcacaccactgcaccccagcctggttgacagagtgagactccgtctcaaaaataaataaataaataaataaatataaagatacaagtattaagaatttcaagacttcagcctcagagcactagactccaggtgccaggcccttcctaataccaggtttttctacatgtggggtcctgtatggctgtgcaggttactcggctgtgaaaccaccactttctctaggaaactcctttctaccttagaaaataatacgttttcttctcactttgaaacctgaggcatgctggacaacttctctaattttccccatcccagatttcacctttattttcattcatggcttaattcaaccaacaagcagttattgagcacccactatgagccaggcactgtttaaggtgctgaagatacagccatgaagaaacattgaaatccctgccctcactgcccccttcaaatggggcgtgacagtcagcaactaatcagccacagggcatgtcagcaataagcgttaaggagcagagcaaagtgggaaagaggagcaggagtgggggcttgcaatttcagaagaggtggtgatgaggggtgcagcaggaagaggaggagactaaccatagcaggttacagtggaggtgggggtggaggggaaaagcaaagggaatgggagacctgagcgggtccggagagaggaaagacagcagaccagtggtgggctagggggctggggaggggagcgggggtttgagtgaaactgggagaagcaatatggcaggacttggaaactgaggagacattttaaatctgatcatgaatcccctctccttgctcttaagctaacaaaaccttgtttccagttagtcgctgaagctgggaacgtctggggtatttgagcagtcatggtagcttagaagggggtccctttgatgggggcgtggagagcgggttccttccaaacgatgtttctccagcatcgcactgtaagatctttccaagatgttctgttagacactagcactgtacttaccattacacagtttacatgtttaaataataatgagttcaacccagcacaggcctactcacaggcgcttgaaaaagggtcactggatttgaatctgattaaccgactgtcctggccgacagaaccgcaaggtggcgccatggctctgctagagccgcagtcccaccctccccgactagcctgagcaactgggagttactgcgagagtctatgccgggcattggataaatgccttctccccattatttccttcaatccctacaatacccctgtgaagtaggtatcattcgaatcacattttacacggggaaactgagactcagagatcacagctccggagctcaggcttttggcaataaccctccactgcctgcctccgcaagacagcaaaaggttggctttgttccccaagtcatccagtttcccacagtgatgggttaagcgtcataacccatggctttatccaagccatttgaattgaagaggaaggtggacgcagagccagcatggttagggccagtggcctttccagacttgcgtgccaggagagatgggttagcgtgggggaggccggagaaggggttttcaagtgaccccggtaggacccccacgtctctctcccgcctttgctcagcatcatctatagcatggctttgcatttcctcaaaagcccaggccagatgcccagtaccttcaggcggtccagtgtcccccaccccctagagccatctcattcaggactgccctcccctgaaacgttttatgtttccagaagacccttctccttccagggcaaagccctttcagttaggcaagctagttccctcagtgacttaagataaggctgtcctcctaggctggacttgggctgaatgcaaaaggcgacacaaggcagctgtttaaaaaagaatgaagcaaatttatatgcaccaacaagaagagattattgctcattgtgacttggtggctgggaaaataaggatccctattagattgatggatttcacaccaaggaggaggatagaaccagccctcccagagggctgtgcttgctgcaggctagctgatgagacacgtggcttactttacccctcgctcagccccagcctcagcctccctccctctacacagggaagacagaggtcagctgctgagggcctcctcccatgcgaaaggttgcattccacccggcattcagaggggcaccctcgctaacctccatggaggcaccttgcttacatttctgacaccacagccacagcgacagctctggggccctacagctcccctcaagctgctgaaatcccagacaaccaaagctgctcatcccttgatgccctacgaccacccagccaggaaacaaatcccccctcctcccactgcctggactctgagacaatctctggccatcttgatgcaacagagtgttccataatcatagtcacacgttcacaggaagtgttcacagatgattcactctattaaaaaacaaaacaaaacaaaacagttaaatcatgaagtgacaacatcgttgtaaaaagttctaacaatatggaaagtatatatagtgaaaattaaaaggtaaacattcctcacccattagcctagtttctatctctgctttcggaagtagctattaacactttggtgtttggtggtcctttctagactctgtgtgtgtgtgtgtgtgtgtgtgtgtgtgtgttgcgggatggggatagagtgtctctgtgtatgggggtctgtgtgtgtgtctgagtggatccatctgagtatgtgtatttaaaacacacgtaggctgggtgtaatggctcacacctgtaatcccagcactatgggaggctgaggtgggcagatcacttgagctcagaagttcgagaccagcttaggcaactggtgaaacccaaaaatgcaaaaaattagctgggcgtggtggtgtgtgcctgtggtgccagctactcaggaggctgaagtggaaggattgcctgagcctgggaggtggagcctgcagtgagctatgattgcgccactgcattccagcctggcgacagagtgagacctcatctcaaaaacaacaacaacaacaacaaaaacacactgggaaaaataggatctgaatacatgcactattctttaattgtttttccaattaaaaagaatcctttcttgttggtttagataaataaacctttctttttcagacagctgccctgtgtcatcatttaccttcatcccaagttcattctagaaggcagcttaccttgagtcttcagggaactagcctgcctagatcagccagaaaggtggagagtcagcttccacctcaagaactcagggcctggcagccgagatgggcacacatctttgaagcccttacttattcccacaaagcagttaatcagctccagtcacagaatcaccggtcccagtgctatccttaagaatctcgtgcttaaggccaggctcggtggctcatgcctgtaatcccagcactttgggaggccgaggcgggtggatcacttgaggccaggagttcaagaccagcctggccaacatggtgaaatgccgtgtctactaaaaatacataaattagccaggcgtggtggtgcatgcctgtaatcccagctactcgggaggctgaggcaggagagtcacttgaacctgggagatggaggttgcagtgagccaagattgtgccactgcactccagcttgaccaacagactgaaactctgtctcaaa

SEQ ID NO: 1467 - DNA, 2119 bp, Homo sapiens
ggcacgagtaggggtggcgggtcagtgctgctcgggggcttctccatccaggtccctggagttcctggtccctggagctccgcacttggcgcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatcttaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggccccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatattaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttcagtta

SEQ ID NO: 1468 - DNA, 1338 bp, Homo sapiens
atgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatcttaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctag

SEQ ID NO: 1469 - DNA, 92880 bp, Mus musculus
  misc_feature (6406)..(7434): "n" at positions 6406 thru 7434  can be any base
  misc_feature (7738)..(9069): "n" at positions 7738 thru 9069  can be any base
  misc_feature (29342)..(29415): "n" at positions 29342 thru 29415  can be any base
  misc_feature (49297)..(49316): "n" at positions 49297 thru 29316  can be any base
  misc_feature (63491)..(63510): "n" at positions 63491 thru 63510  can be any base
  misc_feature (77047)..(77066): "n" at positions 77047 thru 77066  can be any base
tggtacttttgttgcaacttactgatgatgcaaaacgtatgtatgcctctcctgttttctgaataattctcaaagttagtagtcttcttttcaaccctacttcctgtgagatgcatgggtagatattacctcctgctacaaactgaaagattaaaggaccaaccgaagtccattcaagtgtataaactgtgttgggtttcaaatgcagaccttaggttgaaaattaagcaataggatagaaaaaaatctaatattgatgctattttatgaagtgtagcaaaatatcctttgcaccactttagaatgtgatgtgaagaacttacagattcggctgcccctttagaagcctgcatctgcctgtccatgtgttaaagtgccccctcacatgtgtctctttttaacactcatgcttaaatatagtttaagacactttagtaaagctcagctttgcttttacaagaaacaaaatgtgtataaatatgacctccaatttagcttcaaataaaatgaatacatacattaactaagtaaaggaggtgtaagatctaaaacggaagcagtgcctctcaaaactgagctgagcaacgccaccaacaaacggggcagactgagacaccatctaccagaggagcatgggagagaagagattaaatcagaaaaggaagaaagctaatgacataatggccagccacaaatgccacaaatgacaaacagtgtacgtaataatcgctgcaattattctgtgtgcttgctccagtgtctccaaacactgaaaacattagatctctgcttatggctacatgtatctaatatgtcagctggtgttttacctcctctttaatcccttattgcttcaagcaagttcttctaatagagaggatttaaccaggacaaacaccaatggttaatagacagaaagagaagctggtattttaagttgtttatgacgaaagaaaagaaaagggcaaaacaataaaaaaaaaaaaatacagggaagggaagatgtagcatcctcatgccacattttcaaatttccatgttaactctagaaaaagaaacatataccatagcagagctgattctaacagcttgaaatatttgtgtgaattttttataacaaacatgtcttctgtaaatagaaatattaaagcacacagaaatgggacattctagtttatctgggcttcctttgaaccccttatgtgtttctcaaagtcacaatgttcaagaggcatttactagctatgatggcttcaggtagttcggacagtgaacaagaaaagttgtgtcggattaccatatagctaatattttcaaaactattcattaacaagaaagcatatttatatttaacatcatagagttaatggaatgggtacaaaacaaaaaaaaatgcaagctgagccatgaaaaatgatcatagctggaggaaaataaattttaaagaagtgtctctttgtaagagaactcacatgataaccagtagcacaggtgggcctggaattgctatgtagagtctttccgtgaataagatcttttccaacaaaagtcacatcaattcatcccaataagtccaagttctgtagtcttggtgaaagactaagcactggtggccagcagtggtgaacacagagccaaggttcctccagacatttctctggctaccagctgagctctccaggctcttgtgttttccctcatgtgtgttttcatattaaggatgagacatgagtatgaaaagaagccattcttctatacaacctaaatggaaagatgctacaagtgatttcagtcaagcagtgtgcatggaagatgcttcaaaagatgagaaagaatcacaaacaagaagaaatctagtttgttctgtaagtgcttttgatatctttttctacttttttgaagaaccagagaaatttgacattaaaatgactaataattattaggggaatttgaaattaaatgactaatagttcttaatgataattgagtatataatatgcctcatgaattaatatacttcatatatagcaaacttgattaatctttgtaatttaagttgctattattttattctcactttacaagtggtcataactaacgtatagtgagttacagagcttgttcaacattaccctatatagatactggcattagtcccaatacactgtgagaatataccacccaggaaaaatgaaatagcactcataaaaatgttagacctttattctaaggtgaggcaactaaacgttcactgatggattttaggttttagaaaacaaagttttcaagttatccatcttgatggttctcttgctttcagtattaaataaataaccttattaagtttaacaaaagactaatcaccacttctagaaggctttgccttctataaagggcagacagaagatgatggacttagcagcaaaattggacttgtttcactgcaatagagagcccctgtatatgctgggtcaggatcctcatatgatttgattgatggttttgagggggatcacctgacccttttgttattgggttatttcaatgagaatgaagataattaaacagatgagcagaaatgaaaatatcaaaacattaagcgatatataaatgctttccttattcttcactcttgtctttcttcctttattgctgctgcttctgcttcttccttctccttcttctcttcttcttgttctcctctcctctgtctctgtctctgtcatctctctctgtctctctctgtgtctctctctgtctctctctctctctctctctctctctctctctctctctctctctctctgtgtgtgtgtgtgtgtgtgtgtgtgtgtgtgaggggtggggggtgcatgtatctgtgggatcacatggagaccaaaggaggattttgggtgtcctgctctatcactatcttattcccttaacagggtctctcattgtatcttgagcttaggtagagaccagcaagccccagtgagttttcctgtctctgtgtaagggggtggggtggggtggggaaaatttacaagcacctgatgccataacagaatttttatgtgggttctgtttgagcagaaagcattttactttctgagcaatctttgcagtccaaatgctacagaaatgtaaattgtgatttggttgcagctcaggcttattaatattttgtttgtcttaggacataatagtcaatacatattcatcaattcactcaattaacacccactgagcatcaattatacactgcataagaagtgttgaataggaagtctctgtctttcagtcttatattctagtagggagaaagaatataacaaaagttcacacaacaaatggactaccattctaacatgttaccaaattgtgcaggatattgtaaaattataatgtgttctagttgtttacgggtaaagtttggaaattaaaatccacacggataagcataaaaaatcttgagtagcattcataaactttgtgttaagtcatttagccaattcaacctcaagtaatattatgcccagatgattaattgactcagcattattatcataactctgtaaaatattaccttaaggctggtatatatgggcttctgttccagggacttaacataatgaaaaggatagatcaggtttttgctagatagagtctgaatatatcagttttattcctatctcctcttatgagataataaaatacattctctctgaggtagggatttatactgtctcttaccttgtaataatactaacttcctagagttattgatgagtaagtaccatgttaatgagttaagagtaatgtataaaaatattgaatagtgtctggtggacagatgcttaatagttattaactataataagaatcgtgttatcaaaatcttaaacttcatctgtgtacaatggacatttctctgttttaaaaaaaaactatttaatttctttgaaattcagtgcttaaattccatgagtgcttaagtctttcaagaattcataatgccccttcatgtaaattatgggatccatgaggaaaatctctcttaacattactggattccatccttaaccctgaggagctatgtgacattggatcaagttctgtaagttccagttcctcatgctgaaaaatcaagtcggactaacatgtcggacagttttatgtcaacttgatacaagttaaggtaagttaagtgaaagaaacctcagttaagaaaaatgcctccaagcccattgtggatggtgctttccctgagctgatgatcctggggtctataagaaagaaggcagagcaaaccagtaagcaatattccttcatggcttcaggattagctcctgcctccaaattcctgctgtttgaagtcgtgtccttactacttttaataatgaactgtttatatggaactgtgaatgaaataaaccctttcctccccatgttgctcttggttatggtgtttcatcacctcaatagtaaccttgactaagacaactagcgacatagttcattggcctagtgagtactttcctagaatataggatccccagtacttcccaagaagtataataaaatatctattttattcaacacttccagcaaactgagcagaagagtcaatgaatgttaagcaaattattttcataattatttttcttactgtgtagatatgattagttgttgagagtttaggctaatttttaaagcagtatggattaaagcatgagatgtttttctgttgaactaatagactaaggcatagttaggccactaaagagaaaaaactggaaaaattcctatttctgttcaatttaaaatatttggaactgaaatttaaaacttaaaatgaagtattcttctacattaagaattactaggcatgcaaaaaaaaggaaaaggaaaaatattaagtaggaattcttgtaaaatcataaattattcaaaaataaaagaacacctaccatttacaactcaaacatgcaagaaaaaaatgaagtagattcttttgatgagtaattcagttacttaggtctgtggtgtgaaagtatacataaaatgatatatgtgcacaattcttagttccttttaaaaagtgatcatcttcaagggtaagtatgagttttatttagaattgagtatcccccaacacgcacaaatacaaaagaatctctttgaagtctggggaccaaattcagaagatatctcatcccagtagttgagaaattagccagcaaggaaagccaagtcataggtctaagttctcaatgttcactatgaacctggttgacttggttctctcttcttaaaaggtttattgtttgtttgtttgtttgtttgtttcctttctttcttttttgttttcaacactaagtggttcaagggctcttcataactcctctcctggagaaggaggtccgcactgggatgggttttccttcttgaggtgtcaagcttcggctcctttgccaagatggcggccctggctcccatggaggtagcgattgtgcagcacctctggcccaggggccgtcttacagccacggcctacccgcgcaaagcggaagacacattgggcagcctttacattttccatccaagaaagggcgcctcggttttgaagctaaagagcacctctgccaaaatggtgaccgtgtggcgtcactgctctttaccaagatggcggcgagagacttccggcacgcgcttccccaatcagagatctccaagaggtcaggcagaggagaccgccctcggagtccaagtgctgcgcgatcggctgggggagagaatggggtggagccacggcagcctcagctccgatcagaagtgccaagcgctggcacctgtgggggagcaaaagttacttcctcgcaccccaaagcaacaccataacaccttactccccaacccccaggcccctaaaccgtagcgtgcggcgcgaggtagggggcacggtcccagagtcgccccagtctgcccaaaggggcgggcagcttaggggcaggtcccgcgcggcggctgcactgtcacccccacgcccctctcctgtcctagggggaccggccacgtgtttctcttggagacccggggctcgccctgggaacagctggagggagctaaacgctgacgttgtaaagatgcgtgttttgttttatttggaggggcagaggggtccctggaactcagaaagaaggcagagcgaggcactgagcctggagcagcaaatgtcaagatttgggggaggggcctccgcggggagcttggatgctggccccgaagggggtggaaggagaggtcaggagtttggggtaagaggagggcggacttcgccagcaacttactattccgtctgcaacttgcttctaggcctgcacacaccccctcccgccccgcaaggcttccttaatcacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctcgctcggtcccgctcgcctgccgcggcagggcggccctttagagtgtccgcgctccccccccttcccctccgcctcctccattttgcgagctcggagtcagtgcctggagcccgagtcgccgcccgcccgtcggggacggattctaagtgggtggaacaagacgccgcagccgggcggcgcggcgccgggacgggagaacgcgcgcggggagacgggagcggcgcgggggcccggcttgtcagccgggaacgggtgactttccgcgataggggctctcccctcccccaggaaaagaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgattctacagtccagtttttctgtttttcctggtatttacatatttggaaagagaaatcttcaacttatagataaaatattttgtattgagcatattaaacaaatttttaaaaaaggaatataactcagtaaatcttcgtgttaggaattttgataagctctgttctattaaactatttaaatacgttaaaattgtagggaagaagccagtacacactctactctgcttttaaggatgcacattttagtctgtatataatatatattatttcttatatcccaagtttgaaggtaggtgatactagacaggcatatttagttgaaaatggagtttcagagtaagagcttttccctagccctgcaagacaagcagcccagcactgctttttttttttttccaataaaatgtgcataattcttcaaggttgtaccttgaaaggtttagatgtgtggggattggcacaggtgaaattgtgaatcatgaggtgtgtaaacaattatagtatagcatttatcaaacggtttatgtagtggtttccagagaggaatctctcaattgaaaggggttggaaatttaaggatcacgcctttaaaaaaaaaaaaaaaaagttaaatactttgacgtaaatttgaacctttgcaataatcacaaataacaaattacaacctccatgcttaccaaatgtgtacatttagcgagtggcaggataaacagccaagtttaaatcggtcgaccgggcagatgagctgctttgtggatgggagcagggaggatatagctttattttagaagataggaactattcttctgataatgaagactttggtttgggagttacctaaagggtttatttaataggctgtctcttactaatcggatcagagataatgtggttttatagcttattatgtccttttttttttttttgtagttaatatttgccaatggactccaaagaatccttagctccccctggtagagacgaagtccccagcagtttgcttggccgggggaggggaagcgtgatggacttgtataaaaccctgaggggtggagctacagtcaaggtttctgcgtcttcaccctcagtggctgctgcttctcaggcagattccaagcagcagaggattctccttgatttttcaaaaggctcagcaagcaatgcacagcagcagcagcagcagcagcagccgcagccagatttatccaaagccgtttcactgtccatgggactgtatatgggagagaccgaaacaaaagtgatggggaatgacttgggctacccacagcagggccagcttggcctctcctctggggaaacagactttcggcttctggaagaaagcattgcaaacctcaataggtcgaccagccgtccagagaatcccaagagttcaacacctgcagctgggtgtgctaccccgacagagaaggagtttccccagactcactctgatccatcttcagaacagcaaaatagaaaaagccagcctggcaccaacggtggcagtgtgaaattgtataccacagaccaaagcacctttgacatcttgcaggatttggagttttctgccgggtccccaggtaaagagacaaacgagagtccttggaggtcagacctgttgatagatgaaaacttgctttctcctttggcgggagaagatgatccattccttctggaaggggacgtgaatgaggattgcaagcctcttattttaccggacactaaacctaaaattcaggatactggagatacaatcttatcaagccccagcagtgtggcactgccccaagtgaaaacagagaaagatgatttcattgagctttgcacccctggggtaattaagcaagagaaactgggcccggtttattgccaggcaagcttttctgggacaaatataattgggaataaaatgtctgccatttctgttcatggcgtgagtacctctggaggacagatgtaccactatgacatgaatacagcatccctttctcagcagcaggatcagaagcctgtttttaatgtcattccaccaattcctgttggttctgaaaactggaataggtgccaagggtctggagaggacaacctgacttccttgggggctatgaacttcgcaggccgctcagtgttttctaatggatattcaaggtaagtcagcgctttgctgtttcttaagaatgatacatttaagatagtttgataaacttcattcttttatcagtgcgtacttttttctatactatttgtatacttttgcaaataactcagtacaaatggtcttttgaatgtataggcatgttagaaactggaaaggactcgtcactgcaaaagccctttgggtgtttggttaaatagtaatcgtttctcgttggtcagtgttaaagatttcatttgacaactaaatcagaattgctcactcacaagtatctgttaaagtaacatttatcatctacaagtatccaaagtcaaactagtatgaaatcaagaaaataagatgtctagtcatagaatacatttattgcacatattaatttagctgttttagaatatattattgcaagaaaatgcttgaagtgttacctttcaatgagagggttaagaactggaagtagtaacactgagtattcaatctgaacggtctgtgttttgaaactgttagagcatttcagtgtgtagggacctagaccatagtgtcagagtagtctacagcagacagttggtgactgctcctttgcctctgtaaaggagctggtgctccatgcgttcgaaagctcctgcagatgctctagtaggtaattcatgattagaattttcaggattcagttagcaagtaccatatatgtctctcttcatttttctcagtcagttatgaaggatactgatatttctgcctgacctcacaaaggtccgttagaatcgagttactgggaaaacaaaaaacaaaacaaacaaacaaacaaacaaacaaaaatgtgtaagttaaaataaatgggctggtcggcttaggttcttcctgtcccctcatgttcatgttatataaatgttggcttatatatctattttaggtgtgataaaaaagaaaacgtggattgtagtgatataagacagattaatcactagggtttttgttttgtttttgtagaaagcagtcctttaaagccttgtatgtaatcccatcaactgtttcctattagtgatgctcactgttcctattaatcagtcacttgagaagactgtacttaaaattcataagaaatgatttcaatgcagcctatcactgatctatatccttataactctttaaaattccctttttctgaaggcttcccagacactaacaaacaaaaaggtatctctttactccacacatagaaagcttttattagaaaaaattaactttagactatgatctatttttctaaatagtttaattgtatcttatcaagaggaaggaaaaatcaccttttcttttatgtatcctaagagacgggaagttaatatttatattgcctattagtagtgactactaatttatttattactcaataattaattgccccttatttgggagaaaacgattgcaacactttaactttctgaattagggatttaaaatactcccagtaaggaaatttaaatactttcttattgcataaactgtgttttaaaaatgttaagaaacaggctgtgctttaaaatttccaatcttaaatttttgacagtagatttcatgtggttgactttcataaaggaatagttaaaattgacttgattatctatagggagctgttaaattgatttataaacatgtgattacacaaggacaaataatacatttagaaaatttcttgccctgaaaaccatcataaaacttcactttttattataagaaaaaaatagtggaacccaaacttaacttgcatgcactatgaattttcattaagacttataaaatctgggatatgaacaataagtcttagccttagatcattaaataatgataatgctttaacttttacacttaatgacatataaaatgttcatgttggtgttgggcctctgctcttacagagataggcatggccatgtcagtgtggcactgtcatgtccaggaaatgattaatttcatactgacagatgatttggattttaatcactagtgtctcttcaccaggcagaataccttaacgggactgtgggcggtgcttgcaagttttacacttagcactgagaacttctattacccagaacaaagctttacccaaataaattgagacaatgtttcctttctgagcattattgaattcttctattgtttccaggcagcagccctggcagaactgaaattggttgctctctgtatatgatgcacggtagttgccaaacattagctatgatcagtgaccctgagtcaccagccactaagtcaacatgctgcatgaggccacagcttgactgaatgcgctctgacttcaggcagagaaccaggaacgccactaggaacatcgcttggaagttttaaagaaggcatacattttaatttgaattcctaaatattttctccctagaatgtcaataaaaaccacttcatattatattcgagggagaaggcaatttctacagatatgtcagtataccatgacattaggttagcatattaaagttaggaatatcatgactaagaattttgttttgtcttgtttttaaggtttaagttcattggtggtaaaacaaggtaatagttattgattgtcaggtctaatcttagtaaaatgaacttccaagtctaatggtgcaaattaaaattcagtgagcttaacataagcataattgaagcagacacacttctgtgtaatttgatttccttccaccgtgtttcgcctcagcattagtagtgtacattgcagaagataagcagggagaactaaagggttgtcagtgggattagagcttttgggtatgctgttgacattttgtttgcaagttgactctttcctgaaatgttgggtgactagagaaaaaataatactgcaagatggccctctaaacccagtgtccatggaggtagggcttcggtgagtggtatttaatgaggacactaacacttgagtcactttggacatccctcattattggtcagatctgcatcaagttttataaaagtaatgagattgaaaaattatagcaaagatgattttcccctctctcattttgcttatcaatcacgggctagatgttttctgagacagggtgtaaaggaaagagtgaaactagccttttcctttgagaggtacttgtttaatgagtgaccctgttccttgcccactaaaaattccgacagtgggtgttcagtggtgttttgagtttactgtctcttgatatccatttaatgatttctggatgtgattagcttttgagcatacacttatttgcttatatattgttacctttatggtagaattgcttcctcttttaaaagatcagtatgattgattttaacagaaatgtaagctattgtgtactcaggtgtgtcacattagtattggaatgactaaaacagagatagggagtaagcctttagtcagcgcttaatgaaattcttataatgtttctttggctaatccttgtattttttttgattaacaatttaacttgtgttcataacgttattttgtctttcgtctatatgtgtctgtaaatgaatttgaccattttccatgtattactgaatgtttatgaattttgtgacctgttctgaaatatactttgtacaaatgaggatgcagcgcaggttgtaggagatggaccaacaggaagagaaagctcacattagaagcctctaagatttgctgaggagagagattgcattaagtggtattttttccatgggtgtcagtgtgaaaggctaagtgttaaattcttggtgagttatgtaagtctcagtgcactctagcctggttagattaggaagccttcatttagatttcggttaggtctgcagcataattcttcaaatacatttttctctttactagttgtacatatttaattcttacgaggttttgggctctatggtgtgacgactcaggtcatgttgagtagtgtttactgttttgaagccatcttggtaatattttggtcaaaagtaagttaatataataagtatttgtttctgtagttctgaggtgcgcagaatataacttggctaatcccattgtataaagaatttttaaggaatgtgttgttggagtaagctacaaccagaaaaaaaaaatcactccttgactttacagaagagattgattatttctgtctgtagcttcatttagccagctgctctcatttctcctaccttggttttatatttgtcaagttctcctaaggggaacttatattttaaaacaaatctctaaagtgtttccgtactctcttttgagttatgtgatcacttctgtatttgggtgtaacctttaaagattaaatttttttatacattacaaggttaaatgaagccagtggagtcaacccctctccagtaggggagggacaaagagagaagcaacagagacctgtaatagagggagaaagaaaatttcaaggacaattacagaaacccatttggatcaactgttgcttttctaatgttaaaagctatgtgcactatcaggaatgacagcaacggtgctttcttgtgagggctaagagtgacggaaaaacgaacgcttctagttatcttctttcttgtgatgttatcaccaaaataagggcaaaatgcacagtatactttgatgccaagattaatttcatatttttcccattttaagtggttattaaagagaatgtgatgacttgaacttaacataatcactgtgccttatgttgctacaaccaaccatttcacaggccattgtgtatttttacatataaacgtgccttaggctgttacagcctcttcctatttcatagtgtacttttactttgaaatatctctttataaactatcaactgactgtggagtataactctttccttgtgttataggtttttcttttagtatattgagtaaattaggccaatgtcaacataaatgattggattctgtaagtactagatagccacttaaactatttgtattgcagtagaatccttaaaaacagttattttaaatgaaagggtgtcatcctttaacttactctctgagccaatttaaatattaatagcctattttggttgagctatgtgcttaaacatacttatttagagtaacccagctattaattttaagtactttagaatacttttttcattttagcaagcttcagcaagatttatagtgtctgcgaggcaatgtgtttaataaggaacttcttactttagatgttttttccattcatatatagaggcacaatatatatacatattgtgtgtgtgtgtgtgtgtgtgcgtgtgtgtgtgtgtgtgagtgtgtgtaaggagaggagaaaggttgaattacatgacttacatagcttacattaattattatttatatattattttgccttgaatttttattttttgttagtaatttgagtttaataaatgtgtaatatttgaaacttgcaaacttaaagcttattatgtttacttttaaaataataaattagcctttattctagtttatttcataagtttccaaaataatatttagccatggctattatgaaagtatatttgatagccaaattttgaaagctattgtgaaatgatatccagtttagtacatgatttattattttatgttggggcaatgcagcgacttatgaccttatgattgtcacatgaacattaatgctttactggtttgctatggccacttttatgttgtcatatttttatgttttgttttataattgggatttcaaccttccttcattttaattcataaaatgtggttccttttcccctacatctcttccaaataatctgatctagataatcgtaacagtaattgtaggaaaaacaaaaacaacctgggctctaaggctaaactgaaccaatttatgattctgggtaacagtgtgctttgaaatcaaagatactttctctgtcaaaatttattgaaacaccattgcgtctgtgtgtctgtataaaaatttgcaattctcttattaaactgataggccatggtatattaaagaccatttcttgacattttcttgtatagtatcaagtacaaaacaatgaacttagagttgaactttgattagatagggcttaaaatcttatttttgatagcacataatatgtaaatgttatagttggacccaagaagtgggcccttgaaatctcaaagcttgttttatgtgttaggtaagaaatcatctattcccattcccacactttccaatgagaaattgagaccatggcagtacttaggaaagaacacatacttcattagctgtgtagccagctggaaccaccctattggcagctatttaaaccttagcatctagggctcttccagggtctaaaaacaatcagtaattgacataatactgaataataataataataataagcaggtagttcataaaagtcactgatcctttcttcctagtgttagtaggttctctagtgattgaacactaattacatggcagcactatgttacatatgctatgctacatacactatataacatacactatattatatacactatgctacatataatatactccatgcactatgctacatacactatgctacagttcatgttatacacatctcgtactttcatgtcatgtgatgtcttaattctttgacacgctttattctgcttatcacattaagtgtctgagtctgtcagctccatgtaggacaaaagcagctgttacctgagttttacaactgagaagtttaagacatttaaagaaaaaaaacaggaaaccgtaatgctgatctgaaaggaattaattactatttgatgttttgaaatccctcaacaatctttaacactaattgttcaacagtgagtgtgtgtgtgtgtgtgtgtgtgtgtgtgtgtgtgtgaatgagagagatgaccaggcctctgagatatatagatatagatgtatagatatatatattcacttagtgattgctctaagtttcatttagaatacccagcattcctactggatagaatatgtaggcgccaggcgccaggctgtcaatgattcagcaggccgagggcttctgcgcaagcctggtgacctaggtttggtggcagaagccacgtaaccgtggaaaatgagaatctattccataaagtcttcccctgactttcataggtatgctgtggcaaaccccataacatgtacatatacatacacaataaaaatgataatacttaaaacataaaagaatttgtagatgcaagtttactctgaaaatttaaaaaataaattactaagatgcaaggtggtagtttcaaagctctggcagttctgttcagccaaaagcaggacatctctcatttgctaataatagttcaagagtctgcatctctggtgtaggtattgtctactaaaaaaacgttactggaaacttttttatgcctactatgtgcagttttcccaaattgggtcatgactccatttcatttacactactatctttttaaaactcagataattatcttaatattaatttttttcaagatattttttctctttttgtaggggagtacctctatcagtaaccctattccatggattttattacacattagatatactatctaaatttagtagctatactgataatccacattgctgataaacatgagactatcccctttctatttttactgtctgatactcttaggtaatcatgcatgcaaggatagtttgttaattaagaagcttccaatttttaagaataataaatactaatactttttctaggtgcataagtttggaaggattatgtaacttgtttaaagacattgaccaactttttctttgatggtgaaaaagctgcactaagggctggagagaaggcttattagttaagggtagttactgctcctgcagagggcctgagttctgttcccagcacatacgttatgcagctcactactgcctgtaactccagtttcagtgggatctgacacctttggtatctttaggcatcttcacagatgtgtacctacccaggtatatgtatgtatgtatgtatgtatgtatgtacatatacataaacacaaatgtacatatattcatgtatatgtgtgttttcattgtgtggtcaagtatggaaaataattaaatggcagtttaaatagatacatacgttattataaacctgattttgcaaatagaaacatagaaaatgtttaattagagcattatatgaaacatgtcatctgaatcccagctgggtttatgaaggacaaaataggagagtagaatagagtttttaaaaatatttcccccaaatagaaaaacccagaataaatgtttgctttctgagcccccaccttgagaggctgtgttgttgccactcttattttgaagccatcttgagacaccttgtaaaccataagaagaagacagacttagtgaactgtagtactatactaatattcttaaccagaaaatgttatttctctgtttgattacttatgtgcaaactttcagaaatttaaccagcctcaggttataatatttgtttctgttgaggattatttatgagatcagctagggtgttcccttccctcctcttccttgtccccctctcccttttcctctataaaacaggctattgtgcagcacaggctgcccccaaaccttaaccttccacatgccaggcatacagcccttcatagcagaggccgtttgaatgtgcttcccttcgaccctcaagcagatggtgctctgtggttaagtcccagtgtgtgctttcttttaagttataaaggaatttaagtaaacagcttatatacttctttttttagtatcgtgcagaaaaagtaaagattacttacttctaagcctgatttttttctctctctctctctcatgtttattttatgttcaagaaagaaggcctatctttggcttcaacttgaaaggaatttggtgactgcagatatggagtaaatacagtgtgaattcctacagtaattttcaaagtattcgaggtccttattccagcttctccatgtcctagagaattacccatttgtcactacagccaacagttccagttcactgaagttatttatactagcagtctcaagtcataggatcaatgggaaattcaaatagttactacttttagtcctcaaaatgtaaaaaggaaacttagcttctactgacagccacttaggaactgaacagtcttcatcccgagtcccacgtgcatttattctcctgtctgttgttggcagcaggttacgatgggtagaagctggcctttgagaccatggcgcatgctgcagcaaacaggtagcgtgtcttttgtgggatcattgtgttaggactgaaattcttttgactgaatttctttattgagaatagtcgaagaactgtttttatatctatatttaaaaccatctagtttcttaaattcttattattcttccccaaactgtcagatttcagtggctgagaaagagggacaaagagccaccatcatgttagggcagtattaaagtctctgggcactagagcctcatataagctaaggaggaatgttgttaaaaaagaggggaaaaatgcatagtaattcttaggattaacttactgatgacaaatgaccacttgaacaatagcatcattagacagagagccatggtactctaataaggaagccaaaaggaaaaattagaaagccacggggcggggggcgggagaaagaaaatgaaaaatttaaatttctgtctggtgactggctgtgtttcttttctgtacgcttcagcttctgtatggacatggagacatccctaagaagcctagtgatgtcattatgtttgtaaaaggaagagctacaaagacattctaggaagcagttctggagaagggtggctgggagggcactggagcatcacagaggtcttccagctgcagctgtagtgtggaaggcctgctgagctgggtgctgggcacgagtgaggtagcgatcagagcctgctggagagcagagagggcaactttcatacctcttcctccttccttccaatttgctttttaagtgtttgcccgaagaaggcttacacccttgctggagatggagcatgtggtgaagggtttgtggagatgaatcaggaatgaaggtccattcagttactgggagtaagaagagagtcagaaggcttgctagaaagaggatgaaaactcaaaactgacccatttattaagagtgagcaaaggacagacttaaatcatcgttagataaaggagtatgactgcacttgctaccctaactctgtgcatgcaagaccatgctatgtttccttgcctaggactgatttttcttatacctatgtgggggtgtctacgtattttctgagaggaatatggttgtcagtgtaggtcccctggcacatggtctacgcctggagaacttttatctgaaatactttccccaaatatccacgtatttccctgtccttctttatttaggtcacacttccatgtcacttgcataagtgggacctctgtctctatctcaaattgtacatcttccacacctcattttgtccgctttggtgtatttaggaaccttatgtcctctccattacaggtttgctccactcctaaatcccaccatcgaaagagtaggacagagatgctgagtgtgtgaaggagcaaacttggctcagaaatcaggaagaaggctcagactttagtctaagaaaaccagtcttaagacagtagttgatgcaaatagacagaacatacatatggttttaattgttgtctgcttctaaatttactctaaagctttaaataggattgatccttgcagtttcttaacaagttagggcaataaaagcttgtagatgatgtttttgagggcgtttggttgttttgtttgtttgtttcctccactatataatcttctgctctagaactttacatttattattcttttaaaatttcataaatgtatgcaatacatcttaatcatatttgaccccattctgtctctctaccacttcctggctcctttccccaatgcatcccccagttctctgctttataaaagcagccatgtccaagaagagattcccatatgcatatggctaccaggatttattattctagcagataagccaaaaaaaagtactcatttatatcaacttacctagaaaggtaggcaagaaacaatggtttgttttgttgttttagatagtttataacactgaatattctagaagaggaggagtggcccattttctctcaattgccaaattgtctttcttcaacttatgggtgttttgggtttgatttattatacaatagtatcatcaacttaaaaggttattagaagggtctatcttctaagtatttcagataactgtctaatttggcaaagacagacaatgatgatgagaataataataataataatgccaagccacatagggtttaactattgaaagagaattagatgaggtcttttaagagtgaacttctctagagttgaaggaaaagatgggaatagaccaaggacagggctttagagggcatccagaatgaagctacaaaaaacactcagtgaatatctggagaattaagagataaaaatcttaaaatgggacgaggagaaagtatttcatgatattgtatcaacttgggctaaagacataacagagtttgatagttaaatgtgtggtggtgtccttaaaacatacaaatgtcctcaaaaattaagtcctaaatgcatcagcaaagcaaatggttagtttattgtctacaataccttttaatttgaaatataggttaaaacatctcatagaaaataccatttgtctgacacacgccatgaggccgtgaaaagtgagatgcattagaagtaagggcaaaagctaggatcccgaagacaatagatggtgatgtgcatgttggtgcgtaaaggttcttcattatcagtatgcccagaacactcatcactaaagagtgttccatccctattgtgtagaacatggggtagaaacatgggattccagctggaggaaacctagacctggcacaattagtatcatattgcacatcagacttccttggtttgaatcttttaagacctatgtgaccttgatcaaatttacaatctataaacctcagttccttcacttttgatatggacacaaggagacactgctgttgaatggcacttacacagcacccatgagacattagcactcattcttagtgatgttgcttcagactggagagcttcttacggcttaaatgctacatggaggtctgtttggccacagcaccaagcgagtctcagtcttaagatgggttcattatgattttcagagtaattattatacttaagtaacggtagccttcacttctggtagtgttatcagatgtatgttttgacttacatatgaaggggaactaaaaaaaatgtatgtgtgatagatgttaaaaggagcacttcctgtcaggctctgtttaaccccttccatcttcccactcagccacatgagctgtagagagtcactcacaagtacaagcttgtttctttcttctccatgttacaatttaaatagcacttttacaagtttacaaataaggtttggccattccctccctctccctttcctccctcattctactttagtgaagagattgagattagattttaggataaacattgttgcgaagtgcctacttggtgggctaaacactgctgtagagcgccctttggtgggaggcggggaggaaggaaggagacggattctggaacttttgtctcgctgaataaaacgtagtgcgccagaaactgtgcttggaacagaatgagagcaggcagctttgggatggtagcacacaaccacttgtgtgtcagttttaatggatccagtttctacaactaaaatttatgagaaaggttaggggtttgtgtcagataagcacaccagtgaccagacatgctaaaacatagggagcccctccaaaggattctactagtcctaaatgaaaataaaggaacagaagtggggaaagagatgtactcagcaggctgggtaaggcaaatagtgtttgctttggcagcaatggcaaaggtaaatgctaaggtttaagttgcaaggacttcctgccgtctgtagaccactcactgttgaacctttcagtgataactctaaaagggttcgttacactagatcatggagagaggggagacaggtgaatcatgtggtttctgcttccctaccagcttctcttctacttttagggtaactttttgaagtgtccttagatgatgaaaaaacacactcgactttgtctgtctgtcagtctgcttattttgattaacctctgttctctagttctatcagcttttctggaaatgacatgattgtatttttcttatacctgaataatgctccattatggagatacaccttatgctatatccattcatctgttgatggacacctaagccaatcccacagctctgctgtcctgaattggacaacactacactgaagtgggaaagcatctcttcttccatccacagtcgtgatgttcattgtataaatacccaggagtgtggtttgatcaagtgtcattttaccttggggagatatgcatactcttttactggtttatactcgcaccaatcttacagaaggatgccccctttcccacatctttttgagttaacagccattctgaatttcagtatcgttttaattttgattttcctgctggttaaatacattgagcattttttttaaatgttgaaaccattcgtactgtggagtggtgactgttgatgtggttatttctggctattactttgctcttttgatattaggcttttctgagatcttcatatagcctgaattttaatcctttgtcatacaaatggttggcaaagatttttctctcatgctgtgagctctctctacttagttgattgtttcctaggctgggcatagccttttgaagttttgtaatcgaattcttcaattcctttgtttcctgtgctactgagtcctattcaggaatagcctcagttgaacttttgaaatattgtccctatctgtgcttctagtagtttcaaattttggaggtttacattgaggtatttaatctattttgagttgattttttttatatagggtgtgcaataatgtgtagttgtagtagtcttcctgcctgtgcctatccagtgtccctagcaccacttgttagagaatcttttctcctgactctgttcctgagtctgtttttagcactttgataggaatccattggctggagcaagttggatttattcctgggtcctctgttgtattcctttcatctgtggggttgtttgtttgtttgtttgtttgttgttttgttttgttttgttttgtagcagtgctgtactgttcttgttactgtggcctatgtaatttattttgaaattaactatgtgatgtctgtatcattatatttattgattaatgatcaatattgctttagtagtcctgtgtctctctctcacacacacacacacctgaaattccaacactcagaagaagcccattaaaactttgaagccagcttgattgtaaaggtactatttttaccttcttagttgggtttattctgaatttcattcacttatattctctcttctccttccttcttcccccttccttccttcatttcttcctgtgtcagctattccttattttgtccgctagatcaaatttcttcctcagcaaatttattattggtatataggaaaaatactgggttttgtttcctgttgctttgatgaatttgtgtattggctgcaagagcctcttagagtctctagagtcttccaggtatgtaagcagggaagcttaactcccttcttatgtatacccatgtcctttttctagctcaatgggtatagctaaaattccaagtacttcactgaatgaaagtgatgagactggccacccccgtcttggtcctaattttaggggaaagtttttctatatttctccattcagcaagatgttggctatggatttgtcatgcatagtcattatttctgtcctatgactttcctgtgtcatatttagttttctactgtaaagggtgttgattttatcaaaggcctttctgcatttgttaatgactatatgcattttattcttgattatatttatgttctgtattgtctttatttgtgtgtgttaaacaattcttatgttcctggaataaaaccaagttgacatggtatttgatcattttaatgtgctgttgaattcactttgcagttattttattagaggtttttgtaggtggttcagaaagagtagtttataaagttttgttctgtctcaacaggttggttgcagagtagcacttgcttcatagtgtgaggtttgagaagggttagtggtctcatttctggactcagtcgatgagcactgacatttggttctttgtaggagtctggtgtatcttagcagaaactccaagtaggcgggagcttttcactcttaggtgattgtactctgttctcgttgcttattgttgttctacttatatctttatatcttcttggctctatgttattaggtcatatgtacctagaaaatcaaccatttctttaagatttcccaatctattcatgtatacttttccaaaacattttctaataatgctggtatttgttgttacatttttatttttgtctctacatttttaagtgtctttcagtgaggttgcctcaaggattgttaagggttgtcttttgggggaggtgggggcgcgtggagctctaaatcttttctctagattcattttattgttctaaaaggtgtgtgtcggtgtgtgcacacatgtgcgtctaggtctgcgctcgtgagtgctaggcatcagattcctctggagctggaggtaacggcggcttcgagctgcccagcacgggcgctgggcatcacactcaggtcttctgcaagaacgctgtacgtccttaatcacccactgtgccgccagccctgagactcaaccttgtttcaggtttgctttggattattctctcgggttctacctcttgtattgatgcactcatcttataatgtctttcctttttattgattttgagttgtttgtaccatattttgggagactttgtgatgtgttatcaaattattttcatatctgtatccttaatgtatgacatacgtagctataaactttcctctgtgccgttcttataatgtcccacatggcattctggaatgttacatttctagtatgcaaacattttcctcttgtctccagtgctcctctgatcaaacgtagactgtagtcccccatgcttgtcatttgcccttctcctttagtgtctgagacagggtgtctcagcaaagctgaaggaactcactgtttcacctgagctgactggccagtgagctcactcctcttcaccagggttgtgaggttacagttacccatgtgctacctgccatgctgagtacctcagacagttctggggggtcggactcgggtgttcatggttgtataccaggcctcttaccaactgagtcatctacctgattctttcctggtgttctttatgtgaaataataattctcttctctcatttcaaatcgaagggatctatttagtacttgttggagggcagatctataaataatatatcttgtagtacctgaattagaatatttgaatcccctttagttttcaagtgtagcattgctgggtacagaggtctttgacatttcattctttccatactttattttttttctgttacattactctttctttctttcaaatagtatttattgttttaccccagctgtcttctctgagactctgctgctcagaaatcatgtatgatgaattaacttctcttgccttcaggattctctgtctgtagatctgatcgttgaattatgctgtgcctaagtgcagatcttttaaaatctgacatatttggagttctttgggtgtttgagcgtctctcattccatgtggggttgttctgctgatgttgcatgttaagatatttacatgttccctctcttcatgacgttatatttatgtgtctgcagtcataagtgatgacatcccacagacctctcaaactgttgagtgctttccagaccctctggcagcatactgtcaaaggagctatccgcaggctcgctggttctctcctctcctgttctagctttaacatttctatcccattctatttcatctcttctaactctgtattcatattttcaatatagggagatatcaattttatatttcagttctttagacatggttttctttatgccagtgtgtatatttgaaatacttagcgcataagctttccaaagcagtatttctctgttgatttcttgatgtcctgttcattgtctagcctttgtttttcacatcttttatttttattgttattgaaatgagacattttaatatggattcatccctaaactgaaatccaaaatcttaatattttttttttgagtgctaacatgatagttttggattctggagtattcagatttcatgtttctgttttagaggttttgagccagcacagctctatacgtgtttcaaagcttagaaaaggaaactcagtaagggtccctctgcttgtagtgtagtaatggcagtcggcagttgacatgctttcctccctctcctgcactagttcttgataagcattacagacagtgtttagtgtctgttctcagttcctctataaagcttatattcgtgtacattgtaagtatcctgacatccctccctttcgcccttcccttccccctctcccctccctccccctctctctctccatatatgtgtgtgtgtgtgtgtatacatatacatacatacacatatacatacacatatacatataaatacacacatatgcatggatacatatatatatacatacatacacatacatattttaaactttgtgctcatctaatagttgaacagaaatttcattaaatgcataggagcaaagcaacagcttaccagtgtgtcgagaggtcctgtgttgcagaaagnnnnnnnnnnnnnnnnnnnnnnnnnnnnnnnnnnnnnnnnnnnnnnnnnnnnnnnnnnnnnnnnnnnnnnnnnnttttcccgagggcattatctagtttatttactattccttgcagctgcaactgtcacctcagggtgcacaaactaagacatgtcaataaatgtcctcagtagctctccctgtccaagtatagcaagctacatcaagccagttttatggtaagcaaaataaagagaatccttttgaggggatctaaacaaagtataggaggaattctgtgcctctgtgttatactgaagactttggggaaaggcgcattcattccctgccagtcacaagcattgtaagcaggtgccatgtttataggagcaggaaatttctttgggatttaatcaagattcttccttttctagaaaataacttggagaaagcttccagaaatacatcttttattccattttcttttgtgactcttttaagatgtaaaggtgtctagcctgtggtgttgtcagactgtgggtttaactgaagcacatctgagtttaaagtacaatattctgttcactgcccggcaaagtgtccgtccagatttgcctttcaacctggtcgtcgtactttacccctgttccgcgtgtaggccatgttgctttagactgctgggttttgctttgtttctggttcactagagttcaggatgaacgttttcaggtctcctacagcggtggctttcagcctgtggtggagaggagtggccacaggccatgtgtttctgttatctcacttgcaaatagctgtgaagagtccctgggaggctccagagaaccttggaacatgtataggtggattgctcagctttcactaagtattctagggagcgttcggacatctaggtgattagaaatgcttcttattgtcttattaaaagtgttattctatgtggcagcaaacattttgggttaagcttcattttagtgaactggtcaacaaaggaagctgaaagtttgagacttaagtctggccttgtggcttcaaacagaaagctcacaaatgtaaaacctacctgggctatagagaaaattcagggacagcctgggctactgcctctcaaaaaattaaagcattaagggcttaagcagtagtagaatgcttacttagcatggataaggcacttactttaatcctgagaaccaaagaagaaattggagactatcatgtttgttcaaaagagggtttactgtgtatatttgaggtttataacagtgttagcaatactcatagaaaataaaatggttactatcttctatcatatataacattgtgtgtcacaatggcaataaaatctgcattaaacaaaaatctaataaataaaatcttgatatagacttcatgtacacatttcttaacttgtttgttcttttgtgtcctttgaccaccccctccattgcccttactcccttgtatatctttgaaacctctttcttttcatcatgtgatcctgtaaagttttaatttttgcatctgcttattttatttagcatactgtcttcttggcccacctgtgatgtatccattaacatcctcttttgtgtggctaaatggaggtctgggagtgtatagtagattttctttatccatttatcattgatgggcattgtgatgctgcagggacatccttacaaagggttaattccatcacccagaaattattgctgggttttacagaagctgtgtgtgtaacattagaaacctccatactgtttttcatgtacctatgccaatctacaccctgacctgctaagaggtccttttctatacatggtcaccaatatttgcctatttctagtctgttttgtcctgttttcctttcctgtcttttctcttctcttctccattccaccccaattttgagattagatctcattccatagcccaggctgatttaaactctgcaatccttctgcttctcaagagaattatgtcctttgtgggagagggctttacttagtctttgctcattgttggaactgggttgtttgttttaactattgagttgtcaagatttctttctaagatgacacatttctcccttccctttcttgcctcccaacccctccccactgtccttcgaatccatgcctatttttcctttgttatcgcatgtatacgtgcatatacatattttttcctaaatatctgttcagcaccactttgtgtgcttttctccaggaaggctatctctatctaccatacccagatttactcagttgcagatactttttttgtatggttgaggcctcatgggcttttctctgtccactttggcatgtccattggtacagttttggctcagctcatgttcaggcagtcttcctggtgaagctttgtgggggtagtttctgacattactaggagacagccccatagcaaaccctgtgaccctctggctcatacacagttctgtagccccctcctccacagcgttccctgagccttaggtgtgggagtgttttgtagatgaatccactgggactaggctccataacactgcattttaattggtgggggttttctgcagtggtttctgtcagctacagagagaagtgtctttggggcaaagacaatatttatctgtgagtagaaggacatatacttagtagggactatgttgatttggattttataattggtatgtcttcaccatatatgtgatttgcaaatattttttactagtctgtgggctgcctcttgttttcccctgtattttataaacttaagtttagtggagttaaatttatgtgcttttgcttttataatatgaacatttgatgatatattcaaggaataactacaaagaccaatgtcaaagacttttacctccatattctttattagtttatggtttctgatcataggacttttgtcctattttaactttacttttatctatcatgtaaaggtacatctaaaattccttttccccccacatgcattcccaggtcttgtttatatctctttattgccactgtcaaaagtccatttccttctagtccattgccctattttgtcagtgagcatccgttttgtctcagtgctatattgttttaactgtgtctgtgcagtgtagtattcaaccaggaagcttctaacttagtttcttagtattgatttaggtgtgcattgtttctccgtatgaaatttgggattattgtcttctatatgtctttggctaccacaataggaattttgatcaactgccctaaatctttattgattgcaccccatccatgaacatactcagtgttcgcattgtctcttttatctgtcctcaatgatttatagtttccagtgtgtacattttaatttcattggttaaatgtattcctatttttttaactataaatatcattttgctttttttttaattgggctgatactttagtttaaaaagtggtatagatttttttatatgcttaaaaaaaagcaagtttcagaacttgctttatatagtgttatagcactcacctctatgatgtctgtcttcttctgatctgtctactaatggaacgatcaggagtttcactagatacgattaagggggtgggggcaggaatctctggtaaagagaatttgtatagcacaagtgtttttaaatgtctattaaaagagtcagtaagagctggagaggtggctctgtggttaaaagcactgcatgctcttcaagaaggttcaatttccaacactcgcatggcagctcacaaccatctgtaattctagttccatcggttctgacgtactcttctggcctttgtgggtaccaggctcacagacacaaacacacaagcaaaacatccatacacataaacaaaatttttaaaaagtttttaaatatcagcaaaaagtttgagaggattaataaaaagataggacaaaatgtaaatgtgtaaatatttcttcccgtgaggtgatgaggtggtgttgctagcaagaggtacagctccaccgctcagtatggcgcatgaacacaagcaccctcaacaggagatggctccgctgtgtgcagaggacagcactgctcattttgcttggtcagatgtttggtcaacacagcatctgctggtttctgttacaggtcttgaggttgtagtcagccattaaccaaggtttcagagtcagttttgattctgaaagtcttaactgtcaacagaagctggggacctggagaaggtgagagagagggcctaagaatgccttagagacttgatcactatactacttataagagagggttgcattatgatggaactgtgaaagtgtatattcctccagtgaagttaactaagatatcagcccagcattttctgctctgttgagtgttaggaatgctatttccgaggtggtattctgcaaaactataaaaggaaaagtgtgggtggtgagagaagaatgggggcacgacatccccgtttgtagtttaggagatggggttaagttgcctttcaataattcagttaaatctgaggattatagaacttttgtaaaattgtttagaattttgtacttattaaataaaatacttatctttcaaatttatccaattttagcttttcatgctgacattctcaattttatagacagtatattcttttattcaactaccaaagtgattttttttattgtgtaaaactgaaaagtagacactaaaagtgtatgtaaataaatggaattactgctataattattatatttactgagtcaaatttcagtttcctttgtgcaaattcaagtatagcatttgtgtcgacaagccactttgctttcctgtcgcaaatacactaataacacattatagatagaaaacttccatctcaggggatgaataatagacgcttctgtagcccttggctctgaggacgcacctctgctgttgtaggaggattttaattttattattttatgtgtttggatattttgcctgcatgtgtgcctatgcaccacttgcatgcttagtacccaaggagaccagaagcgaacattggatcctcgagaactagagttagaaacagttgtgagctcttatatgggtgccggggcccaaacccaagtcctctggaagggtatccagtgctcttcacactgagctacctctccagtcctgccgtggaagtatttttttcccatcttgtttataaattaaagcttttttcagggtaataaatgttgtacctacccaattactaactcttggaaactgatcaaagtctaatttaaattttataacatagtgacaatttagaaataacccatgagttgtgggttacaattaatctcagcaatttgggtgtgtatttatttttaagctcttaaaaggaatgggctaggaatctatttcagtggtggcatgcaggcttgcctagtatgtacagcattggagtccatcctggctggggtcaggagtggtaaaggaaagagaaaatgaagaagaggaatgggggaaaggaaagatgaaagtttaacctaaatgtgataattaactataagcttttttagaaaacaactacctagaaaatagtttactataatttagtaataaacagaccacattcgcatgtaatctctatttgaaagaaacaaatcaaaagtaaaggcagaaaaagaaacagcaatccaagtaccgcagagcctgagccataagaccactgaagagaattcacgaagaaacatgctcagggcagggcagccgagatacccactagctctgatgggctcaaaaactaaaacttagcagcctcgggttgctgatagagtaatttgctttgccagttgaacttggttattaaatataactgcttatgtacgacaacagaaatatcatggtttgtttatagtacagtaagaggtgtataagttcctaaaatctactggaaatttgactaggaaaaaataaataaggaagaagctggaaaagttaaatagtacagagtagtgctttctgcctgtcttcattaggaggctgagagggcttcaggttttagaaggatcttcctttttctacagaacacgaccatgacgtctgtcatttctgtagttcctcaccttttcactgcatacatgtggcttgaaatcattttcattcctaatatttgttggtttgctcataggattataggagacaagttatagtttaaagttgtcctatagtataatagataaagagtttttattacctgttacccctgaattaaactagacaatgagggatggaaaaggctctaaagggcttaacaccaatcaccatagctcttgggcatagactcaaggcactggttgtttttcttacctacttctattttgataatcagagcttttctgttttctacatactctgctctttggttttgtactattgtgtttatgctaagtactattaagaacaatttcaattaaattatttaaagttaaaatctattttaaggtagatgtgtggtctttaaaaagtatagttaaaatttacttaaaatgcagaaaaataaccattctactgttgagcacatcttaggattgtttattaaaaatcactttaaaatgctaggttataaaaggtggattcaaagattttggagttttcaaaataatacctacaaagtttaataaagctcttttttctgttagtctattttggaaagcattcagactgtgcctgtaagtactgcttctctgtgatggttggaggcagggagtaaacagcctactgtaaatgggccccatgccagctggctccaggcagcctcaagcttgtgacttacagtcagggttaggaaaatgctttttaacttgttcatttccgtttctgttaaatgtgggagggaaggcacatcatttattaaataccatgcaagatcttgtaaagcttacatgtcttaaaagttatcagtaatatcactgaatctgaaaccctttaacaggaaaatttggagtttttagaatctatttaaccttctccttgttgaatgtacttggggtcatatttgggacttctttgacctgttgtcaatatattcagtttactgcctagtagtattttggggtgaaattgtatggtatttaagaaatgaggacttttttcattttgtttgtgtgataaaaagctaatttaaaataattattttcttatttaaaagaggaaaatgctcaatttgttttcaaagacacatcacacctacatcttagtttagagctgataaaccactttaactacctaactagctgagtatcactcccatgatggaaaaatggaagcgaagattctggataggtttttgttcttgttgaaaagctagtcaaaaaataattcttttcttgaatattctgtcaattattttgcaacttgggaaacatttaagtatcatgtaaccaaattattgactcaattttctaagattgctgtagatatttatttacaggaataggaagtaagggtttgtgtgtgtgtgtgtgtgtgtgtgtgtttacttgaaaaatggagagtgaaatttttcaacattgaaatttccaaatatatgaaacttgaaatctaagaaagcactttgttttaacaataagattttaaacatgatgtaatatagtaatttccattatagctcttttacttttaaatactttattccatgcagtaaaactctaaaagaccaggttggattattagaagcaattaaagcaccatgagttagtgtacttttcagtgactctaaactaacacagtttctagatgtgcatgaagtgtaccgggttttagatggttggttttttctgcttggtttaaaactatggaaacaatttttagaggacatggtatcttctagtaagctgtttatttctgctttctgaactaatatttgcaagttttcttgggtggtataactcctatttccccttgggagggcagcagaaatgtatggaatataggttaaaatttggattattggttgtcatttcatatgctaatgtattatttattaaaattagaatcggtggtgatgtaaatgattctaagaaactagtagacaaagtaaggacataaatgaaggtattgagcatgagtgacttaaactaattaattctgacagagacactaactagacattattttggtagtctgtgcccaagtacttagcatataaagtacatgtttgtcacccctaagtgtgggaaagaccatggtgagtgcaaagtggattctacagctagtcaccaattcagtcttcctcactagctacaggacttcccagggcagagtttgggagactggctcccagaaagccctcataatgttctgagaccaagatctgaaaagaagatctatgacaacagtggtctgcactgtttattttgtggctttaaagaacattttgataaaaaacaaacatgagaagttaagatttctaaaatatgaatgaaagtaacttttccctaattgagaacatgataaattgtaattagtaaagaaaaagtctcttggcattgttttataaaccaataaaatgcatcagggatagctaattcttgttgtttcatgaagttctaggttcactagggtaaaatttcaaagtatcagtcttagcaagatagtttgtttctttatagttgttacaagtgatcctaggagtcctttgcaactgtctgccatagagagtaattgagaaccaagaaacagtagtggggacaggagcttcttagctaagtgtactctgtcatcagagcttgataacaagttatgtaacatacacatgattatgcaaaatactggaaagcagtagtaaactaacaacactaaagtcgtggaatatgttatatgactacataacatatctttcttggcctgtgacctttatcacctctcagatttgctagaggcctctaatctgtctgctgttaacctgccttgagtatgacagttgtgaaactgggaagtcaagggactggctagttcagtgtagtatgttagaatactctcttctaactaggaagcaccacacacttccaagatggctattgctttaaaagaaaaggtatgtgtgcctttttcctctttcttgtcattgtactttgctgagaattgagaaccagtggtaatagggtggaaatgttttctgtaacagattattattatgaaatccattattaaagtcttaaaacacctccccctttgttagccacatgtttcacagcacaacaaggaatatatttttatggcagatttttctcttagatgttgttgatatagtactagactaaataaagacccagatcgtaagaaaatggttctcatctgagtgcccataatttacatcttggctctttaaatgtggttaattttttaaagccattatttcgaggcagacttttgaattgcagaccatatgaaggacttgaagattgagataagtaatgaggcaggggttaaatatcaggtagaggggttggattttaccaacactgttagaccttaggagccatataaaagcatctaacagaactgagggcactgctgttagtgttacaaacagcagtgctctggtcatacctgtatgcatggatagcaagggttcagaataaagacctcactgaagttgagagggatggtatacatattataaaggcagcaaagaatgattatgcttctgagctaggctgtcttgctccatactgtaccttataaatactactctggcagttagatataggataaactatgtttggagggaggtgactataccacactttagaggtaagagtgactgccagactgcctaagatctgataagaaacaaggcgagaatgagctaaagtggccacaaaagaaatggggagcagtttcagaaagctttaggaggcagttggttagagcaccgttggtttctatctttactcattgactggcttttcaaaaattactactcacctgcttgtctctaaattcagtgacactctctggtgacctactatgcagaagttccatgctatataccagtgtcctgtttataaagatttctttctaaggtttttgtggttcaaatctctcgggctcctttctgttagttcctttgttcttccgtgtttgcagagctctttcccagaccctcttctcattccattcctcctcctgataaataccatcagttgctttatctagtgtctcaaatctagtctctaacctcctgacctatatgtataactacctactggtatcttatcttactgacaggcctctcaaactcaatatgtccaaaatgcatttcctacttatggtatattctagttccttttgctcctttatccagtacctgagaaggtgcattatgtcttgttagtcccctgcccgaggctgaaatctagacaatactcaagttgccttttctcctccctgcctatagtttttaagatgtgaataaatccttcatgaagtgtgtgtgtgtgtgtgtgtgtgtgtgtgtgtgtgtgtgtgtgtgtgtgtgcatgcatggggtggaggtgggggtatcaaacccaaggccttacaaaggaaaggaaaactttctacaactgagatacactccttcattcccactttctgtctcaattggtcctacgttaaggcaggctccaatgatttttaagtggattactgagacatcttgactggcatccttcccatcttcagtgtgctccctattctgtactatagctttcaagcatgcagatgagatcagatcactactgctcgtaaggaacaattcaactgcccttactgcccctagggtagttggacacttttatgtggcttgtaagatattgccttaattaggtttatcttgctgagataaagaccttgatcaaaaacaacatggggaggaaagggtttatttgaccttaaggttgtgctctataaagaagggaagtcatggcaggaactcaaggcagaaactaaagcagaagccatggaggtgtgctgctgatgggttgttccctctggcttgctcacattgcctttttaaataacccaagaccacctgctcagggtggcaccactcatagtgtgctaggtaggccctttcatatcaaatcctacaggcagtctgatggaggcatttccaattgaggttccttcttcctaggtatctctctttgttggggagggggagactatccaaaaatcaaaacatgacaagtgtcatgatttggtaagatttttattagatatttttttcattcctcctcctccttttcttcttactcctcctcactcttctttttgtatttggttttaccatagctctctggttcttagttacacaagcagcatcaggtaaaggtcgaatcagacataggatagttactgccacaaagtgtgtgccatcattgtcctagcatattagatacataagctaaacttcttttaattctttctttcctgctgcagtgctttttcataataccaatctttagacttagtacttggcctccaaccatctttcctttccattccttcttcattctccaaaacctaactaaactatcccatcttcaagcaagaccatttctgatgcccttctctgtcccatcacaacacttggcagtcacctgtcctagcctttatctcactgttttacagctaaagaaaaacagggagtgtaagagcctgtgacctcacagctccaattgcacagtgactgggaatttgcataaaatgtctccaaggatgggatgcacggggagggaatgcttgggggttctgttttctatcaaccatccagtgagcagtcagggaaaatacttattaatgcataaaatttttctgtataataaaaccattttaaattgtcagcagaagaaattcggttttttcttgtgtatttgtttgcagcgtgagaactggaactgagagccttctacacactaggcaagtactctaaccactcagctacagcctgagcccgtcagaggatttcatattttatttaagctatcgctattttaacaaaaaggacatgtttacaaaatctttgttgagtgaagagccagttaaataaataaatgaacacatgaaaatgttcttggaaagatggaagaaaacgtctagcaaagttttcttttagagttaaatgtactactttcttaaaagtatttttaaaaagaaataaaatttgatgtaaaactcccaaaggaagagcaggggagatggctcaaggtaggactgttggtacaaacatgaggacttgagtctagagccagctggttgtggtcctgcatgtgcatgtaaccgcagtgctgtggtgggcagaggtgggagatcactagggtttaatggctactaacctaacacaggttcagtgagagaccccgactcaaggaaataaggtggaacatgatagaacaggacatttgatatcttcctttagtctcagcacatgcatgggcctgcatgccccctccccatatataccatgcatacacacattaaaaataataatatcaaagtcaaacccctactaaaagcaacttgggaaggaaggtgtttattccaccttatacttgcagcccacactgagggaagtcagggcagggcagggcaggaccctggagctgatgcagagatcatggcttctgcttactcccttgtccctcttggcttactcagcctgcattcatatagaacccaggaccaccagagggggcaccaaccacagtgagcagggccctcccatagcagtcatcagggaagcagtgctgcccagtgccagtcttaactgaggtttcctttccccaaaggcagaacttgatttgggttgatataaaactggcctctcatttcactaatgctctcagagttttgtacaatcgccctagatattgtgtgtctgcactcgcacatttataagatagctacctgcagatgaaggactcattctacctacatgttttatttattacgctctctaacttccgcctatgtagtatttttgtggtgattcctcatggaactgcaactaagctatatccagagttggcaggctatagtctcagatccatctggcccttaaattaccatgaactaatgatttttttaaggtttataaaatacaacaaggaaggaatggcataaggctccagaacctcctgagaagtcttttgctgacagatgtggattgattgagctctataccatctttatgtaggtgtctaacattgctttcacgttagctgtgtagttgattttcattatccatggtaattagattctaaatgtgggagtaagtatacaagaaagacatttatagtatgagagtctgaatataggacggcagtacctctcttttctctttggaatgaacttttcagtaaagttaaatttttatcactgtgtgcttatctgcagatagtcaggatgacactgcattttgggcattacaaataaattttaacaaataagaaaacttaaaaatataaagtcaaggtttaattaaaataagttgtaatcactgtgttagtatctaaaagtaaaattgccacaccttaagaacttgtggtcctctctccttttgtgtgtgtgtgtgtgtgtgtgtgtgtgtgtgtgtgtgtgtgtgtgtgagacagtctcgtctcatgtacctcttacactagcttcaaactcactatgtagctgaggttgcacttgtattcctgatgctctggcaggcacttaccaacgacctggcttcaaccttatcctgctttttaataattgagtggtatagtttatactttcagtgggcacttatcttaaaattattagagctctaaagtatgctagcagagaggttagctgatgcatgagaaaaagtcaacaggtaatctggcaaccaggcactgtaatcccaggactcaagagacactttgagagttcaacgcttgcctgggctagtgagagactcttgaaaacaccattaaaggaaaacgtttttaactggaatggttaagaaaccttgaaagcccagacatgaagtgaataataaagaaccacatgtttaataacgctcgtgttacccatggtagggcatgaggcttcagacacgcagtcagcagtggggaagtgtttaaaaggcctcacctgggtgtgtgcttaaaacaaggctcttctgaaaggtagacagtggagctgtactgctaactgaaggactttattttctaaaacaaaaaaagtttgagagattgcatacaagcaacatgttagctctgtcaaatatacagttacctacctgaatttattaatgtcttttcacagtaatgatttgtctttgaggtttagtctaaatttctaaatggaaatgtatttagggagaatagctttttgaagctgttccctcagtaccaagtatggaatgccagcagctgttggctcttgtttgtttgtataataaaatgaatttccagaagagtcactgtgtatcctctaatagatattagaaatgacacttagcataatggtatttaaaagtaaagaaaactattagccctttgtcactgtgatactctttaaaataattatcagagttggaacttcaaacttagggcactggtttaaggtgtgagtttgcaggtgcaaatgttaagtgtttttaaaatagaagtaagggggagatgtgacatcacctctagtttcagttcttctaaatcttcagggtgagactgtagagagggagtcctctgctcttagcttcccttgctcaagatggtagccacatgcagctggcagctcatcatttgattgccttaggatcaagggatgctatagggcatcctgctttgctgaccaaaactcatgttaactgtggaggaaaaaagggaatgccatacagttgggcaattaatcaccaaatgcaagggtgaatgcactgagtagagaaatgtaatcagagatgctaggaataatgaagtgaaatagcaggtggattactgaaaggtgtctgtggacctgatgcagtcaatcccttcaaacttcagtgactgttcccagaactaggacagaagcaattgcagtcaacatgaaagtaccacagtcccccaaaaagccaaagaaatcttaaacggaaaagaagatagtactgaggtacaacaaagtacctcactccaaattatatacagggccaacgtagcaaactgtcactatactggtatgaaaacaaaaactgtggaccagtgaaccggagtatcaagaaataaactgatagtagcatagctgtctatagtcttctgatgcacatggggccaaaacatacactgaagaaaatagcctaacaagttaaaactttacatctgcatgaaaaaaggctgaggcttgattttacctctcaccctgtgcaaactcaaagtggatccaaaactggacagaaactttggacctgctataagaaaacacagagggagacatgggacgatagatgcagtggcaaggactcgttcagcctgcttacccaggaccacttgccaatgagggacactgcccacagtgagctagagagctagagccatccacataatcaaaaaataccccatcggcttgcccacaggccaatttggtggaagtatttttctcagttgaagtatcctcttccccaaatgattgaggcttgtgtcaaattgatataaaactagccggcacatccaagaagtaatagcaaaaactagccattgcatgaaattagaatgcagaataggaaagaaatcagtcttcagcatgaagagacagcctacagagtaggaggaggtcttcaccagctagtcaccagagattataatccagaatatagaaagaattaaccatcaggaaacaatatctgaaaagtgagttacagtgcaagtggccagtggatccatgaaaaggaaatgtccaacatctgaagacatacgaggaaaagacaacatacttcagccaggaggactaccatcaaaaagacaagcattcctttatttttgtggtgcctgctagggttggctgtgacaagatgaagctaagtatctctctcccagaactggctgtcagaaactcattgaaatggatgatgaacgcaacaagcttcatacttcctctgagaagcaagcacatggccacagaagtagatccttggtgaagaggaaagggctctgaggtctgaatgggtgggattgacaaaaaagattttcctgtgaatcaagtcatcctgaccagagcatagcatgcctgttgtaactaattacttaccccatccctatctctctcacaaacttcctcctccatctccctccccttctcccctgaaagggtagaggcccctctgtgtgtccccccaccctgtcaatatcaagtttctgcagggcaaggcgcattctcctactgaggccagacaaggcagcctagttagggtagcagattccacagacagggacagcccctgctccagttgttgggggacccacatggagaccaagctacacatctgctacatatgtgtggggaatctaggtccagcccgtgcatgctgagtatggagcactcttgttataggctaagaagaactggagaaaggaaacacaagtctacttacgaatgcactcagtggccccaaaagaactagcagaacctgaaagattttcagtccctctaaagaaaatgatcttccctagtttgcagtattagacctggaactcccaagagaagcccataagcaaagagtaagtccaagaccaaagcacccaagaactagtgtcctgtcactccacatgtcctgtaacacaagcatggacaaattgctatgtagaaacaatacaataataaaactgaggaagaggctatagaatatgttaaacttttagccaaaagaatgaagaaagccaaagaatacaggaacatatatccaagaggcatagactgtcctcacagcttctactccttagtctgagtctagccaaaaattagtctttattttaaacaattgaaccttgaaaaaagtaaaatccagcaacatgtctactgtgttccttgtagtcaagaacagagtccctccttagcatccatgtgaaacaaaaggcaagcctgtgcctgtgatctcagggctacagaggtagatacaggacagctctgggactggctggtcatacagcttagccaactggtgagtccgaaatccattgagagacctgtctcaaaaataaactgagaagtgattgaggaagacgcccaactcagtgtatgtgtatctgtttgtatacagtgttcccacagcaaatagtggcaaggatggcaggtagttatattttggtgattattctgaggtgcagtaatatttatttcttttaaaatgctttgctaatttttttagaattccatatagtgtgttttgatcaccccacccactcctccctctaagtcctctgagattcacccctctcagttagttaaccactagaacagccctcagtgcacactcacaggagtcagtcagtgtacaataaagatgcctacaagcccatgtttgttttggcactgctcaaaatagtcaagtcatgaaatcactcattagtggaaggaaaaagaatatgaagtatatatattctttgactatgcacagccactaaaaaataaaattgttaagcaaaataaaccatacttggaaaagcaaatgtcatgatgaaacccattattttgtgtcattaatacatatgagttacaatttatataaaaatattttaaagtctgcaacttgaaaaatgttacaaattatttccccttttataacatgagattttgaactttatactatttatcttggtaaaacaattaaaccataattattacaaaatatttttatatctttgaacatgtaaatatttaagtaatatcatctgttgagaacggaaactgcttgttataaagaacttcactctctagaaagttataaatcatagcctatattataaatcatagaaaccaatcacattcaaaggcaccctcttaatgctcctgtagaaacactagaaatccactttcaacagccaggtaacatgtccctggaaagcagtcttacttgattatctgaatttaaatgttttctgttcatgaagaaatatgtcattccaaatattactctgaacactgaatgactgcaggatttattttcacaatagttttcctgtgagtgttggaaattttacatctcatcgttttgattttggtagtaaactctgtttattatttattattatttttacttattcactttgcatcttgctcactgctccctcctggtcaccacctcccacaacccttcacccaacacctcctctcctctgtgtaccctcccccaggtatcccctcaaccctggtacctcaagtctaggcacattctctcccactggggccagacaacaaatcccacatatgggaaacagcttttgggatagctcctgttccagtttaggacccacatgaagaccaagctgcacatctactaaatatgtgaggggacctaggtccagctcatatatgttttttggttggtggttcagtctctaagagccccaagggtccaggttagttggctctgttggtcttcctgtgaagttcctattgacttcagggcctgcaatcctttctcttattctttcataagagtccctgagctccatccagtgtttggctgtggctgtctacatctttctgcattagctgctgggtggagcctctcaggacaacgtgcttctatctgcaagcataacagagcatcattaatagtgtcagggattgttgcttgcacatgagatgggttttaagttgggctaattattggttagccattccctcagtctctgctccatcccctgtgcctgcatttcttgcacacaggatacattttgggtcaaaagttttgtgattggattggtgtctctatcattccactggggttcctgtctagctacagagggtggcctcttgaggtttcctatccccaatactgtgagtcacagctaaggtgaccctcactgattcttgggtaccttccttaccccaggtctctgtctagttctggatgtgttctctacctcctcacccctaccagttgcagatttccattcattctgatggccatctctcctgtccctccccatacctgattctgaccccatcccctccccacccagccccctcactccatctatctcttatgactattttattcctccttctaagtgaaatccaagcatccttgtgtctgtagagtgccgtatggttatcctgtattttatggctgatatccacttataagtgaatacataccatgcatgaccttttgagactggcttacctcactcagaattatgttctcaagttccaaacatttgcctaagattccatcttacacccatcagaatggctaagattaaaaacccaagagacagtacatgctggcaaggatgtggaaaagaggaacattcctccattgatggtgagagtaaaaactcttacagccattctggaaatcaatttgacactttctcagaaaactgggaatagttatacctcaagacccagatataccactcctgggcatatacccaaaaggcattctaccgtcccataaagacacctgctcaactctgttcatagcaactttattcataatagccagaaactgggaaccacctagatatccttcaactgaagaatggataaagaaaatgtggtacatctatactattcagcagttaaaaacaaagacatggattttgtaggcaaatggatggaacttgaaaaataccatcctgttgacatattttaagacttcattttagcctggtgtgatggtatatgcctttaatcccagcacttaggaggcaaaggtagtcaaatctctgtgagttaaaggccagccttgtctcctgtaagtaaggagagtctgtcaccctnnnnnnnnnnnnnnnnnnnntaaggaaggtacccaagaatcagtgagggtcaccttagctgtgactcacagtattggggataggaaacctcaagaggccaccctctgtagctagacaggaaccccagtggaatgatagagacaccaatccaatcacaaaacttttgacccaaaatgtatcctgtgtgcaagaaatgtaggcctccccccctccctcacccccctctctctctcttctctctctctctctctctctctctctctctcacacacacacacacacacacacacaactgggattgaacagttggtttttttctctcttaatccaaagaatgtccatatttagaaaaattttgattgtctacatttatagattgtgctagtgtctgattattagtcccctttctttcatagtgtatataacttaccatttccttatatcttctataatgaactgcaggggcttcataaaaccagactcttggtcttcctacttatactacagtcctaagtcacagcatgtttcttggcttctgattcagagcttgatctgttttccttgtatctttgctcaggatttctgattccatcctaaacagtttgagggatcttttcgttgttactgttttggtaatgtaatgtcataaaacctttacttgctatttccaatttctcttcgaatgtgattatcagatatacgtccatggtaacttttatacccatatgacagcaacatggagaatgcagtagaaggcaacaaacccctgggccgtaggtctcttgtcaggagctaccaagttgtgcttggaccactgcaacttggttactaatcttttctttggccccaaagtggcgatattaatataacccattctcaaagataatatcagggtacgataatgaagtcactgatgcagagagcatctatacgctgctagcacaccaggttagagctggcatcaattaattttcaggtcaggtgaaataactaaaaggaaaatacttaaagattcttaaggcatagtatatttctgcctacctggtctctttgttgtccctgctgttttgagcgtgtctgtacttttgaacatggcatcagtgagagcactcatgactcaaccattgcaccatcctagacaaacatcagttggatgtgtgccaggatacgtgataaaatacagttcccctgcttcttcattttctttgctatgaaactctgctgaagttcagcccatagcactatattttatttgacttcatagtgaacattgaagacatttgccctatttattgtaaactaaataattctatattcttcaacaatttggttttgtctttcctaacaattctactttttgaatattcaagaatatttaatagcatgttagtattgaataatgccatcataatttcaactctttggttagaaatatacagtacagggtacatactctattagaacagtctgcagttggaagacttactcttttttaaaagagataagatttgtggtatttgtgagtcttgtatatagatgtctcttaaaaagactagtggtgaatagttatttttatattattattgacattcatgttaaaaagtactcagtgtaaagctttgcaagttaaagaacatttctaattattgagttaacagagtcagccaagtcttaggtaaagcaaagttgagaataagtcagtttacttcctttagcattgcagcatccccttgctcattgaagatgtaacttgcttaatacatcctgagtctttcccttcacccaggagtacaacttgaacttcctatgtcatgggcctccactgttgctgcttgtattttcatagaaaaagctcttgagtttcctggctgcacaggggggtatggatgggtgagtgacaaaaggagaacttccggttttgcaacagagactgaagaaaaagaaacactcatctgggagaatagaaaacatgtagggaaaaggaaacttccctcaaactatcacttctatgtttagacataaaaacagtattcatcaaataataatagtgtgttgctttttagagaaaccttcagagactgcaactaagaccttggaaattgcaaggcagtgacacaattgaaaatcttaatagaacaagtgaaacagaaaaataagatgacccagaaataaaacaaataggaaagaatataggaaaataagaccagtctgagaattcaaaaaagaaaatgaaaaaaaaagacttaaaacaatagaaggaaggaagtcataaaaacgagggtagaaaggataatgaggagattttctgcttatttattttgaatttttaaaattaagtgaagtccaatatggtggtgacatgcctttaatctcagttcttgggaggcaggcaggtgcaacataatggtacactgtctcagataaataaataccacaaacaagacaaaaggctactactaataaaggatattatgaaccaaaacatttttacataagaatatttaagaagcttggagttttgggattcctagctagagcaagaaacagcacattaccaatacactggagggttctagagtgactataagacatcatcacactctgctctttctctataaaaataaccactaccctgacaaatatgacaaatatacccacactatttacatacttaaacctttgtccctggatttcatataaatagttgtatgtgaatcttatggatgcaatgtcattttttgttttctttgtcttaacactgcatactatggtggttgatcctgcaaggatagaactttatcctcagaggtagaacatgtagatgcttagatatctattccacaattgtgagctttgcctagtttccagtttttgagtctacagtgaaaaatgctgctgccagcatccttaaatgttttgtgatacatggctacttgtccattgatggaggtgctgaataaccagacttaacaagataatgtcagactgtcttccaaactgaatggacttcttaacttgcttcctcctcattgtttcttttctaccaaggttctaggtatacaagagacattcagtgtggattaagtttgagacttcataattacaagtgaagttgaataactttttccctcttgtttattagctatttagagtccctgtgttataagtttatatatgtgttgtgttgtttgcttgggtttgtttgggataggagaaaaagtgtccatttttcaagtgagtcttctattcttttatttgaaatccacatttgacttaacctaaagatatttctatgtggttggagtgctttctttcccttagacacagcttacttatttttgtctgctcacaggtcccttttagggtaaatatattttactgaacgtttgaatttttcaggtaagacttggaccttttttcaaaaagagttgtaacccagcctaccatttctctaaatagaagcctgtaaatgttctagctaaactcttgatcaacctttctgattttgataattaggtttcctcctagatattcctgctatttaaaaacattccagaagtctgttttgtagactattgcttatatcttctcatctttgaaatcgtaaacctcaaaaaattaaaaataaatggcatagcttttccaagaacctaggaaaatgagaataaagttaacacagggtgtcaattttagttagagcaatatctagctggtcattttattttaaagaatcgtgcacttcaataataatatagctagcaaatactagtatcatgtgctcaatattggtactgagagctctaagcattagatattcatcattagatttaaaatattttaaaatttaagatgaaactttatagacatatccttaaaggattaaattctaaataatctaattctttacaagagaaggcaagcaccacaaaataaaaacaaggcaatttttatcaactaaacattcaacagactcttgtgagaagcaaatgtgtgcaagggcctatatatgctcatgcattgcctactttactgggatcacgtgataggcagcttaataatacatggctggtatatatatatatatatatgtatatatatatatatatatatatatacacacacacacacatacacatatatagcagaatgatattgaataagttcaaggtgtacataccactgaactacataaaagaccatgtataaaagaaacaagaaaaaacaccattatggtacatatagaaaataccattatggtacatatagaaaatccttagctgattcattggatatccttaccttcctagaagtttatcttaagcaaattaaaattaaagtatgaccagtagctggagaatgattaaactgtgtctgaatcccttaacatcatgtgacctgagagtgggatgcttgtcttcagcattgatgaggccctgagttttactcccagcaacacaggaaccacagatggttactctgtaaccctagcatgtgggaggtagaggctgaacgaccaaaagtttgatccttggctccctagggaattcaatgccagcttgggttagacaccctgaaaaaaataagattatctatagatagaagttttctcaatttgttaactaagcaaataaacagtgcccccccaaaaaaaagtgaggtacacagcaattgcctctggttttacatgaaacaagtacatgggaacttgtgggaagaaggaaatgatgtgtataaggaggtctgctggtgaacagagatagccttattttctaaatgtttaaactataattctaattcagcttaggtcatttcattatttctcactgtatatttctaagtggatctgaagcaatattcttggagtagattttggattgggtacaaagaaacaaggaaaaaggtttcaggccttctgtattcagtaatgaggacaatagtcatgtagaatttattccatatttttcttcctaactggatgaagaaatgcaattgctttagcatgtacagttctatagtatatgatactgttcattattagcaagaagaaaagcaaatagtctcctattcaagatgtaatcctgtagcccacaaagacagttacccagctgactccagcttcccactgtagtggctatggagcccctgcttcctcgcctgagagcttcctcaaggtactgctgttccccattccttttggcttcagagtttgggtccatttcagcaattacagtgactttttcttccactgggttccattcttgagccctctgaggaaagccaacatttcaagtaaggatgatcctcaccggggttcctgccctcttccctgttcatagaactggcaggttccttcccaatgctaattaaggagggacctttcctaaccaccccactgtaagcataaaatagtttcatttcatgactctcagaactctcagttgtaaaggttcagatgttgcaatataaataaagtccatgattctgcaaccaagattggcctcaagttcagttcaatcaccatctcagccttccaaatactgctgttacagccatatgccaccaactctgattgtgtctgtgattcttattgtaacagactgttgcaaaaatggtcttggtaaagcctagctcttgcaggaatgttcacctaacagttcccagtccacttggtaatgttttcatgttctcaacagttgccagttttcaatattaaagatatgctggagaatcacttaccaacaataagacatttagtgtcaggctactaaggatttaagctctaaattaatggcttgtccttcatacaccaacttatgatccgggctttagcaagtggttttgtatcctgtcttaaactacggatgacatttttgaaacagccattgttttttggtggttcttccataacctccacccccaagaaaacctctgaaatgttttcttttcaccttattatagcataatgtagtactttacacatgaacacattttatgtacaattgcagagaaacaactacgtagtttgacaagaaaaaaaaaaaggctgtaattcaaaagttcactgagttattttgataaactcaaaaatactttctctgtagaaaacagtaaaaatgataaaaatttcccagtaatttaagccaaagtgaagctgaattatacatagattgttttaacttaagaatcccaaagaaacctgaccttcattgttcaaagagccatgttttacttaagtggtataaagtgcacacagcatgtcgtttcattagcttgctacagcattaatgcccaagtagtgaattggtttttgttattaaagcatattatttctaatttcacattgtgacattaagtgatgatttaatttaaagtttcagttttaaacattgctttggatttttttaaaatagtaaaacatactttcagaaagtcccaggtttgggagcttctgttgacaaaaatgttctctctgcagtgtagtgtccagtaactttgtttcctgtgtacagaaccaaccactcacatgagaacacaatctgagaaggcattctcatggctaatatttacatccttgcacttttcagtgtaaggatttttaaaatattttaatacttcgatgaagtaaaactttgagctttatttgtgtcagacagtatagtattgcacttacattttaaaattagagtattttgcctgcctgtatgtatgtaagtatactgtgtgcatacttggtgccatgcaggtcagaagagggtgtcagatcacactagaactggagttacagttggttgtaagccaccatgtgtgtgaaaggaactgaacctgggtcctctgcaagagcattcagtggtcttaatccctgagtcaactctccagtccctgggtctcctcttaaatatttaaaatagcttagagaggggaagacaaagttaaaagcaagtgctgttactgttacttggctgtaaatgctcatcacagttaaagctgccagacagcacatttccattgcattaccaggcacagtgccttctcagaaaagcttctgtgcccctggaacttttacattcagaaaaacgtctctaaaacaaaaagcacacacctatttttaagtttttcatcttcctatgttgtttctaaaatggtagtaaattcctttttagaagaaacacaagttactgtttgaactatagtaatctacactttatttactctgaaacaaaaacaaaacttgttttctattttgaaatttacaaaagtaaaactacatggtagcttatattgcttatcttctgaattgagaatatatgtgggtaaatcagagttcatgtgtatagcacacaacatgtatgtgctgcaatattagcctctgtaaattttgatatttacataccttaccacaaggactttattttagagcctgaaacaatttccttgtctgtcatttcaccttggttgttgtgcagtagatttctaccctacagttattactgcattatacatattctacaacaccatagctagccaaaagtgcatacatattccatattactctgctatagttagccaaaggtttgtcattggtatgtgctaaaagcgaaacagcaatcaacttgaaatcttgaattcaaattcagatattccctcctactagtgattgatgtgtagaacattctgggactggtgatctttaaaaacatccctgtgtcttagttgtcacactataaatgtgatatcttctctcaggttgcttcatggatcacagaatctgtctatcaagtacatagcacaaaatgtttaaataaatgctatccgtttccttctaattgagttgactatataaattatactttgatgccctttaaactgaataatgagaattacttggttgaacatcaggtaacaagttaacatgctcatactgtttctctaatagtaggtgtgtcttctatttacagatctgacagtgggaatagatacttccccctccagctcaggctggataatatatactaccttcattttacttaaattaactatttagtatctgttctacttttaaaaatgacttctctatagctgtttattttatttacgaatggactctgaaattcaaactccagcatccacccagtacatgagtccaacatagagtatacttcaaggctcccctgagatcaagaatggtgttgagcgcataagacatgtctctgcttctgagcctttgatgtgtagtctccatgattatagtgttttaatgactcacatgagttttaaaataaaaatgtgaaagcaagtgtaccagattaattcaatataataaggatctaaagaaaatgtaaataccatgagatgcttttgtatcattaagttacaaatattaaatatttaaaaagtaatttgttcctctctctccttgtgttcatggctggcctctacttctctattctctctctccctctctctgcctctactacctcttgactccctatcccatgccctgaataaactctattctatactatttttaaaaaagtaatttcttctctattcacagataggggaggatgtattagaactgaattttcatatttactacagtatatctctctggtgcccatataatcttaaaaacttcatgaaccttaaaggctactaccctccagacccctactaggcaaatgtcaggcatagctgaattcagatccaggtagtgttttatgatacaactttgatttttaaaaaatagcttaatctctttattcttgatctataaattaaacttagaattatttatgtaagttcctagttttgaggcttggcatatagaattacagtctgtaacttgtaacatggttattactgtgatgggacattttgtttataacctatcaaaaacatcttttcagctgggcagtggtggcacacgcctttaatcccagcacttgggaggcagaggcagacggatttctgagttcaaggccagcctggtctacagagtgagttccaggacagccagggatacacagagaaaccctgtcttggaaacaaaaacaaaacaaaacaacatcttttcagccttttagtagcttttccatccttctagaggctccttctttacttctcgatctagtagtgggaataatgtgtctctcctctttatcaaatatgtctattgtttctataaatatccaagggaggagtcagaagactcattggcacaacagaaactagcagctcgtgctaacatgagaattaaactttagcctttgatgaggtaaagaaaatggtctcaaacaaaactgaagcctgttctgagggattttccttcatttgtgtgaaatatagatacactgctctgttgctttctgttcttagagatacctctggaaatttgaagctatgctaattgtgcagcccgagatatacattagtttgtggactatttgaaaatttaacacagttataaaataattctttgcctttaaaatgatagaactaagctcaaggagttccctacttttactttgtgttactgagacgtaaagtaaaaagcattgcttctcaatttcaagatcgtgattttgtcaccgtgtagtggcagtactgggtcaaaggttaatctaatataagaaagaccacactggtgtgtaggaagcaagaaggcatgattgaactttactaattaattgtctaacttaggcaaagccagtgtctacacctgtaatgttagtccttttaataaagaatgctgtgtagtacttagcttcaagcttacagagtttcagctctgtattggatataatcttataaacacctatcatattaggtgcttcaaattctctcccaggtcagataggatattttatttagtatatttatgcatttttatttttattagaaccacatataagaggcccatcatgtgaagaggggcgcaagccatggccctgggcctcttcaaaggagttactagtaggaagaatacacacatatctaaaggcaccaaggccactgtgtaaaatattacacagtgattgagtcccaaaatcttatggttcagaaatgccacagtagatgcatcatgataggggaacaggtcttagcaaagactcccaggaaaaacatagtgcatactaggcacttcgtaaatatttatacaacacaggttctctgaaatgacacaccaaatggtttatgtttgtagaaagacacatgattggaaaaacgaaaggggccagactgtgagccatattgtgctcatactgtacacattggaaaagcccctagacttttaattaggacaggactgactgtcgacagtgatgggattggttggaatggaaagagaaaaagctaaggatgggacaacttaggataaatcactgcagtggtgaaagatgaacatatttaaggtggtcacagagaggacaagaaagagaaaattggcatcgtgtataaggataaaaaatagaacttgggctatgtctccaaaacaaacaaacaaaatagtaataggtaagatatgagaaatgaccaacatggcaaaatctcttttacatgtaggctaccaagcacagtaaatgattcagatctctctttaagggtgtgatggtgtataccaatgtgatggtgtatacctctattcctatcatccaggaggattctggagtaggattcaaagttccactgtcgcagctaacaagtgttagttgcaggatgataactttattcttggtatgattttgcaggttcatgtggactgaaccaagtcaccatcctatttcgagttgaagtgcacttcaaagatgtgagagagtagtaactgaccattgcctccctcatagccttgccttctgtgaagatggcacgcttatgattctatatgacaccttctacagttcagatactagcaaatcagttatcctgtgtgttcttaatagtgaagaagcatcaaatgtagtaaaggcacatcttcattctagaaatagccatgtaataaaaactttgattcattgtccttaccagtcttccttcatcttataccattgcttctccttaaaacttgtgcttcttaacaaacactcaagctaacagaaccaagaacacagcatgagaaagagagtgcatggaatttacaagatttataatattttctcctctataaaagatgacacagttgttaagaggtaaatttcttagcataagattcaggctcaggattgactgttcatgagaaagaaatacattgtttcttcctgtgaagtagattagactttaggtgaccaatttattctcaaatataaatatataggaccccaaagccatttacaggtcagagtttactctttcttgctgaaacccacttagaaaaggcggcctgcttagttggagcatatgagcaaaatactttgatttttatggtcaagcaaatgatgcccagagaaccagcaggattctttatgtacacctaaaagtgaaacctttctccataaatgcaaagcagagagaataataaccagactgctttgtattgctaagatcaggtcaaatgtgtcctactgaaaccatagaacagaaatgcggtgaaagtcttccccttgagtacttctgtgttggtctgaaagctaatacatagcgtattattaaacaaatcagtaatcttttagctaaagcaaagataaacagaaagtcagaaaatatagtcacctggtgtgtgcagctgagtgtttacatttttcctaatgaacagataagaaaagtacaggttgattttaatgtgtaaaattcagcttctactgctagccctagaggggaaaattaaattactgactcaagctaattctatcgttgataaccaggcctgtaaagtctctggcttctactccattttgaacctctctttggacttgtctgaactcaaaactacagaggcaacatcaatagaacaatcatttcttttaaaaaattttattagtttgtgtgtgtgtgtgtgtgtgtgtgtgtgtgtgtgtgtgaatttcacatatgactgctacataatattatcctcctctccaactccaccatgtcagcccctgccccaattccttctctagttcacagcctctttttcttcagttattagtggtgtgtgtgtgtataagatatagcctgctgagcacattaccgctgctcagatgaatgtcttttagggatgactacttggtatttgataaccaattagagggcatgtgccatcactgacaaagactgattctctttcagcagtagcctgtagccatgtttaatctagagattaaaccctatgagatatccttcttccacattggcatgtcagctgctcttgtcattacttgggtcttatttaggcaaccataccattgagatttcatgagtataactgtcctatccatatagaagatcctatctcagagctgctcctgtcctctgtctcttataaacttcctgctctctctgaatcttagctgtagggattgtgatctagctttatcactccagaatgggcaccacacactttaaaaacgtttctagctcttgtctgattttattcattcatccatattagtttatgtgctagaaacttgggccaagtttcaaggatctcaccactgctgacacctaaactaggccattctagtaggcggctgtcttgtgcaccagagggtgtttaccacgtcttgggcctattatcccttgcaaaactagcttttcccccatttgtgaggaattaaaaacatcttcagacattaccagatgtccctaggaacaaaatttgcccctattgagaattacagtccgatagcatttgcacagaatgaggagccaatgagaataaacctcctccattagtggttgttaaaattaacccagtgatggcagctgcatttccagggtttccccatggtagttaatacttgtttctgaggtgggttctggcactgcactgaaaaattactgatttaaattcacctaaactgaaggcttaactcaatcacaacacttgggtttataaaaggttaacatctcctgtcctgaacaaaaaaaagcttcaagtttagtatacaataacatttctttttactcagttcattactatcccatgtagaaataggacagtagaggatttatagatactaaatgattaccacactcttatattatcaccacccatgttctccatgacagcagttctcacagtgtattcaaatgacccctgagaatctccaagaccatatcagaatatttttgtgatgacacttgcacttgtgaacttaacattttttttgtatttttttatttactatcacctcatttaaagggtgtcaagtccactgagcatccttgagaaagcaaaaagttgttcattaaatatcaacccacgtatctttaatatgtgacaagatagtaagagacaggagtacttgcactgttaccaattgatagtggttatcagaaatactggtgaaatacgcagttactataatataactttaatttctgccatagctttttatgaaagatatttgttattttccttggaactaatcattttgttggaccctacccctccttagtcaaatttaattaatttatttatttatttttaattttattaggtattttcttcatttacatttctagtgctatcccaaaagtcccccatgccctctcccccactctcctcccacccccactcacacttattggccctggcgttcccctgtacttaggcatataaagtttgcaagaccaatggacctctctttccactgatggccgactaggccaccttctgatacatatgcagctagagacacgagctctgggggtactggttagttcatattattgttccacctataggagtgcagatccctttagctccttgggtactttctctagctcctccattgggggccctgtgatccatccactagctgactgtgagcatccacttctgtgtttgctaggccccggcatagcctcacaagagacagctatatcagggttctttcagcaaaatcttgctagtgtatgcaatggtgtcagcgtttagaggctgattatgggatggatccctgggtatggcagtctctagatggtccatcctttcgtctcagctccaaactttgtctctgtaactccttccatgggtgttttgttcccagttctannnnnnnnnnnnnnnnnnnnatcagtgagtacatatcatgtgagttcttttgtgattgggttaccttactcaggatgatgccctccaggtccatccatttgcctagaaatttcataaattcattctttttaatagctgagtagtactccattgtgtaaagtaccacattttctgtatccattcctctgttgaggggcatctgggctctttccagcctctggctattacaaataaggctgctatgaacatagtggagcatgtgtccttcttaccggttggaacatcttcgggatatatacccaggagaggtattgtgggatcctccggtagtactatgtccaattctctgcagaactgccagactgatttccagagtggttgtacaagcttgcaatcccaccaacaatggaggagtgttcctctttccccacatcctcaccagcatctgctgggacacttcatactcatcaaaggtaaaatcttccaagaggaactctcaattctgaatatctatgctccaaatgcaagggcagccacattcattaaagaaactttagtaaagctcaaagcacacattgcagctcacacaataatagtgggagacttcaacacaccactttcatcaatggacagatcatggaaacaaaaactaaacagggacacaatgaaactaacaagttatgaaaaaaatggatctaacagatatctacaggacattttatcctaaaacaaaaggatataccttcttctcagcacctcatggtaccttctccaaaattgaccatataattggtcacaaaacaggcctcgacagatacaaaaatattgaaattgtcccatgcatcctatcagatcaccatggactaaggctgatcttcaataacaaaataaataatagaaagccaacattcacgtggaaactgaacaacactcttctcaatgataccttggtcaaggaaggaataaagaaagaaattaaggactttttggagtttaatgaaaatgaagccacaacatacccaaacttatgggacacaatgaaagcatttctaagaggaaaactcatagctctgagtgcctccaaaaagaaactagagagagcacacattagcagcttgacaacacacctaaaagctctagaacaaaaggaagcaaattcacccaagaggagtagatggcaggaaataatcaaactcaggggcgaaatcaaccaagtggaaacaagaagaactattcaaagaatcaaccatttgaggagctggtcctttgagaaaatcaacaagatagataaacccttagccagactcactagagggcacagggaaagcatcctaattaacaaaatcagaaatgaaaagggagacataacaacagatcctgaagaaatccaaaacactatcagatccttctacaaaaggctatactcaacaaaactggagaacctggatgaaatggacaagtttctagacagataccaggtaccaaagttaaatcaagatcaggttaatgatctaaacagtcctatatcccctaaagaaatagaagcagtcattaatagtctcccaaccaaaaagagcccagaaccagatgggtttagtgcagagttctatcagaccttcaaagaagacgtaccccctccttagaaatatcatagcaacaatatttgcagctttattcatctatttcttagaaaaatggtcagtatagcccaatcagttccattctgtgtgacaaaagctggtttttcccactgatgtctatggcacacagccttccgtgcagcctcccacatactgagttcttatccgctacatctagatggcttcctgaagcctgacttggactccagattcttgccttttttagttctaactctgttgccatctacatagatcacacctcagtgacctgaacataagtttccatatatcctaatttctatgtgatcatttggggtctactgtcctagatttaagacttaagatttgtttcccttaagaaaatagtgctgggcagtggtggctcacacctttaatcccagcactttgaaggcaaaggcaggcggatttctgagtttgagcccagcctggtctacagagtgagtctacagagaagccctgtcttgaaaaaaaaaaaaagaaaagaaaaaaagaaagaaaatagtgaacttgtatgtttcaattctttgctgcaagtactagacatctaaacatgttcacaggtgacacttctcagcttcctgataaaaactagagctcatcagagcagatgattcccaaaagctataggactgtcaagtgggactgcccagaccaaaacaaatcaggattctccctggtcagccacgtgctactgtttacatgacctcaactagggatggtcgcatcttatcacaaggttgttcagaggataaatgagattcccttatggaagtgttctgaaaccatgatgtacctaaatactgtttaaaagtcaaatatatacatatattttatatatgtgaatattatgtttaaaacaggcaaacgaaacaatatagaattgaccttaaaaatctttaaacaatgtgcttattttccataaactaaatatacaagcaacttgctgatccctaaaaatagatgtcagatgagaagagattggctgaccaggaatcggcgcgtcctcagaacagaagctctggaggctttgctcccctagaacattgctactctgtgtgctcaccccaggaccatcgcacttcaatgtggaactctgccccaaagcagcagctttgccttacaagcctgcattaaccagaggctgtgcccgaccgaagcagtcatgtctggacagtctcttccattagaggttcacactttgcactcagtcctcttgcccaaacccagcaaggaatcaataccttgtgatatggaaacaagcagacagtctattgacagtgctcaaagaacaatgtgaaacctattcccagaactagatggtgggagtgctgcactattgactaagctactggataaacagacagttggcagcatgcaggaagattcatttgaggattaaatttagggtgaaccttgggtttaatgacttacttaatagcattctaacacatttttgtttgtttctgtctttcttgagacatggtttcacagggtttcccagaactggcagatcccagaccaggctcaattttatagcaatctttctgcttcagcctcctaaatgttaggattagagggataagtaacaactcccagctacagttactattttttaatttttgttcctaaagaagcaattgaaaaacattgttatttctaactagagaaagaacaatttttagttgtgaatgtattaatctttttttttttttttgcatttgaggcttagcgcttcgctaggctgaaataaaagcatgcataaaggatgaagagacaagcaacatccagtctagcttattcctaagtaccatctcttagcaaagttcatagaaagagagtgctgatgtgtgtgaactttcctatataagtgataaacaacatgatttaccatgaggagttccacacccgacgagttgatactattcatagtttttaaagtctgtttgagaggctagaacaagacgaggaattggcaatataatcagaagcaaaaggctagattatttttagcaacacatatgcttttgttccagagtcagcatgtatggcaaaagttccttaggacaattcaatattgaaaatcattatcacttaatataagatgtaatagctaatttatcaatttttcataaaccttcgttgattcaggtaaaggataaatatccattgttcttccaaattctctgaaaaattaaagactttgaataagaactttaaactaataatatatcttgcttattcccgtgctggtaagaagtttgcagaatgaaagtgagccctggtcagagcagcagactcggtttttgttgttttctcaggatattctgattgagagagagcaggacggttgtactcagaatagaaaactagagggtttccaatatacatggtaatgtttctaaactaatctttcccaagtcacaagaaactatcgtttcagctaggatcaaactctaaggtgctatgtggttttttttccctatagtagagagcatggatagaatgataatgagattaatgtaagaacttaaaaggaaaagaagattgatgtttaagggttagaaggaatttaggggtgtggtagagatatcatcctttcttggtttttatggtaattatgggtctaatccatttttttaatcttgccaatcacatacttagaaaataatgcatttttaaaaaatagtaattatatgttaaatgaaccacaacatcattctgtttagaagccagagaactaattggctcttgcactgagtattttatttactgttgtatgtatgtttcacatgcatgggaatatgcaaatatgtagagaccagagcagcacatagggcatcttctatagcgctccgcctttctgccttgagacaggcatgaatggtaacctcactgtctgtttgtgagctcttcatatccacctgactctcttcctcaatgctgggattataggcatgcacaattacggccttctttttaagaaagtggtaaagatttgaacttatatcctcatgcctgctaggcaaatgatcttaaccactgtaccatcttgtccatttaatgcatttcatatttcatacagaaaaatagtatattccaatatattgaaatcaggtattggtgcttgttagcacttaaaagacagaattcagtgtgaacatgctgacatggaatgagaagggggaagaaatatattctgacattcctttcataatcatgccaagcataaccctgtttatgcttcctatagccctggaatgagaccagatgtgagttctcctccgtccagctcctccacagcaacgggaccacctcccaaactctgcctggtgtgctccgatgaagcttcgggatgccattatggggtgctgacgtgtggaagctgtaaagtcttctttaaaagagcagtggaaggtagtgtgtgttttgaagagtttaatttttgttcctatttctcacagtaaatgtttaactgttcattgtatacaaagtccactaatgatagacattagttcaggtgcaagcatggtggctcttaaatcctccattgggaagggacagaagtaaggagaagaactagaataagtaattaagttcagcctgagaaagaactaaagcaagcattgtaaggaacgctgctgcacggactggcagtactctgagtctgggcagtccgagaatggtggcttttcattccctgtaagcaagctggcttcaaagctaccagctataccagactgacaaaatcagtgaccctggggaggaacaataagggagggacagcattctttgctttacttttttcctgttaaataaataaagaggtcatgttaagtaccacaatggctgaggccaaattaacaaagtacagagattatcagataggtgaagtctagaaatatggtgtttgaaagaagatgactgcaaggtgatcatgtgttgacgggttcacattccagagcagccggttaatattagagatagtttatataccctacccaaaagtatcttaatggaattaaaccagaaaataaagctacattgatctttcaatatactacaattcacagcccattgttcttatttaaaatgaactcattcccttatttttatgtaaaaataagtattagctatgctatttataaaatgtttaccatttagttatttcagcaaagcgtggtggctagattacattagtaaggaagcctttagctgtgtacggtgttaatgagtaagcctcttggctcagcttcctccctaacttgagtttcagtgttctcaaaggcactttccagctctaacattctgtaaacccttgatactctaattcaaggaaaaaaatttatctagacttgtaaaatccataacatagtttgtagcatttcatttttaaaattattaaattttatttgatattacatacattacatatataacataacattttaacacatactagaaattatacttaaaccctgtattggcattataaatacccaaacataaatcagagttaagttttacacatttgttatttatataagacaaatctattttttaatccaagatcctatgagttctccatgtccttatgcccagctggtcctttttacttgtattcattttacctacaagtatctataactgtattggtagaccataagtggatagttaccaatgactcttcacttgccgtgtgtgaagtacatgcatccaaaatcaattagtggccctgtgaacacttagatcctgttaggatctgtgtctgccagactagcaaacaggttcagaaagttgaagtagccaagctgggattgcaacaaagtggtctccaagtaaggtcttattctcaacaaagatcctcaaagatgcatctgacaagcccttgatacctgctagattataattcaggtagatgctgaaataaaagtaatcacaagagatttaactattagctactatatactgagtagttatggtgtgttgagcacagtatcgtctgcataattacttccaagcttggcaaattttctaacagttcataagagaacaaactccaaaaagttaatgtttccaagatcagtttcttggcatgccactataccactgctactgagaactgctatagaagcgtaagctgatagtattagtttatacttaatctccaggtactcacagtacagtctgtagcctgcatcttttacatgtgttgtttcccatttcctataccatgttgttctatgcaacattttattggtcataggatccagctttggtatgattctagaaaggattacactacaccttattaggagacagatatcactggctatcctgtaagctggctgctacaccaatcataaatagcaaggcactgtcaagtgctaaaactagatttagccaaaagcaccaacaaccaacagcattaaagaggctttggatgagctgaaggctcttcccttgacattaagaagttagaaaggaaatttatcaggtggcagaaaacaaaggaattccagatgactgtcttaaaaagacatgtaattggtagtacatggccattctcattctttgtgaaataatgaacactagctcaaatcccctgttttgttacaaggaatgaatagactagtggatcattctattatactaacctgagcctatagctaagattctcagttatactacacactggataaagaaataaatatcagcataatacacagtcaatcttttagttagacataaataaacactgaattttttctactctagaagtaatttttccccagtttttccagcaacactgatataaggattctctgaaagacaatggatgtaggggtgtttttatggggtaaaattttagtgctttaactgtggatacaatctgttgtttctccttttgctgcatgatggaagtttttaaaaagaatttatttatccttatttatatgtataaatgtttacctgtataaacactgtgtgcctggtacctgcagagctaaagggcatctggttccctagaattggagttatagacagttgtgacctgctgccatgtgggtgctaggaactgaaccaaagtcctttgcaagagcagcaagtgttcttaactactgagccatctctccaatcccatataataggattttattgagttagttcttctattttgtgtttaagaaaacaggaggcttataaaatacagaaagtatttgaaagagctagcatagatattaggcatgggaaagtaaccctgaaataaagccattatataacttaactatatagctaagtgtatatatatatatatatatatatatatatatatatatatacacacacatacatacatatgactattagtcaacttcgtaactgtatcttcacaaaagattagactaatacagttaactatgtactccaaactcatatttaaacaacatcatgattttacatatcaggaaaaactaaatgttttttttttaatccaagtcttagattgccctaataaagaaaaaagtctcttcttagaaatcaggtctatatatgttccaactggtgaactgactgttacaattctttctcatttctttgaatatgatttattctaatataagtaacacagattgttaattactggtgtatctatatagacagttaaatcttgtgtaggaagcttctataccccaccccagtcaaatagatccttcagttgttttcatcaacatttaatactcagattaaagaagacagtgcatgtgggaaacagaaacacttttagccttttcctttttaacagtcttagaattttttgccaggagagaactgaagttcataatatgttcttcagtagtggataccagaaaatggagccactagctagcattaagtcagtatttgaggccaaaggtgactccatgcatctttgtattctaaaagtatattaaataatgatctttgttagtttgtttagtttgccacatttgtgatttacctaaccagtggctagaagttggtaacattttacttcatttaaaattgggaagaacttcttttacctacacatgataatgttgagtgatgaattaaagtcatctttttccttagggattccaaaagaaaatttaagcctgcttccttttagtcacttcaacaatagatcagaattcataataaaagtaataattgcaaaccccatttataactgttaaataactatagaaagcaggttttaaagtttgatcttagagtattcttatgatttgaatacatatatatatgaaatactgtagttgggttgttttcattgattttaaattcgttaagcagaacaagtcctctcaacattgtaattcatgcagataaacagacttaacatccttagtcagtgactttgtgtcttgatgatagtctgctcaaaacaaaaacagaaaggggataggctttttcttttaaaatatccttacagatctgtggaattttaacaatgcccttttaatctcttataggacagcacaattacctttgtgctggaagaaatgattgcatcattgataaaattcgaagaaaaaactgtccagcatgccgctatcgaaaatgtcttcaagctggaatgaacctggaaggtaatggaagcttaaggaactgtctgcctgtcacatgagaactgatcctttactttataaaagctagcaagtgaaccatgtaatgaactctatatatgcttaattagcaaaatgttatattaaaatggttttttccacgatcatatcattttgtgtgttaattcaactacttttgttatatacattgaatttgggacagccatggtgtatattaagtaaagagattacataatattgaaaattacataacttggagcaattttgttttcatccttcttactccttttttaaaactcaaaaccatttcctaagattggaaaagtattgtacatgagatctagttcatattcctctcttactttgcacttcaaaaaccaccacaccttttacttgaaaacatatgttttattacaactctgccaacaacattggatgggttgttttatggtttaagtataaaggaaaagtaaaaactacttgtaagttataatttgatattcctgcttatataaaaagttatataattaacacttatttaaaaacttccctctggaaacgtcagggttttgctgtagtggaaatagcaagctctgtgaaagtagcattcttcctaactcatgttgttagtattgactgttactgtggtacatcatagcaaacgctcagcaaatataaagagaatacaaatttagtacctgagtctgagcagcttactttctgtttatgctacagtgtcaatcacaaaatagtatggcactctacaaaggcaatactattacaggaccaagacggaaggccatctgagcctgtcctgaaagtcagactcatcctggaagaagtagcactgagctgcaaatacagaccttgaggaggaattagatagccatgacagagacgtgctcatagttgtactttataaagagcagtctttgggatagacaaatggatcggtggcaggggatccaacttcacttctcagcacccttatttgctgagaactcacagctgcctctaactgggaattgaactcagcatctctagaagagcggtcagtgctcttaactgctgagccatttctccagcctgagactcaaaagtttaaggtgaacagtaaactcttggttccctgttagaggaaacaagtcctgggagggaattcctatagagaatcctggaattgggagttccatgggtaaaatcacttgctaggcacgcatgaaagacccaagttaggatcccactacccacttaaaaagccaggtctagctatgctcttgcctattaaccacagaattttgaaggataaggtggagacaggagtgtttctagggcttactggcctacctccaagtccaacgagagagcctgcctcaaaagagtgatagacttggatacccaacttcttcccctggccttgagtcatgcacagatgtgtgcatatgcacgtgtacatacaccacactcacacatgtacacacagattcacatagacatgccaaaagttttaaatagtttacttctttcaataatagtgtcagaaattaaagacctcttataacttgaaagtataggctacaaagttgatttcgtatatttttttcttttttcaatattcacagctcgaaaaacgaagaaaaaaattaaaggaattcagcaagccactgcaggagtctcacaagacacttctgaaaacgctaacaaaacaatagttcctgccgcgctgccacagcttacccctaccctggtgtcactgctggaggtgatcgagcctgaggtgttatatgcaggatatgacagctctgttccagactcagcatggagaattatgaccacgctcaacatgttaggtgggcgccaagtgattgccgcagtgaaatgggcaaaggcgataccaggtaaggcatgaaggatgagccacggcataaatctttgtgttttattgaataaatgcactctgagttgggcttggtgaataacttcgtgacatgccatctgcttatcatacacaatccttggggtcagtctgcagcaccctcggaatagagctgctctgagactctaggcggtctgtcctcctgacggagctcacggcagagctggtttcttttactcacaaggacaaaagagagatccaaagtatactggatactgttccctgactttcaggttacacatagtgtctcattttacataagatcttatattatccgaactaaaattccattcacagcgacacctggaagacagcatttagaaattccatttattttcattcagattgtttttgaagttgataaacagcaggttttgttgactttgtcaaaatttactaacacaaagttattttaatttttcattaaatgaaatggcatctactgactataaactttattctagctttaaaggtatttttaaacaagtttcatgttggaacttcgggtgcagcagaggccaaggttaagcatccgcccttactttacagatagcaaagtggttggcacgtttatggctgcatacacctaagctgccatcaccccacctttttagcaaaagaagatggatgtcaggaaattttaaaaatctaaatctgttaagaaataggaatcctaagcaaagactctcggctttctcttttactatatattctactttgtgtgcacttaaatggacaaaattggccaaaaaatagctattcataagtgtttttaaatcattaaagagggttgagtgcccaggcgttgatctggtcaatggctgtctactaaagatcacatccaaacaaggccaacttgtcaactcgagtgttccttatacctttatttcccatctaggattcagaaacttacacctggatgaccaaatgacccttctacagtactcatggatgtttctcatggcatttgccctgggttggagatcatacagacaagcaagtggaaacctgctatgctttgctcctgatctgattattaatgagtaagttacatggccttaaccctccacaaagaactatagcaactaagcagtgctgacaacaggagaaatggttttccccagagactaatacatcagttggttatccagtaccattggtcatccctagaagcatgcatacaagtaacatcatgcatactgagcaggtttcacttatgtatttaggaatatatatatgaatatacatgcatgaatgtaacagcaattcatgcacaaagtggccatcaatttgaaggagagcaaaaagaggaatgtgaaaaggtttagagagaggaaagggaagggaaggggcaaatgactttgtaatctgagaaaaatgaaagaattttaaaataaataagcagactaaaagacctgtaaaaaataactaatcccctaatgtttccataaaagtatgctgtaaagattccagaattagatagcttattgagttctgagtatataaaggattcacaattttgttgtttcaaaacagcaaaaacctagtgtcacatgtaaagggttattattgaatagtctctccatgttctccaacattctagttctataataggttattgggaatagcagtaggtatgtttgcagccatgacttcataaatttaaaaaccaacccaaaattcagctaatattttagactagcactatttctttctaactcacatctgtatttgtgtctcccaggcagagaatgactctaccctgcatgtatgaccaatgtaaacacatgctgtttatctccactgaattacaaagattgcaggtatcctatgaagagtatctctgtatgaaaaccttactgcttctctcctcaggttggtggaccacctactcacttttaactttcattctaaatatggcaaatgcatgtgaaagttgtataactatcgtgcatatatgtgtatatatatgtatgtgtgtgtgtatatatatatatatatacatatatatatatatgccaatttcattgtgttttcctagtaagatgatttttagaaaggcaaactgtaaaaagggtatatatatatattaagtgttatcaatattagtaaaataaataggtattgtagatctaggtgtgggatctgcccagggatctctggtgatgaggctccatatagagtcttccttcctgctacccattcatctatatctatataagatgtggagaaagaatgccaacagtaatgagtctgtctctctactgtacgagtgtttctagataaacagtgacagctaccatgaatggggaatagctgagaaaataatcannnnnnnnnnnnnnnnnnnnaatgtttaaactttagactttagcaagactactttatattaaaagtaaaaaagttcaaaaaattaaaggaatcttgtctatattagttaagtaataaaaggaaagtcatacctgatattctcttaaaatatacaaagatctcttcaagtcagcaattgaaacaacccagtttttaaggactgggaatatgcaaagatgacttattaaataagatagaataaagacagtaagtctgtcacattccataaggacatgtctagaatgagccaatccagagtagtgagtacaccaaatactggttgaggacacagagtacaggaattctttttcactgctgaaagaatagcaaagtggaatgaccatttcagaagacagtttggtagtttcctataaaggcgaacatagtctcaccatctggtgtagcaattgcttgatcagtatacaaaggaaatgaaaacttatgcagcatggatatttatagccaagctgtttgtatctggctcaacttaggcgcaatgagatatatcatccagtagacaaatcaataaactgacatatgcaaatgatggtattactcaacactgaaaagaaatgggctgttgtgccaataaaaaaatattattgaatcttaaatatatactattaaaaaaagtaatttcttaaaaagaatctcatcaactctaagaaacagatggaggcagatgagatgacttgtgtaaaatggaagctcaacatgcccagcaagccaactttcctcagaaattttacaggtgcttgtggtgaagataagaggaaaactctcccatttttatgtcagttagaaagggggataaactgttggaggtacatgtagtatttccaaagcaaaagcaaggcctgccctataagagaacctcatcaagaccttatctgacatggagcaaaggcaaataaaggattctagacccttataatagccctcctgacttcacagggaagaaaaggggaaaatgggtttccaggaagcatttgggtgcagtaaaagtgaaatgtaatcttaagagaaaacatttcattggagccttgcttacagttcccagagcttagcttagttcattatcgtgatggcaggcaagcatgattctggaaaagtagctgagtgctacactctgatcggcaagcagagagagaaagagagtagcactgggcctgttgtggacttttgagacctcaaagcttatcctacagtgtcacacagtaacagggccacacctactcaaataagagcacacctcccaatccttctaatcctttcatagctcccctccctggtaactaagcctatgggaccattcttattcaaaccaccacagtgcagataaccaacattaaacacagtccagagcctagccagattaccatactatcttccaccaaatgtcttaattccatcagttctgatactccttgtctagctttcaataaaaaacaaagccagcattaaatctgccccaaaccactggcattatcacattggaatttaaaataactgcaatatttttgctaaggacactacaggaaaaataaagaccacatgagaattatgaatgaagagtcatagaagctaaggaggttcctctaagggagcactagagataacagatgctgaaatgataatgcacagtgctcctagcaggcagaccatcagttgtcatataaccaagaaagagtgagcatagggcaacaaaaacctcctagactcaaataaaaagagggaaaagaataaaaaaaaggtgtagagagatcataaaaaatattttaagtaataaaagttcaaaaatttctaaaattagttatatgtaccaaaatgtggatgcaggatgctcaaggataaccaagcaaagaaaaacaataacaacaaaaaaatctatattttggcatatcctcttcaaattataaaaaaaaaaagattttttaccctgagttatggttttaaaacagcaatgacaacaaccagacttcttatcagaaatcatgcaagtaagaatgtgaagtaaatagttagaaatgaaagcaaacaacccaccagtcctgagacaatagatccaacagaattacctctcagaagtgaggaagatggtgccatgcacagtagtagacacctagaattctagcactccagagactaaggactgaaattcaagccagccatggctacctatcaagactgtctcaagaaataaagtaatgggtaaaataaaaacattctcaaacaaatgtgtctttttaaagggattttgtggtcatctttacatctgtcctacatgagctattttaaaaattgttcagaagagaggaaaatatgtcagaattatgtgctgcataagaaagagattatagctgggcagtggtggcgcacgcctttaatcccggcacttgggaggcagaggcaggtggatttctgagttcgagaccagcctggtctacagagttccaggacagccagggctacacagagaaaccctgtctcggaaaaagaaagaaagaaaaggaaggaaagaaggaagggagggagggagggagggattttaatagaaaagggatgcctgagagtaaaatgtcaattttcttcttaatgttacataactgttatagtgataataatcaggtatcaggggatctggagaggtggctcagcagttcccagcacccacataaccactcagaactgtctaactcaggtcccagtgatccattgcctacttctaacttctggggtacatacttgtggtgtacaaacatacatcaggcaaaacactcatgcacacagatacacacacacacacacacacacacacacacacttttatttatcttacaaattaacaatcgcagactatgtgattgaaatacaggcatatgtacaatgaatgacagaggtattgtagttaagttaggagggaaatttcagatacactctggcattgactttgcctgttagagtagttctagtgtatttcggaagggagaacaggttagttgtaaatgtgtactgcagatgacagagcagtcactaagagttcaaactgtcaaagggaacacgcaatcatgagcatgtctgggacactgaaggctgatgggagtctccagagtctagtggttgaaagtgtgcaccacaggcagggtccccagcttccccaaacctgatgtgcttggtcagaacagaagcacctctcggggccaagctaagggggaagctccttcccctcctcggggcaaagttggaaaaactgctaagtgtgagcaaaggcaatccccagaaacaaaaaagcaaaatggattcttggtgcaaaactagtagcaagagcacaggtctgcttcagtgagctccttggggctgtttctaaaatgtgttcatgggaggcacatctgctaaggaatgaaaaactgaagacaacaagaaagaggaatggaaaccagcatttcctcctagggagattaagttcagtataatggagaaagaaggaaggagaagaaagcctggaaggagaatgacagacttaattccctggtgacactgcagacgctggggagatgtgcggcagcaatgatacaatctagggaaagcctgctgaacggaaggagaaggacagcgagagttgtgcccacagcgataagggagacaggttcagtaaaaaggacagctgtgaagctttcaaatcagaggaagatgattaataatgaagtggatctccttcagtgtgttcttgtcaatgaagtatttaaacaactcccttcaaagaaaaagactgaaatcaaaggctctatagaagtgcttctaaactctctagccgtttgctttgtaatagttaacacacagcacagacaccctttcctggaggtactgacctcacctggtacagtatgaaggttgtaaaatggaagattgtttaaagcgggttctcactggtacacatcacaaattagctatacacaggatgacacggtttgcatcctcgggtgtcgtcaccgctcccgttataagatgggagacatttggatctcccatggttatgaaccccaattctcagttagcctatactttcacttagctatagtcccaccatcctttgagaatgcatgaattttagagtgtattgaatgtacattgtaacgatgaaatacgcatgaaatgtgctacttagtacaagacaagttaaaaaaaggaaaatttaactgacttcatcttaccttttagttcctaaggaaggtctgaagagccaagagttatttgatgagattcgaatgacttatatcaaagagctaggaaaagccattgtcaaaagggaaggaaactccagtcagaattggcagcggttttatcaactgacaaaacttttggactccatgcatgatgtaagtaccaaacataaatccaaaacaacagcaaaaaagaaaaagtaggttggggtggtggcagatgcctttaatcacagcagacacagaggtagagcaagtagatgtctatgagtctgaggctgctctacatagggaatgccaggacagtcagagatacgtaagagatcctatctcaaaagcccaaagacagagacagagagagacagagacagaagaacattgtaggtcctaggttatggtttaattagtgtatgtgtatagttatataccaatcagtcattatagtgattattcaagataaataattttttacacatttctcttaagtcttactagtctggtcatttgcgtaaagatgactctgttagtacagagttcagtagctcctgattttaagtatccctgaagtacatgaatgagctatcagattacactagtttcacctccctgtgtatcagtactggtgcagtctcctttgagcctgctgcctcgtctcctgactgctgggatcacaggcatgccaggcttcattctgcacacagtttaagatgccttttgttcttatgtgcttattttatttaaattattttcttatctgaggaattccaacaaagattggtatatttgtgatcaaattgttaaaatggccagtagggcaggaatgcaggatctatataccaggtcttctgtgtgtatattacgactttcagtttagtgtgtctgggattctggagtgtgggaaccagtaggtccctgactcttgttcctgttcttgggttctcctttttctctttgtcttttccaacaatatgatggtttttattttattttgctatgttttattttattatcacctcttagaagcacaatctttttaataagaggagaagttgagaggaactgggagggtaagccacaatcaagatacattacatgagaaaagaatttattttcagtaaacaaaaaaatatgtcaagacttggtgtggggagccaagagatatgagccattcgcagttatgctttgaagcctcaccattaccgtatcttctcttgcaggtggttgaaaatctccttagctactgcttccaaacatttttggataagtccatgagtattgaattcccagagatgttagctgaaatcatcactaatcagataccaaaatactcaaatggaaatatcaaaaagcttctgtttcatcagaaatgactgccttactaagaaaggctgccttaaagaaagttgaatttatagcttttactgtacaaacttatcaacttgtcttgtagatgttttgtcgttctttttgtttgtcttgtttgttttctatacgcactacatgtggtctctagagggccaagacttggcaacagaagcagatgagccatcacttttcagtgacaggaaagcagacagtgatgtgcattggctggtgtatcacagaaactagaacagttagtggagacatgtccactatcagagaaggaccgcacctgaaccaccagtgcccaaagtccatgtgatcaactttctgctcaactttcagttggctggataacactttctagacttttctgttggtgtatttttcccatgtatagttaggatagcattttgatttatgcatggaaacctgaaaaaagtttacacgtgtatatcagaaaagggaagttgtgccttttatagctattactgtctggttttaacaatttcctttatattcagtgaactatgcttgctcgtttttcttaaataatttttgtattccagttattgtatagctgtttaagatgggcagctgcctcacagctctcctagacgctaacattaatttccgtgtgaaaatgggtcggtgctcctaccctgatggcactcagctatcagaagaccacagaaattgactcagatctccagtattcttgtcaaaagctcttactctgtatatatctgcttccatggggaattatataggttgtgcagattaaccgtcctaactggtatagagcacctagtccagtgacctgctgggtaaactgtggatgatggttacaaaagactaattgtaaaacagtgcccaccaacaggccccgtttgcacccaatgcaccatctcttcagtggtgcgatagcaacaaagtttgtaactcagctctttcaggaccttcgggagtagtttgtgtaacattttaaaatgtattattccagataaccagctgtgataaagccgagagattgttttaatcagaccaagtaacttctctcattaaacgttaccctcaactaagtctctaatatggcaagaatggctagacacccattttcacatcccacctgtcaccaattggtctagctttcctggtggtacaggaaaatcagctactgattttttgttatttagaactgaatgtcaggcatccatgtttgtccaactatacatccctacatgtgccatagaatctaacacaagtcttgtgaacttcttcacactgagagttatcattttaaacaaaacagaagctgtagtagccctttctgtgtgcaccttaccaactttctgtgactcaaagcttaacacacttactaagccacaagaaatctgatttctacttaaggtggccaaattatttgtgtaatagaaaactgaaaatctaatattaaaaatatgaaacttctaatatatttttatatttagttctagtttcagatatatatcatattggtattcactaatctgggaagggaagggctactgcagctgtacatgcaatttattaacatgattgtaaaatagctgtatagtgtaaaataagaatgatttttagatgagattgttttatcatgacatgttatatattttttgtaggggtcaaagaaatgttgatggatatcctataagatttatagtatataagagcatccatacaggcctcagtggtcttggaaattaaaacaggtttgctctaagctagggagagggagctgggactggccctgtgtgcagtgcaggtcctgagggtttgacccgatcagatcacaggggaactaattccctcccatctaaccatcctcatccgaccatggccctgtcagtgcaggctggctttattaaatccaggacagaaaggtggcgcttatgtacttagaggcaccgtccagtaacagggttgttcccacatgcagcctccgcacgggttaacagaaacagaggctttagaagtttggcaataatgtgcatagaggttccagcaatatgtaaatactaaagaatcgcataggaagccaataatacactaatcctctccatcctacaagagtccatttccaagtaagatgaggacatgtttatgttttctttgaatgctttttgaatgttgttattttcagtattttgcagaaattatttaataaaaaaaagtataatcatttgctttttgaattctctctaaaagggaatgttcagtttgtaatggtttaaattggtctcaaagtactttaaaataattgtaacccagctggatgtgaaatttatggtgcctaagaaataccacttgaagattatcaatgacagtgttaagtttcaaaatgagcttctcaaaaatagattattgtacatttatggaatgttatatggttaaacccaaaaagcacatcacacataaatctgctttcagttccaaccagcttggctttcaaaaatagagctccaaaaaaaaaaaaaggaaaaaaaagatatatatgctttgttattaacagaaggcagcagacattcataaaactactatcggaagttttccattagatgtataaagagctatcctttggtatgtgggaaagaagaaagctgtcataattctgattgagtataagtgagagagatacggtactgtttgagagcagctccttttctgcgtgtggcttcataccgttccaaactatgtagattttataatagcttcagtgagaattggtaacatgcctgtatgactcacaacagatcttgaaaactatctttaattactggtaggacaaaaagggacattctggttattttaggcactggcttggaacactgtatatgcagaagaaagaagacaggcaatctggggaaaggaaggggacctgggaagcactgccttctttaaggaaagacacaccaatagatgagatcatcccaaaggcacagggaccacagagtgtgagtccttagtgacgagtcaggtgagctctggtgagcttggagaagccagccccaccagcagagcaggcacggcagggatgggacaagcagggacgacaattccagctggacactggtcccagtattttgctccctcttatataccgtgaggcagtatcaccgtgggatgaaccatggtagcacgttttgatctgtcagcactcaaggatcatggtagccttcgggagctttaggttttggttggtcaccccaacgatcagctgtagttgaatgtgtttcttatgtgcctggtttcagtgttagaaggtgaaatagagtgtgcaaaggacactgcaaaccacttcggatggaagttttctcattttccagactattttcggtcagcctggtctatcaagatcggtaaccaggtcttcaggaaagggttggcttctatctaggacatgcctgaaaggattttattttctgataaatggctgtatgaaaataccctcctaaataccctgcttaactacatatagatttcagtgtgtcaatattctattttgtatattaaacaaatgctatataatggggacaaatctatattatactgtgtatggcattattaagaagctttttcattattttttatcacagtaatttttaaatgtgtaaaaattaaaaaccagtgactcctgtttaaaaataaaagttgtagttttttattcatgctgaataacctgtagtttaaaaacctgtctttctactacacagtgagatgtcagactgtaaagttttgtgtggaaatgtttaacttttatttttcatttcaatttgctgttctggtattaccaaaccacacatttgtaatgaattggcagtaaatgttagtcagccatttacagcaatgccaaatatggataaacatcataataaaagtatctgctttttcattatgtgactcccaacatgttttcatagaacttgtgcagttacaaccattcttgggttttgttttgtttttttttctcttcattccactcacagcaaagttgccacttgaaggaacgtaagatgctgaggtgggcatgtcagtgccggtttggccgctagtgtgtgcggagagatgacacttattcaaaagcgtaccctgatgccgacagctctaaaggtcttctcacctatctgcagaggtcacatggttatgactccccaggggaatctggggaacacacagaagcacaggagaaactgatgcctgtaactgcttcaaagatgccattcttggtaaacaaatgttatctcatagcacaattaatctcttagtttaaaatccaccgtgctcttagaaatacacataagtaaacacagcaaatgtctaacacagaagataaaggcgtggtggagtcaccatttatctttacactttactcggtagcttctaaaacattatgttttctatatctcccacagtatagcactatcgcttatgaaaaaagccattctaatttaaagagtaaaattgccttatctcatacactccatctactggctgcatgcctactatataaatataaggaaatgacaacacttagatacttaagaccatgagattgggatgtccggaaccacctttctcagtgtcttaaagtacaacagatgcaccagatacggctcagtggtctacagtttgcatttgcatatgcatctacagagcccagaagagaatagtgtcttcctcttattgctctctgccatattctcttgagacaaggtctctcagtagttcagctagaccaactagctagtgagcgcccaggatcttcccgtctgccctgcagtgctgggcttacaggcagctgtagccatgtccagtttgtggactctgggtattcaaattcagatgcccacgcttgccgagcaagagttcttactgagccacacagttcacccgtacctattcttgttgtactatttactctcaagtataaacctggttttgtaaagttcctttgcacacgctatactagttagtcttcactcaatgaataaagtgaagacattgatgctagtaactcaattagtaaaactgcactggaaacctgtgtgaggaagccatttggttaccaagtctcagatagcaagtctcaggcagcgtctcagacaacatattttctgcttttctctactgcttcactgagcacttactatgtctcagacaccatgtttttttttaacatattatttaatctttgcagccctttaaagcaatattcttattctcatacatatgaggacagaatagtttgaaaaaaaaatgggtagtcttccaagacttaacaaagcttgggaatggctaagtaaaacgtgacgacagtgggcatctggctcaggggttcgcgttcttaagcacttccggggagagagggatgtgaagcttctaaatgcagcagctgagccttgtgtccctgtcctccgacatgagctcaatcccatttgctactgcatccattttttaaattctttattttgagattgtagttgtgtcattctcccttccctctcctccctcaagcccttctttcttttcttcaaactcatggcctttttctcattagcattgttgtgtgtgtgtgtgtgtgtgtgtgttggagcagatgccatctttcttagatatataagcataacctactcaatcatacgaatgacctgtatgtatgtttggacccctagaggatgagggtgaaaaactaactccagagagattacagaaaactctttggtttttcaaatatacaaggaatctgcgtgtcacttaacagcgctcacagcaaatcaactaacctccaggcagaagaagataaagagcttacagttacactgaggaggaggaaagatgttagcaagtgaaagctctgattcaagccaaatctgaccccactgtaacaacaacaacttctagctaaaccttggatataaaaaacaaaatcaaaaacacttgaaaggctgaaaatgcagcactagctgaatagtttgtagactttgttcatcttgagagtggctcccaacagcttttatagaatcttctattaagactcttgtaaattaattcatttgttttttaaaagtctcttgcctgcaggctgcatcaagctccctgtttcttggttaaaatgagatagtgcagggctaaagggaacactttactctgttcgtttctagaactgaagaaactgagcagttcatctagaccctagcagatgcctagaggccccggccaccggaataagggggattcgcagtctgttcatcccatgtgccctcctcagtgagctctaggcaatgaggcagtcccggcagctttgaaatggcagtgtcagaaatggaaccatgcacaactaactacaaagggaatcaaagattcaagttttaaggcaatatgtctccttcccttcgtttattgggaaatggttctctttctcactttctttgattcctccttagctttctgtgtgttcataacaaatatacacactccataagtgacaggaacagtgacagaagatgaaagcacacagccactagtgctaccactatgtcctgctgtctggcatttatcaccctagatatgattcttatattacatcatgtttggggagaggtggctgggcacatgccaccgtgcacttgtggaggtctggaggacagtttgtgggagttgattctctgcttccaccatgtaggtcccagagatcaaactcaggttgtccagcttggcagcaagtcaatttacctgttgagccatcatactggccctcatttttgcttttaatttgtttctgttgctcagtctgtcccagacacctgcacctagatgtaagtacaaaagacctacagctcggggcttgaacagtgtccgggcatacacattcacagcagcgttgctaacaagagccagggtccataaggctttgcttagtaagtactctcaagataccatggggttctgatggaaatatgaatgtaggacatgtaaaatctccaaggctgataagattccaaggaataaagaaagttagtgtgaagggggaggacagtattcataaaagcagaggctcacatgaaatcatatcacaaggagctcctgattaatttagtggcctcccactcaaaggccaccaaggcattactaaaaatccatgaatacagtcctgccctcaaggaattcaatatgaaggcctaatgacttagcatgtccacatctgtttgtctattccaataagaacacttgaccattcaatgacctacatgtgaatgtgcatagtagcaaaacagccaaaatgtgaaagcaatgtaatgactttccattggtgaacaggaaaacatacaatataattattatctatggccactaaaagtaaaatacagatgcatcccataactatacgtcatgctatagaacatgctaaaagaaggcaggcacatacatgatttttcttagatgcccagaaaaggcaaatccatacagccagacagctcatcaatggttgcctatggctagagatagcatcaggacccaatgtactgagttagtgaaacttctaggtggtggagtgttctgaaacttattacagtgatgactgcatagcttggtgaagtcaatagaatcccagaactctacttcatcagaaattacacaaaactgtgggctaatatcccttatgaacacagatggcaaaaagtctaaacaaagccttggcaacgcactctagtattaaaggaagagtgcaccgtaaccaataggttaacccacaaatgcagtgctgtgttaacactaaagtctagcgggactggcgagatggctcaggagataaaggtgcttgacactaaccttggccatctgagctccaggcctgggacatacagaggaggagagagtcaattccagcaagctcttctctgacctccacacatgctaacaatggtgtacacacaatggtgtacacatatgcacacacataaaggaaataaatgtggaaaaaagtaattcacagtggtataaaattaaaagagaaaacaatgtggtgaaatacgtatcaaacatttcctgaaatgccacatatcccgatttcttttaaagacactcagtgattataaagccctcaaccttctgaaaggcgcctaccataaggtatctgtcagcatcatgctcaatggaaaaagaaaacctttcctcttaagagcagtaacaaaatgtttacatctacttttactacttccatccaaatatcatatgagggctgcagactctataataagaaaaagaaatacgacatttaatcacaaaggaaaaaacaaagttatttgtaggtataatcatgatatcttaaatggttctattaaatttcaaacggttgaagagatttgccatctagcctactattctattcttaggtagatatccaaaaaaatcgaaagcatctgcccaagtaagcatggtttttcaccctcagtttccccaggagtccaaggatcctgcttagagtgcagggttttacactggagtgacgggagtggcttgaaatcagacaggaatggctggtaggtaacactgggttacggcacattgtctggttttgagcagtttcattatgactttcagctcaatgaacattatttttttaagttactaggagtaatggcagttgagggctgcaagatacagtgggccaacaaacctataaatacaaaagcaaggcattccaacagaccatttgttctgcaaattaaaattaccatctgactgactcttagaacatcagatcaatataaaaagtaattttacatctatgctatgatattcaaggtggtacagtactggcaataactaagtaaaattattttttaactgacaagttaatcctttaaacagaatagagagttcagaattgaaccgacataaatgcagtcaagcgatgtttgacaaaggagcaaaagctaacacagcaaagagaaaccatccacaaatgatgctaggaagagtgggcgtcacctgcaaaaggtatctctagatgcagactttccattctgaacaaatataaattaaattaagtgggaaacagaagttacaagtttctaaaagacatagaacagtccacatgatatgctaccaaaggcattattcatgaaagaaagaataagctggacttgattaacatttcaaatttctcctatgcaagagacaatatgaaaagacaagccacatactgagggaaaatacctgggcgagacctttcctcatgagcacacaaaggctcctgagacccagaagtacgctagataaacagtgtaaaagctgaccaaggagcctgccctgagaagatagaaaggtgaagggcacatgaaaactgttcccgtcacagattatctgggaaattaaaagttgaagcaaaatgagataacactccatatttttagaatggctcaaatgcacaacaactatacctccaaatgctggggagggcgggacaacatgaactcttgtttgttgctaatcgaaattatgtgtggcgtgatggaagatgcagttcttagaaaaatccagcatactcttaccattttagcaatgaatggctctgtatttagactttaagacatatacacacaaaaacatctattagagcaactttgttcataatcaccaacatgtgggagcattgatatggcttgagtaaaaaccaaacatcaaactgtggaatatgattcaacactaaaaaccaggctaaaggccctgaaaaggcatagaggagccttaactatacattacaaaggaggggagctgatctgaaagatgtgcattctgtatgatccccagtgcagggcagtctgtaaagggcaaaactatacagaaagatgtttagtgcttttagaagcagaagttggaagtagagaggaatgcaaagaacagaggatagacagggcagcaaaagttttccacatctcacggtggacatgctctaactatccaaatatacagcaccaacatagatcctaacatagcctataaactaagagcaatggtggtgtcaacatgggggtcctctactgtaatacgtgaatttgtaaaaggatggatattgattctaggagtgctattcacgagggggctaagggagaatagagaagagctctgtgaacagttcctacagtaactttctcacagttttatatcaatc

SEQ ID NO: 1470 - DNA, 2575 bp, Mus musculus
ggaagttaatatttgccaatggactccaaagaatccttagctccccctggtagagacgaagtccccagcagtttgcttggccgggggaggggaagcgtgatggacttgtataaaaccctgaggggtggagctacagtcaaggtttctgcgtcttcaccctcagtggctgctgcttctcaggcagattccaagcagcagaggattctccttgatttttcaaaaggctcagcaagcaatgcacagcagcagcagcagcagcagcagccgcagccagatttatccaaagccgtttcactgtccatgggactgtatatgggagagaccgaaacaaaagtgatggggaatgacttgggctacccacagcagggccagcttggcctctcctctggggaaacagactttcggcttctggaagaaagcattgcaaacctcaataggtcgaccagccgtccagagaatcccaagagttcaacacctgcagctgggtgtgctaccccgacagagaaggagtttccccagactcactctgatccatcttcagaacagcaaaatagaaaaagccagcctggcaccaacggtggcagtgtgaaattgtataccacagaccaaagcacctttgacatcttgcaggatttggagttttctgccgggtccccaggtaaagagacaaacgagagtccttggaggtcagacctgttgatagatgaaaacttgctttctcctttggcgggagaagatgatccattccttctggaaggggacgtgaatgaggattgcaagcctcttattttaccggacactaaacctaaaattcaggatactggagatacaatcttatcaagccccagcagtgtggcactgccccaagtgaaaacagagaaagatgatttcattgagctttgcacccctggggtaattaagcaagagaaactgggcccggtttattgccaggcaagcttttctgggacaaatataattgggaataaaatgtctgccatttctgttcatggcgtgagtacctctggaggacagatgtaccactatgacatgaatacagcatccctttctcagcagcaggatcagaagcctgtttttaatgtcattccaccaattcctgttggttctgaaaactggaataggtgccaagggtctggagaggacaacctgacttccttgggggctatgaacttcgcaggccgctcagtgttttctaatggatattcaagccctggaatgagaccagatgtgagttctcctccgtccagctcctccacagcaacgggaccacctcccaaactctgcctggtgtgctccgatgaagcttcggtatgccattatggggtgctgacgtgtggaagctgtaaagtcttctttaaaagagcagtggaaggacagcacaattacctttgtgctggaagaaatgattgcatcattgataaaattcgaagaaaaaactgtccagcatgccgctatcgaaaatgtcttcaagctggaatgaacctggaagctcgaaaaacgaagaaaaaaattaaaggaattcagcaagccactgcaggagtctcacaagacacttctgaaaacgctaacaaaacaatagttcctgccgcgctgccacagcttacccctaccctggtgtcactgctggaggtgatcgagcctgaggtgttatatgcaggatatgacagctctgttccagactcagcatggagaattatgaccacgctcaacatgttaggtgggcgccaagtgattgccgcagtgaaatgggcaaaggcgataccaggattcagaaacttacacctggatgaccaaatgacccttctacagtactcatggatgtttctcatggcatttgccctgggttggagatcatacagacaagcaagtggaaacctgctatgctttgctcctgatctgattattaatgagcagagaatgactctaccctgcatgtatgaccaatgtaaacacatgctgtttatctccactgaattacaaagattgcaggtatcctatgaagagtatctctgtatgaaaaccttactgcttctctcctcagttcctaaggaaggtctgaagagccaagagttatttgatgagattcgaatgacttatatcaaagagctaggaaaagccattgtcaaaagggaaggaaactccagtcagaattggcagcggttttatcaactgacaaaacttttggactccatgcatgatgtggttgaaaatctccttagctactgcttccaaacatttttggataagtccatgagtattgaattcccagagatgttagctgaaatcatcactaatcagataccaaaatactcaaatggaaatatcaaaaagcttctgtttcatcagaaatgactgccttactaagaaaggctgccttaaagaaagttgaatttatagcttttactgtacaaacttatcaacttgtcttgtagatgttttgtcgttctttttgtttgtcttgtttgttttctatacgcactacatgtggtctctagagggccaagacttggcaacagaagcagatgagccatcacttttcagtgacaggaaagcagac

SEQ ID NO: 1471 - DNA, 2352 bp, Mus musculus
atggactccaaagaatccttagctccccctggtagagacgaagtccccagcagtttgcttggccgggggaggggaagcgtgatggacttgtataaaaccctgaggggtggagctacagtcaaggtttctgcgtcttcaccctcagtggctgctgcttctcaggcagattccaagcagcagaggattctccttgatttttcaaaaggctcagcaagcaatgcacagcagcagcagcagcagcagcagccgcagccagatttatccaaagccgtttcactgtccatgggactgtatatgggagagaccgaaacaaaagtgatggggaatgacttgggctacccacagcagggccagcttggcctctcctctggggaaacagactttcggcttctggaagaaagcattgcaaacctcaataggtcgaccagccgtccagagaatcccaagagttcaacacctgcagctgggtgtgctaccccgacagagaaggagtttccccagactcactctgatccatcttcagaacagcaaaatagaaaaagccagcctggcaccaacggtggcagtgtgaaattgtataccacagaccaaagcacctttgacatcttgcaggatttggagttttctgccgggtccccaggtaaagagacaaacgagagtccttggaggtcagacctgttgatagatgaaaacttgctttctcctttggcgggagaagatgatccattccttctggaaggggacgtgaatgaggattgcaagcctcttattttaccggacactaaacctaaaattcaggatactggagatacaatcttatcaagccccagcagtgtggcactgccccaagtgaaaacagagaaagatgatttcattgagctttgcacccctggggtaattaagcaagagaaactgggcccggtttattgccaggcaagcttttctgggacaaatataattgggaataaaatgtctgccatttctgttcatggcgtgagtacctctggaggacagatgtaccactatgacatgaatacagcatccctttctcagcagcaggatcagaagcctgtttttaatgtcattccaccaattcctgttggttctgaaaactggaataggtgccaagggtctggagaggacaacctgacttccttgggggctatgaacttcgcaggccgctcagtgttttctaatggatattcaagccctggaatgagaccagatgtgagttctcctccgtccagctcctccacagcaacgggaccacctcccaaactctgcctggtgtgctccgatgaagcttcggtatgccattatggggtgctgacgtgtggaagctgtaaagtcttctttaaaagagcagtggaaggacagcacaattacctttgtgctggaagaaatgattgcatcattgataaaattcgaagaaaaaactgtccagcatgccgctatcgaaaatgtcttcaagctggaatgaacctggaagctcgaaaaacgaagaaaaaaattaaaggaattcagcaagccactgcaggagtctcacaagacacttctgaaaacgctaacaaaacaatagttcctgccgcgctgccacagcttacccctaccctggtgtcactgctggaggtgatcgagcctgaggtgttatatgcaggatatgacagctctgttccagactcagcatggagaattatgaccacgctcaacatgttaggtgggcgccaagtgattgccgcagtgaaatgggcaaaggcgataccaggattcagaaacttacacctggatgaccaaatgacccttctacagtactcatggatgtttctcatggcatttgccctgggttggagatcatacagacaagcaagtggaaacctgctatgctttgctcctgatctgattattaatgagcagagaatgactctaccctgcatgtatgaccaatgtaaacacatgctgtttatctccactgaattacaaagattgcaggtatcctatgaagagtatctctgtatgaaaaccttactgcttctctcctcagttcctaaggaaggtctgaagagccaagagttatttgatgagattcgaatgacttatatcaaagagctaggaaaagccattgtcaaaagggaaggaaactccagtcagaattggcagcggttttatcaactgacaaaacttttggactccatgcatgatgtggttgaaaatctccttagctactgcttccaaacatttttggataagtccatgagtattgaattcccagagatgttagctgaaatcatcactaatcagataccaaaatactcaaatggaaatatcaaaaagcttctgtttcatcagaaatga

SEQ ID NO: 1472 - DNA, 96589 bp, Homo sapiens
  misc_feature (6890)..(7626): "n" at positions 6890 thru 7626  can be any base
ctcccctgcctaaaattccagactgcccattgcactgattccctgggaaataagtgaaaagagacaatgataattttcatttttgttgtggtgaagtgatagtgcaaaaattccataagctcctctaagttttccaaataaagcttagtgtttaaaaacgtttgaacacatgatcccatgtaaggcctacattacttcctgtgtgataggtggggtagatatcattatccttcctttacagattgaaaaacaaggctgagaaaaatcaaatgcctaccccaggctcattcaagtaagtaaatggcagaatagggtctaaaaaccaggtcttgtattgaaaattcaacaagaggatagagaaaatttaattgacaaatactgatctcaaaacaatttttttttcaatggtgacaaatgtcctttgtagcactttggagtttgatatgaagtatcttcttatcttgttaagggatccctataccaagaatgttttcatctcaaccccactatttctaagttagcttaaaaacaaaacaaaaccctgtgtgctctaataagaagatataagaaccaaaatggaaatgcaggttctcaaatgagctgaaagattccacatagcagcggggcagattgaaacactctttaccaaaggaacatgggagagaaaaggagattaaatcaagaaaggaagaaagctaatgacatatgaggagccacaaatgccacaaatgaaaaaacaaagtacgtaatacttgttgcaattattcagtgtgcttgctctaatgcctccaaacattaaaaacattgagttcctgcttatggcaacatttatctcatttatctgctgatagctgcctcatccttgaatcaggtattgcttaaactaagttctgccagcataaagaataaagtcaaccaggacacccattgggcatttcacgcatatgagcacaaattgtgatattttaggttgcttatgatgaaatcattgaaagcatcatgaaagacagcaaaacagcaggaaagctagtaataatttagcatttcccagtccaggcgggaatgttaattctaattacaacgaggaataccaaagtggagttcattatgattaagaacttgctgtactagtgtgaattgtttataataggcatgtctggcataaaatacaaatattgaagcagacagagatggctcattcaaagctcagctgggttcccttgaacctcttaccttataaagttaaataggaatagaagtattttccaaagtcaagatattattttaaagagacaaataatagctatgatagctgcaggaataattttttaaagtaagttctaaccaccaataaaagctgtttgtgtgggcttaacatgttcaaaatacacaatacacatgtacacaatacacgtatacatggttcccatttatatttaacatcacacatttaaagtgagagagtacagaaaaaaagaataaatggaaactgaagccatgacaaagaatcacggactataggaaaataagtcacaaagaagtatgcttatgtaagaggaaatatatgtgataaacaacaggagacatgggaatgaatgtggtgtcttatgtcctttctttaacagaatcgtgtaacagacactactcaatatcgatctcaactgatccagttctccagtctccctggaaaacaatggattgatgcccagggtgcgctgaacactggaaccatggtcacttctgcacttcacacgattctgctcccaccagttgagctaccaacagttcctggtgcttttgcttcccaaacatgtttatgccatttgttgcttattactgtacttacttaatttgattaaatattaagtaaaatgatgaaatgagtgtaaaaaattgttctataaaatctaaatggaaagatgccctatagccttccttgacttacagttgcgtcaagtaaggtggatgtaagacaattttaaaagactggtgtgggggcaggagtgaggaatcataaaaatttagaaatctgcacgaaaattattctaaaagtacacattgaacatccctaacttgaaaatctgaattttgaagtgctccaaaatccaaaactttttgagcattgttatgataccacaaatgaaaaatcctacatggaagtacttaccacaaactttgcttcatgccccaaattattttaaatattgtataaaattatcttcaggctataaggtgtatatgaaacaaaaaatgaatttcctatttagacttgggtcccatggccgagatatctcattataatgcaaatattccaaaatcagaaaaaaaaaaatccaaaatctaaaacactttcagtattaagcatttcaggtcatggatactgaatgtgtatctttaatttcttgttctactttgtttaaaaaaaagggggaaaatagtaattctacagatgaataataattgctaatgatgagcaaatacttcctatgacccaggaattcgtctaagcacttcacatatatcaaactggtttaatctttataaatcagtactattattatccccattttacagatgatggaaaaaggcacagagagttagcctgcccaaggttacattccttttagtggtggagactgtatttggcctttatagtctggcttttaactgctacactatatcaatgcattacaggtatagtttatacacacactaaagaagacatggaactccagtcagtgggctcataaaagctttagaccttcatcaaaagattagaaaataaatgttcaatcacaggttttaggtttcaaaagtttcaaaagtttaaagtttgcaagttatctttcttaaaattatttccttcttttaactaatttttaaattaaactccagttcaatcacatccactagaaggcttcactttctacaaaggggtaggtaaaggtgatgatcttaaataccatactgggagttgggatctgtgtagcactagaatcaagagttattgtatatacttgagaaggagcacagcctgatttagttgatgttttggaggggtaatctggcagtacagcttggattattttagtgggaatggagatgacaaaacatgaagagaatgggagaactcacttgggtaatatatcagtttctgaaatcaatgtatcaagtggtttggttattagtcaggcttaaggttttattggccttaggacatagtctctaagaccatatattatcttcattcattcatttaaccaacacccactgagcaccaactatgcactagtgatacaggggtgaacaaacagacacagtccctgcctttgcagaacttatgttctggtgggtgatacagagaaataacaaatgagggcacaaataatgaactatcattgtaatgtgctaacaaagtatgcagaatactataagaacatacaatcaagaatctaatctagtttattttaaaaaaaagtggggggagcactcagatgtttaaacacaaaacaataaaaatgaggatcttgagggttatctgtacactttttattaacccatttggccacaacaataacccagtaaaagtgattttacatctagttaactagttgactcaatgttattataaccctgtaatgtatttgttgggtgcctgctatgtagtgggctgtgttccaggagtgggacataaagctatgacaagatagatcaggtccttgccttgactgagtctgaatacatcaccttcatttccacctctgcttctaagacaatcaaataccttcccactcagatagggattcatcctatttcttgtagtaattataagttcccagggttacagattagtaaatgccatacctaaagacttaggatactgtgcataaaacactttcaatagtgtctgtcagacagcagatgcgcaataaatgttgactttcgttagaattgtgttattattataatgctaaatctcacgtcctttctggcacactggagttcatctcttcaattaaattccgtaagcacatattgtaagtagtctatcagaattgatatactacttcatgttaatgattgagatcagtgaggaaaaccactttaatattgtctaattcctctcttaatgcataggagccatgtgaacttagacaagcatcaacctctgtaagcctgttgtcctcatattgaaaaatcgaataacaatacctatctcatttaattgttgtcagcaaaagtgggcagcagaagagtggggatcaataaatgttagccacaaatcataactatttgtattactctgaaaaagaggggttaacttatagttcatgcatgcttccaaatgaatgtgaaagactaaagaatgagaatttttttgctatcaaattaaaaaattaacaggcacatttagattgctgaagagagaaattaggataagtttttttttttttttgctcaattaaaaacgttttcaatggcatatttaaaactacgtattcttccccattaagatctgcagagaaaaaaaaatgaagggagaataattgggaactcttgtgaaatcataaattatttaagcagagtacctaccactaaggatttgagcatgtatgagcgatgaggtggattcttagagcagagattcagcagtgagacaggctaatggcatggggagatgtgttctattagacaactgtattgtccccttaattatatacatatatatgtatataatatatatgtgtatacatatgtatacatacatgtatatataaatagaattcttaatcattttaagcagtgtacaaggataattattagcatgggctatttaactcacttttaaaacgtgtaaaacattattgtagggttgggtcttgatttgtttcccatgaaactgttggtagtttaggggccaaattaacgaaagacatctcattctagtgcttgaggctcagaaattggaaaaacgggcaactaggtcaagcagtgttctcatagcctcacagatgagcatccaaagcaagggcctccttctagttgacttgtgccaagggacaggagaagcggagtctgccttctgggtccagaagggggttttgttaacatggagttgctcagcgcccttcataaaaattcttctggctgagggttctacgttggcatacggttggttccctcttcttttccgaggtggcgagtatctcttcctttgccaagatggcggctccagaatcctctggaggcggcccccgtagatcgtctccggacaagaggcttgctgaaagcctacttctttcctttcacatcagacaatgcacagggaaccgtttacccttgagaaccaaggaaggacggcttaggctacccgcgatcgcgaacctttgccaagatggtggccgcggggacgggctggcgacactgtaccctaccaagatggcggcgggcggcttccgggacgcgcttccccaatcgtcttcaagatgtcagagcagggggagccgccgtcagtctgagcgcggcgggaggtgagagagtggctgtggccgagcgcccgagcaggattaggtggagctgcggcagcccccgcccgtgtcaggagctggcaagcgatgtcacctgtgggggcgcaaaagttacctccccaaaccctaaacccacacagcacaacctttcccagagtcacaaaaatcataatctgtgccgcacaaggtaggaggctcggtcccggcatcgtccaagccttcccgacgcggcgagctggggaagggagctggggcgggggcttcccgcacgggcacccctcgccccacggccctctcctttctcaggacggaccacgagttcccttccccttggactgagggggaagctcctaacaggaacatctgtagggagttgaacgctggcattttaaagctgcctgtattttgttttatttgtaggggcaggggtcctatgaacgtgatagggtgagcaacgcacagagtcgagggcagcaaatgtcaagattcgggggtggggcctgcaccgggaacttggacgcgggccctggccggggtggaagaagaggtcaggagtttcggaaggggggctatatttcgccagcaacttactatttcgcctgcaacttgcttttaagcctgccgccccctgctttccttaatcataataataaaaaaaaagtgcaaagaaatccagctcgctggaggttttgcatttggcgtgcaacttccttcgagtgtgagcacattgggcgggaggggtgggggttgaacttggcaggcggcgcctccttctgccgccgccgccgcctcgcagactcggggaagagggtgggggacggtcggggcgcgggggagggtgggttctgctttgcaacttctctcccagtgcgagagcgcggcggcggcagctgaagacccggccgcccagatgatgcggtggtgggggacctgccggcacgcgactccccccgggcccaaagtacgtatgcgccgacccccgctatcccgtcccttccctgaagcctccccagagggcgtgtcaggccgcccggccccgagcgcggccgagacgctgcggcaccgtttccgtgcaaccccgtagcccctttcgaagtgacacacttcacgcaactcggcccggcggcggcggcgcgggccactcacgcagctcagccgcgggaggcgccccggctcttgtggcccgcccgctgtcacccgcaggggcactggcggcgcttgccgccaaggggcagagcgagctcccgagtgggtctggagccgcggagctgggcgggggcgggaaggaggtagcgagaaaagaaactggagaaactcggtggcctattaacgccgccccagagagaccaggtcggcccccgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggtaagaagcgaggcgggagggggccggggcgcgctcgctcccccgaggtgccgctgggaccggagacaactcgggggccgccgcgggagcctacaaacttttattagcctcggggagtgggggtggggggctggcaagggccgggcgacggtgacgaaagggcagcgcgcgggtgacagcgctggcctcttcctctccctccgccggcgtcccctggccgggccgagggggaggaacctgacctcggacggcgagcggagccccgccgaactgccgggggcttcgagcctctcattcctcgcgggaatcctggcctcttttctccccctagtgtcccctttccctccaagggggtcgcccgacacccgttttcgtggtgaacgctaagccgcgtatgaattttactcgcccgaatatctgcacgccaccccggcgcgcccgagcgcgagcccgggctccggggaggccccggcggcgcctggcttgaggagggcgtgcggggcgcgtgagggtgcacacgcggggggctgacagcccgcaacttggagactgcggccggggccggcgttatctgttagaagtgggcgtgtcggagagagaactcaacaggtctggacgtacttctcttttaacctcgcacttttttctcttctccacccccgccccgcaagggcttgctctttagcgtttgttgttaattcgcgcctgaggtttctaagtggccccttttagaaaaagaccccctgtaaccgtaatggttttgtgctgcgatttttacaagtgctagtttgacgtttggggttgcagacttgataattgcaaccttgtaataccacttaagaccctctggcatggttcattagggccaattaatgtggctgggttatttgcaacttaaactgggggataatgtcgcttgagggagcgttttcgttttaggaaatattgttttggtttcgggtttgaaggcagctgtcaaaaaagcggcatggaaattcattgggctccattcgatacctcgtgtttagagatcgttatcgcctcagataaacggggcagagaggtggggagataagcagtttaccctcaagatttgtagtggcaagtccacacccctctctctaccttcatattcacttttcagtgagggccagtgacatttatgctgcctaacgtcatcgcataggaaaagttaccttttattggacgggatttgactatagtgtcccaaatgcgcttctccgtcttagcccatctcttaaaacaccctgattaacgatatactaacagtcttactctcttgagaataggctgagaattgggataggtgaaggtttggataggtgaaggcagagaaaattattttgaacattttactggatacagttgtacctgaatttatatgaatgtgattttacggttctgtgtttttccatttttcagtacttcgatatttgtttggaaaggaaagaacttagagatgtaatagcatttcatattgaggatctcaagcaatgtaaacaaatgtagcttaatctagatgtttttgtgagttatgataagggtcagctatatttaagttatgtaagctaacaacgtagtgagaaactactacaccttctcttctgctctttaaaatctaaattttagttggcctatataaagtgtatctcatttcatatatccaaaatttggaggtaggcacatccagtcagaagtatgggttaaaaagccttttcccagcctgtcggaagataagcagatcagcattgtttatttttcaaagaaaacgtgcatggttcaccagttggttgtactcaaaggtttggatgtgtgactagctggtaggagggaaatttggaagtaattagggattgagaattctagcatagtatttatcaaatgttatatgtattggttctcagaaaagcaaacagccgtgattgaaaagaggtaggaattttaatgatcacacttcctttttttgaaattaaatactttgacatcaacttgaaccttcagaataatcagatgtaatgaattataatgtctgtgattaacaaagctacacgttcagtgagcggcaggatgaatagccaagcttagttcgatacacttttgccctcagctgtgcaaatggattgcattgtacttttaaatgtggcatgctgaatgggagcaggggacatggctttttattctggaagatagaaactactcttctggtaacaaagaatttgattcggagttaactaaaaggttcatttaacaagctgcctcttactaatcggatcaggaagataatgtgactttagagcttatgatgttttccccccgtttttgttttttgttttgtagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaaggtaagatcagtgtttttctgtttcttaagaatggtacatttaaggtagattaatagatgtaaatcttcattgatttatatgtgttctctaaagattcatgtgcttttttatatgaataagtttaagtggccttttgaaagtaggaaaggtagacaacctaagtgacatctgtacgtaaccatttcaggttttttccttaaatagtggttttcagtatcccattggccaacggtgaggattttatttaacatttttaaaataatgttgctcattaacagatatcttaacgaaaaattatataaattcaggagagtataatgtctcataatatcatattgtgttgtgcatggtcattcagctgttttagaatatgttcttatattacaataaatgatacccttacttacatagtcaaaagttgtgctgccttatttgtaaattcgttaagtgttagcttgagattaaagagttaaaagcagaagtactaacaaagagccctattcttcaaactgaatcttctgttaaagaatttgagttttgaagttgctaaagcaatgcagtgaacagtgtaccagaccatagtattagacacaggtcttgctcacagggttcttgccataaagtagacaagttatgtctgctgatcaatctctttaagagaggaattggtgtcaacatggtgcaaaacaaaattttacgttcaaatgttcctgcaagttctcaagtagataactgatggccaaaattgttaagcttcaattttcagctttcgtttgatttttctcttttttttactcagtcgtttataagcatactgatatttttgtctgacccaaaaaggtcagaaaatggaattatcagaaaaaagttctaaatgtagatatacgtgttggtaggggtgaatttctctaccccgtaacctcatccccaattcagataaatgctaggttttatatccattttagttgtgaaggaaaatataaaaatgtggattgtagtgacacaagattgattaatcagcgggtttttttaaaagaagacatggtagacagtgatttatttgtatgtaactattgaagttttttcttaaatgttagtgatattcatcgttcccattaactagttattcagatttttgaaaatcctttttctgtgaaagctatcctaacctggaggatgtctcttttctttcctctgtacttaagaagcttttcttgttagggaaataatttagaattagatttaggctatgttctgttcttctaaaaggcttagttgtcaaaaaaaaaaaaaaaaaacaccaaaaaaccttggttcttacatgtcttaatgtgaactacctcctaatctattgtttaaataattatcctttatttagaagaacactacttcaacctgagttgaaggtttaaaatcttttcagtaaggagatttgagatctttattattgcataagctgttgtgttttaaatgctaaaagacatgctgtgttttaaaattttcaattgcaaatttttggcaatagaattcgcatacttggttttcttaaaagagttaagtacggttgatttgactaagctatctgtaggaaactcttaaattgatttataaaacatgtaattatacaaagaaaaataaaacatcttaggaaactcttggggattattaatggattttgccctgataatcatcatggcatggttttcattttccttactataaagaaaaggcaagggacaaaacttattttccatttgctatgaacttttaaaccctataaaatctgggatatagagtataagtagatgaacatagttactcttaaatcactaaaggtgattttaatgctttaacttttatagtacttcatgacataaagtatctttacgtatttttaatttgggtcccataaccttatggaggtagtaggcaaggcaatgatgatgcggctctttagaagttctttaatatcaaatgaaattattatttttatgccaatctgtgattgggaaatataatcagtagtctgtgtcctaacaagaaggtataatactttatacagggtattttgttaatatttgaagattttataccttatggcattaacttagcactgggaactatgattacccaaaacaaagcttcatccaaataaattgaaacagtgtttcttttaaaccatcattgaattagtctattgtttccaaacaacagccctgatatagctaaaattagttgctttctcttctctatatgttacatgactgtagccaaacatttgctatgaccagtgaccctgagtgatcagcaaataatcaacacattgagaccacaacttgaatactgaccttctgactttacgaagaaaaatattaaatgccactaataacttgaattccttttaaattaaaaaaagttataaattgcaatttgactttttaaaatgccacctaaaattgtttttatcagaatacttaaaaaaaaatcctcactttattctctgggggtgggaagaggcaattccttccttccaccacaacattgaattatcacataaaattgtaaaattatgaatattatgattgagcttagtaaagcattttctaagttcatttatagtaaaacaagagaaaccttattctcaaaatctattctttaagtaaaacaaactagtcattctaacttaatatgcttttaaaaatactgaagttcagtacatttagcataaacttattgacgaaggcacatttctgcattatttgattttcagccttgtttcatttaagcattaatgacagaggtagagaacagaaatggttttaggtggtattagagcttttattgggattatgttgaaattttagtgttaaaaaattgttcgtatcctgaagggagggattattggagagaatgaatgatgtaggatgaacttgtaaattcagttttcggcagagtctaaaattaagtgatgattggcacttaatgaagctactaaaatttatgtagattttaatgtctcattagtaatcgcatctgtatctggttttataaaagtaatgaaattgaagacctgtacaaatacagaatgaatgaagcaaattctgctaacatcatgttgaatgttttctcagaaaaagaggaaatacgaagagaagagatttgttttgactgtgatttaccctcacccccatggatactttctttacttcctaccttttttctttttcttttccttctaaagattctggcaatgggtgtttcagtgttttttaagcttaatatttctggtactcatttatgtaaagtgatttctgaatgttaaaggagatttctttttaaatatattttcacttatttttagctttatgatgagaatcttattttttaaatctgtaacttgttatggctacatgattagtaaaaaaagtttttaaaacacactgtgtattcaggtgtgtcattttagtgtgaaatgactaatgcagaaatatgtgactagcatgtggtcagattttattgaaattacttacgatgtttctatggctagtccccttgtatttttataattggtaacataattcatatgttattttggtcttgtctatttgtgttacatgtattttagtctgaccacttttgctacttatttaatgtttatacattttatgaaagacttattctgaaatataccttgcataaatgtaggttaaatgcaaattgtattaatagtgaaatggatatgtgggtagagatcactttaggggccttttgagatttagtgaaggaaagattggatcaaaagggtttactttaatgtgactgcctaatgtgaaagtcggaacatctgcattaattggttagttacataaatcttagtctactctggcctgcaggtgactgaaacagcccaggaaatcttaatttacattaagcttagacaaggtctgaggcttaggcttagttcttaaagcacattcttttttactttaatgattattcctaattttaatgagcagtgggttctcattgtgtactagtacttaggtgggcaaattaaataagcaaaataggtttgtgctgaatagcatttacccttctgaggacatcctggtaatattttcatcaagagtaattgtgtaatgcaatatttacaggtatttgccagattaatgggcacttgttttcatatttctgagtcatggaaaatatacattgatgattcctgttgcataaagagttttcaagaaaattttgttgaattaagctataactacaaaaaaaaatccattacatattgacctttagaaaggatttttaaaagcccatgctgtccttatttctgcagcttcagagagccgactgctcttattttcttctggcatattctattaatacttgggttttgtatttttcaagtaaataaaatattcctattgagaatttcaattttaaaaaagaaaaggtctactaagtgttcctttccctgttgaattatgtgtgatcatttctatgctaaactagattagggtgtgacttgtgatggtgatttttgttcattttacatattaagaaagaaatagaattttattgcagttcaaaattatttgtagacagtggttttaacccccagacacctaattgtgacaggttgctttccttagtgctcaatactgttgtaaatgtctctaaatacagaatttccagtggagttcatgaattaattgggggtggagggtgaagagggaggagcaacagagatgtgggatgctatagataagtttaggaatatccagatcagttctgaaaactaacagtttggatcaactgtcatgaattagaggtttaagaaaagaaaaatttaggactataggtacaagggaatgcatcaatcagaattacaatttaatttcttttatttcaggtagaaatctaaaactgaccatggctatataatactaatttttgagttatgttgtttcttactatgctttattatcaaaaaaggataaaatgcacattttacttgaagattattttagctaagattaagttcatatttttctcatttttatttaagctgctgtttaataaatgaaaatctaatgacttgaatgtagtcgacctaatgtcttaatgttgatataatcatttcatatatcatagtgcccttttacagccattgtcaactgactggagagcaacccttttctttggtaatatatttctatgggttatgtatttttctgctggaatattgagaaaattaatttttcataatatgcagaataaattatggggttctgcaagtgctagacagtcacttaaaccatttatattgcaatacattccttaaattcagtattttgaatgaaagtgtgttatccccgaattttatcacttgtccaatttaaatattaattacatcccaatagagctgcatgcttaaacatgctttttcagagtaacccaagtattaatttcgagtgcttttaaatattttttctttttagcaagtttcaacaacattaatcctgtctataatgcagcaagttcagtgaaagtacctgttgttttataatttttttttcattctcactgtagggcaccaaaaatatatataaggggaaaaaagttttaatgatatgattagttgtaaatgtttacgcattatcttaccttgaatttttatttttgtaactaataatttgagagttcaataagtatgcagtgtttaagacatagtttgttgcaaaaagtgttaacttactatttctttttacaataaaattagcctttattctagttgatttcataactgtccataatatttagctgtggctattatgaaagtatatttgatagccaaattttgaaagctattatgaaatgatacaattcactacatgatttattatttcatgctggttggggcagtgctgtgacttatgaccttatgattgtcacatgctgaacactaaagctctaccagtttgttatggacactgttttactttatgttatcgttttaatgttttcttttataattattgaggataagagcttccttaattttaagactatttaaattgcagattttgcttttttatttttttaaccatcccttccaaagaatttgatttagatattcagtagtagaaacagaagaaaaatactcaactaaaagtccaaagacctagtttctaatgctaagggagacagtccatggcctccaactaggtactttggagtcaaaaatactttctttacaactgtgtttgaattgttttcaaaacacctgtgtgtgtgtttctaaaattccacaatccttttaacccgtcaatttgatgagggaagtaattagggtagggaatggtataacaaagttggttctttgacattttctttatagattatcgaatgtaagacaaatagatgtgaatgcagatttggtgtttttataagataaggatttaaaataatgtagttggtgatatataaaaataaactattgctgctgttagcacccgagaggtggggctcttgggttctcagagcttgttttctatgttcgttacagttattttagattagaacttaaaagaacttgagagtttccctaattctaccccctaattttttcgaatgagaaattgagatccatagaaagtgttgaggtaaagatcacaaaacacttaatgagcggtgttgccagtttgaatatctcaattcttagttatctaagttccctggtaggcttctttaattatctgggtctcttctagacatctggaacaaatagttgattgacataatacagactagccacatattttataagagttacttttgactcatttagatttttaaaatatacagtgtctgtattcttctctattcattttgttaatttttttttacctaataatgattaagcaccaattatgtgacagcactatgctaagcactttgcatgcattcatctcatttaaatctcaactctgtgaaagtttttattctagttactgtattaagtctcaattctgtcaatatccatgaagcacagaaggcagctgttatttaccttaattttacagatgtgaaaactaaaggcatttaaagagaaaaagaaaaaaaaaaccaggaaaccttaacacttatctgaagggaaatatttaatattgggtatgttagttcctcatgtatctttaataatttttgtcaacagcgaatctttaaataaaatataaaggatcaggcctctgctctcctgcatatatttgtaaagtcacttactgctttttgtcacagtttcaatttctgtaaaatagtgagagggtttttacctgacaggatttgtgcatgtacgtttactttgaaaattaaaaagcattaggccaggcgcggtggctcacgcctgtaatcccagcactttgggaggccgaggcgggcagatcatgaggtcaggagattgagaccatcctggctaacacggtgaaaccctgtctctactaaaaatacagaaaattagccgggcatggtggctggtgcctgtagtcccagctactcgggagcctgaggcaggagaatggtgtgaacctgggaggcggagcttgcagtgagccgaggttgcaccactgcactccagcctgggcgacagagcgagtctccgtctcaaaaaaaagaaaaaaaaaagaaaagaaaattaaaaagcattataaaaatgcaaggtggaatttttaaagctctgccaagtccacttagcttaaaccagcatgactctcattggctaagtacgttatgacatctgtgactgtggtgtaggtattgcctataatcaagaatcttttagggtctgctatgtgcaatccctgaagggtcatggatcgcagtttcataaagactgctgtattttaaagccttcaaatgccaacgtagtatcttcacaatgattttttttttcagttttattattttttgaaagcgccttcgacaaagttttcagtggattttgttgagggatattaagtatgccatctacataatagccatagtgataactccaaccacattgttatatttttattaataaatgctagagtattctctttctggtatttcctattctgatatttttatataatcaagtatgcaaagattctttgtcattggaaaccttaatttgcctgaaaatgggaatgaaattttcaggtttaaaatttttttacatttattacatttattgaagctgtctgaaaaagctcttgagtatattgaataccaaaatttatcctaactgcataaagttgggaggattgtgaaacttgactgcactgacttgttttctttattgatcaaatggttgaaaaaaacttcagttaaacaaatttgatctattaaaccaaagttataaaagcagaggaaagcatagaattattaaacggcagtttaaattggtaaacataccgatgtagaacctaagtttgtaggcagctttcttagatggaaacttaaaaaaattttaatcagaacattatgtgaaatttgtcatctggaattcagctgggtttattaaggacaaagtgtatggctataaaatagattgagttttttttttaaaacagaaaacccaaaataaatgttctaagtttccaccttaggaggctatgtatattgctcctctttgaaactgccttcagaaccaccttgtaagccataaaagaaaatcggactcattgcactatagtaacacctaactgttcttgctcaaagaaaatgtatttatcccttagctttatttgtgtgactccaaatcatatgagtattgccagatatttagaaatttaatcctctctcgaatgataacatttattttctttgagggtttttaaaagagcccacatagatatttctacagaaaatgtttaattctgttttgaatatgcctggaataagtgaatagcttcccagggtgactattctgaaatgggtgatgcttagtggttaagttctgatttgtgttttcttgaagttattaaggaactttatgataacagtttatatattccctcttcttggcatagtaatgaagtaatagagactattcacctctaagcctgattttttaaataagtgtttattttatgtttaagtaaggtaggtctgcttttggcttggacttgaatttggcaatagcagatataaagtaaacataatgtgaattcctacaacagtctcccaaacagtttaatttctcattcatacacatttcccttagtgtatcagggaattaagtatctgattatcagtatagcaagaacaactcaagtatactgaagttatttatactcataaaatagtttgagttatagctacaatataaaattaatatatttttgacttttattcctcacaacctgaaaaaaacctctgcgattactgatagtacttttaaaaactaaatgaattttgttactactatttgctaaatttagtcatgtttactgttcaaaaaatgctaggttaaaatggatcctaatctttgaaatgatgaagacatgtgtagtggtgtcaaaaataggatattcattttgtaactattctgttagtgccgaagttcttagaatttctttgtgacaacagcctgcttaagaactttagattttttagaattgtactaaaagcaaactgttttcttggatatttgttctttctccccaaaagatgatttataagttttcagagctaagaaatgggaaggaagagccatcctagcatggcaggtaatgttttactgctaacaggttttctctgcactgctttatttgccttgaacctcttactttgttctgtcagctgggaggctggtagattttctattaggtagcaaatgcttctcatcactaaacacatatcatgggctggtgttagtgcagtctgtggatgggcactacatttttaatcaagaaatgtttttaaaggaaagacaaattggtgaagtaatttctaattcagtattttagggatgagtgaccttttaattgataatgatatttaacagagctgtacagtgctttgggggtcccacagacatgtttaaacaagaaaacagtaaataaggaagccagaaggaaaagttataaaactattaagaaagaaaatgaaaattctaaacttcaattctggtgcctggctaaatttgatttttgtatgcctcagtgtttctctatggacactgggaaatcaataagcaacctagctacgttattatgttcgtaagtggaagaactaaagaactacaaagacatgttctaggccaagaattctggtggtaggtagagtgggaggttaactagatgatctccaaggtccttctaattgcacttggcagcagcaagcatttatcaagctagacactgggcatatggagatgaagaagatgaatatccccagcagcatggagagcactctgatgatagtcatccctgcctccccctccctcagtttgctttttgaaatgtgagcttgaaagatctcaaactccttcctgggaagacataactgaaacttcatggaggaaagtgcatgaatgaatgggaaacaagatttgattcaactatttggaataagaaaaggggcaacaaggagtctgaaacaaatgaaagaaaagatggaaagaattagttgactagatgaggactgagtacataggaatgagccaacaggagacttcagcaactaatggatgaaagtattatgtgcatgcatgttgtcatcaaatatcacatgatacaagacaaggagaaaacatgactttcaccataacctcagtttgtgtaccctagttgcaagatatttttttcttctagtcacttaagaatatccttattgtctaggagaaataatcctctttctgggctccccagtgtataagcccaaatctgaggaaaatttacctgaaatgttctttccccagatacccacatggtttactctctcatttaaatgtcagctctgtaaaagagatctctgactgctctatctgaaatagtagaatctttcacagtctttccttcttcttgacatcatctatttgtgtcttatctgctcacctgctacaatgtaagctccatgagagcagtgatactgtctgccttgcttactcctgtatgccagcgtctagaatagtgtctagcacatagtaagacctctacaaatacatgttgaatacctaaataaacaaaatttaacatataaaccaaaaagatatataggaatggattatatttctaatctttctcgagtgaggaaaatgtcagcagatagtgaatatcactgagagagagatgatagcccaggttatcttccccagatagaaataagccttaagactgacaggtgtatatgaatacagagagtatacataaagaagatgtattttcaattgtcagtctctaaatttgctttaagacttcgaaatggattgcttttcataatttcttagaataactctggtctgtttaccattgaaaaattagagtagccaatgtttgtaaatgaagggttagagggttttttcctttggtggtttgttaaaagcttgctcaaggcagtaacatagtaaattgtcaatataggaacttttgtagcagaagctttatgcttttcacttttataagaattgagattatttaagcagatgagtctaatgtatatgtttgtactgacttacctagaaggtcaggcaagaaatcggtttcctcatttttcagataagtgtgtgtgtaatcactgagtaccttaagagaggaggggtgttttatttttgcctgaattttcaaaatatctttcttcagcttatttatattttagatttgacttattctgtctatagtatataacagtcaggaggttggtaggataagttcatctcttctactaagagttataggagagttcaacctaatatggcaatgacagtcgcagaaaagagaaaatgcaagttaagtaggtgttagccatagcaagaaaatcagatgaggtcatttaagaatgaactgctctaatgttcaggaaaaaagaggggagggacaaggacagggctctagaaggcaaccaaagagagcagccacaaaataaatgaatagctgaagaattaggagacaacaatcttaaaatgtggcagggagagggtagttgtcacattaactagcatagaagagacagaatagaataacataaatatatgagtgattattgttcttgaaaccagtctttaaaacatgggaacattcccaaaaatcaaagccagataaattagggaaatcttaaatggcacaatataactagtgatttcgtttataatttttttaaaaaggagacttaaatttgaaatttagatgtaattaaagcagataataagaaacatacttctgagaccacaaagaccctgagattcagttaagagtaaggtagaaaggctggaagccagaagggaattaagtttctgttccctgagaagccaacacaacaggaaaaaactggccacaccctagttcaaactcttattactcttatcaatagtctcctaattgtttctctagttttctcctctcccttcttaattcattctgcagtctactgccagattaatcttcctagaacaccactttcagtattattcccctgatcaaaaaatgtctgtggttttgttgctcatagcatagtggttctccttctttgtaccacagcccatatgcacgatgatagatggtgggtagccacatgaactctccataacctttggaggatttgggttatacacagtctgttatccaagaaagcatatctgagtgtaagtgagcattatagggatagtcttataattgactccttttaaaatttgttcttctttttgcaaatgccccttcagaatttacagaaatagtgtgttcattccatcagtaaaattataccccaaaatgttaataagcttatttccatcacgtctcctttcctatttctttctttcctctttcttcctgcacatctccccttatcctccacatttctctgtaattacataagcataaacagacacatatgagattttctgggttgcttgcctttaaataaaagaatgggattatcttatacccctttgtctgcagcttgcttttctcacctaacaagtacaccctgaacatccttccaggttaacagatgcggatcccattcttttaaatagacaatattctattcatgtggtttcgtgatttttgccactacaagcaagtttctaataaacacccttttctatgtaccctttacaaatagcaactttttttctaaatataaatgctatggtttggctctgtatccccacccaaatctcatcttgaattgtaatcctcacatatcaggggaggggcctggtgaaaggtgattgaatcctggaggcagacttctcctctgctgttctcatgatagtgagttctcatgagatctggttgcttgaaaatgtatggcacttccctcttcactcactgtctctcctgctctgccatgtgaaaacatggtttctttgccttccactgtgagtgtaagtttcctgaggcctcccagtaatgcttcctgttaagcctgtggaactatgagtcagttgaacctcttttctttgtaagttacccagtctcagttagttctttatagcactgtgaaaatggactagtacagaaacttggtaccaggacagtggggcattgctataaagatacatgaaaatgcggaagcaactttgtaactggataatgggcagaggttgcaacagtttggaggactcagaagaagacaggaagatgagggaatgtttggaacttcctagagacatgttgaatggttttgaccaaaatgctgatagttatatggacaataaagtccaggctgaggtggtctcaggtggagatgaggcacttattgggaactggagcaaagttcacttttgctttgctttagcaaatagactgacagcattttgcccctgccctagagatctgtggatctttgaacttgagagagatgatttagagttcgtggcagaagaaatttctaagtagcaaagcattcaatatgtggcctggctgctcctaacaacatacagtcatatgtgttcacaaagagatggtctgaagttggaacttaggtttaaaagagaagcagagcataaaagtttggaaaatttgcagcctgaccttgtggtagaaaagaaaaacctattttctggggagcaattcaagtgagctgcagaaatatgcatagatgaagagtagcctaatgttaatagccagtagaatagggaaaatgtttccagggcatgtcagagaccttcatggcagcccttcctatcacaggcctggaggtctaggaggaaaaaatggtttcgtgggccaggcccagggttgcgctgctctctgcagcctcaggacatggtgccctgcatcccagctgctctagctccagctgtggctaaaaggggccaggagataatcttgggctgttgcttcagagggggtaagcctcaaaccttggcagccttcatgtggtgttgggcctatgggtgtgcagaaggcaagagttgaggcttgaaagcctctgccttgatttcaggatgtatggaaatgcctggatgtccatgcattctgcaggggcagagccctcatggagatcctctgctagggcagtgcagaggagatacatggggttagagcccccacacagagaccccactggggcactgcctagtggagccgtgagaagagggataccatcctccagactccagagtggtagatccactgacagctttcaccatgtgcctggaaaagctgtaggcactcaatgctagcctgtgaaagcagctgcagggtctgtacccagcagagccaccagggcagagctgtccaaggccttgggagctcaccccttgtgtcagcgtggcttggacatgagacgtggagtcaaaggagatcattttggatttttaagatttaatgactgtcctgcaggtttttggacatgcatggggcctgtagcctctttgtcttaaccaatttctctagtttggaatgggggaatttacccaatgcctgtatcccaattttttcttggaagtaactagtttttgattttacagtctcataagcagagtggacttgccttgacccaagaagactttgtacttggacttttgagttaatgctggaaggagttaagacttccggggactattgagaatgcaagattgtgttttgaaatgtaagaacatgagatttaggaggggccgggggcagaataatatggcttggctgtgtgtccccacccaaatctcaatcacttgtaatccccacatgtcaggggaggggcctagtgggaggtgactgaatcacaagggtggacttccctcttgttgttctcatgatcgtgagttctcatgagacctggttgtttgaaagtgtgtggcacttcccccttctctctctgtctcctcctctgccatgtgaacatgtgcttgcttctccttcaacttccaccaggattctaagtttcctgaggcctctcagtcatgcttcctttgaagcctgtggaactgtaagtcaattaagtctctgttcttcataaattatccagacacaggtagttctttattgcagtgtgaaaacggaataatacaatagatttccccaaagttgggttcctgagtcaggggtatgtgtatttaaaattttaacagatatttccaaattacttttttcgaggattatggcaagtcacagttccccctggcagtgtttatacttttctttataataaaaatacataaatcattattactaacaaattccttgccatgagtcctaaattgataacaacataccagtgtgccatataacatagctgaggactgttgcagtctagaattcaggctccttctctctgcttttaacaatatgtgtaatgttcaagaccaatttagtgccacttattttgtatgctttcctttatgtagtccaggccatagccccccacctcatctgatggtatcctctggcagccacagaccacacagttctttctacctaaattagtcattagcacatagtaggtacccagtaaatgtttgttgaattaatactgtttatatatttctaatttatctccaagtaaatccagtctccttaaggacaaggaacgttttcactataacacctagcacttaaggtactcaatttaggtagggctgtttgaacaaagaaccacagaggaagcaaatagcatggccttgcctttaatacatatattttactttctcttagggaaaactggaactgtaagaatctagtaacaataataagaacagcacttttattgagcagttactatatgtgaggcacagttcaaactgcagaggatacaacagtggacaaagctttagttgtttctgcctttctgaagcttatggtttatgggtgttacattcaagacatttgtaggacacattctaaaatgccatccaatttcaggctctttccagcagaaactgtggaatatttttccgttcattcagcatttacttagtgcctgctctgccaggaattgaagagaaagcccaaagacaggcagaccttacctgagaggtagtgaactgaccaggatgactgtgggcagtagacttgtttcccaaactagcctcaccatttctgtatttgcatatacgaggaaaggattagatatagggattcatgtcagcatacaccccagggacatttgtttttagtgaaaggtgccagtcttcatccctgtacccagtacacaaaccacgaagaagtatgctcccgtcattgtcaaagaatcatagaattccaaatggagctagttttgatatccagatctcacttcatatgaggaaactaggtccagtattgtgagtaagaattaggactcttcagattccctgggtatgaatctgactaacaactgtgtgaacttgaccaaattcataaccctgtaaactctgtttcctcacttttaaaatgggcacaacaaagtgatgcatgtaaactgcatagcacagtgtctggcacttaaaaagcactcctgaagttatttttagtgatgtgttttaagattagacaactccttaatgccaaaggtttttacttgagaactctgtctgttgtgccatactacacgctgttcataagataagcctttttcattaattgatctcaaactggcttcattatgatcttaactttatttcagttttatttttaaaatttatttttaatttttatgggtatatagtaggcatatatatttatggggtacaggtcatgttttaatgcaagcatgcaattgtgggggtgatatataattgactggggtgagatatctcattgtagttttgatttgcatttctctgatgattaaggatgttgaacatttcttcatacacctgttggccatttgtatgtcttttgagaaatgtctattcagatcttttgtccattttttaagttggattgtttgattttttcctgttgtctgaactctttatatattctagttattaatcccttctcagatgggtagcttgcaaatattttcttccattttgtgggttgcttctttgttgtttcctttgctgtgcagaagttttttagcttgatgtgatcccatttgtccatttttgcattggttgcctgtgcatttgaggtattactaaagaaatctttgcccataccagtgtcctggagagcttcccaaatgttttcttttagtatcctagtttcaggtcttagatttagggctttagtccatttttatttgatttttatatgtggtgagagataggggtctagtttcattctgcctatggatatccagttttcccagcaccatttattgaagagactgtcctttccctagtgtatgttcttggcacctttgctgaaaatgagttcactgtaggtgtatgaatttgtttctgggttctctaggtctgtgtatctgtttttatgctagaactatgttgtttgggttattatagttttgtagcataatttgaagtcagataatgtaattcctccagttttattttttttgttcaggatggctttggctattccggggcttttgtggttccatataaatcctatgattttttttttctatttctgtgaagaatgtcattgatatttattaataaagattgcattgaatctgtagattgctttgggtagtatggacattttaacaatattgattcttccaatccatgagcatggactatctttctttttttgtgtgtcctcttcaatatttttcctcagtgttttattgttttcattgtagagctctttcacttctttcgttgagtttattcctaggtgttttattttatctgtagctattgtaaatgagattactttctgatttcttttttagattgtcctctgttggcatctagaaatgccacagatttttgtatgttgattttgtatcctgtaactgtactgaatttatctgttctaatatttttttggtggagtctttaggcttttccaataagatcatacagtctgcaaacaagaataatttgacttcttccattccattttggattccctttatatctttctcttgtctgattactctaggtaggtcttccagtacttccagttgaataacagtgggcactcttgtcttgttgtagatcttagaagaaaggctttcagtttttccccattcagtatgatactagctgtcagtttgttgcagatggcataactttcaaactaattgattatagttaggaagtggatactttaacttgtggtaccattatcagatttatatttcggccataagcttgaagaggagctgaaaaatgcatatgtgatgcatatgcttcctatttggctctcttctcccacccccctgccctataatccacacaagttcctctctcagtcactcatcaactacttgaacctctgaggaacttggggttaaggtaaattagaataaaactgtctgaagaagagcaagcctttcatgtcttgagaaattcttggggttttagaaataacttcattgctttttttctccagttactttggcttcttcttaaagagaatactaacactttgaacgtcataatactaaggttctgcctcttcaaataaagactttaaaaaaaaatggtttttgtatgattcagtgtgaattaaatcccacagtgtaaaggactttactttcttaatgtagattttcaaatacacaattactgatgtttataagtagatttattacaccaaagcacctagcaaattcttgaatggatcaggtcttatttttcagtcttactttgcaaatttaagtcaaataattaaggatttgttaaatatttgtcttaatatcaagcttttgcatatcggggccctcttttataagctttataagcaatcttttgttttctctgcttgctcaaagtagctatgtttgttgtatctgttagtatttgctctataacaaacatactgggtgccttcccacttagatttggcaattatcactcctgtaaatgagatattacataagataggaaaaagaacagtatctttccaagaagaatagtatccttccatattaacagtttagagctgactgcttttaaaatttagtggctttaaaataacaaccatttattattcttcatgagtctacaaatgaggtgggcagttctgctgatctggccaagctgaacttatctcagctgggcacattcagcgtatctgctgtcagttggctggttggctgtagcaatgaatggtgaaagtaggctgcccttaactttttcacacagtagcattagagttacaaaagaaccagcagaaccatgcaaaactctttaagacctaggcttggaacaactatatttctaccacattctattggtcaaagcaaatcacggggctagtctagattcaagtgggtggaggagctgcaattacactgcaaaggagtgtgactgtagggagaggtgtttttttatttttatttttttgcgatttgtcacagtagttgtaggaatcaggtgtatttaaaattctgatccttctgtgatatccgaattgttcatgaaccttgcctctggtggaaaggcagaatcattgtgacagaaggataaaatcttggaatttagagactaacaaaggttcagattccagctccatcacttatttctgcaatcctgcagaagttaatcttcctgataggcattcagtaatgattgattcacctgaacctcagattctttatgtattttaaagaaagggctaggtaaatgcaaagcacttatgtaactgcttttattattgcaaacctggctcccacactccattcaaggtgtaagactcagtgtcttccttgaattaaaaaggaagagaaagtgtgttagggaaaggaagagaaatatttgactaattgtggccccaataaagtgaccactcactgggggtattttcctgtaagaaaagaatggttgaggctcagagttaagagatacaaatccaaaagtctccttggggtaggattccctgtgattcatgggttgagaggtgtaacattagacacagtcccagtctagattttttttttaaagaattgtggtccatcctatacacactgggtgccttaatactatatgtggcaattatcactcctataaatcaggttttacataagataggaaaaagaacagtatcattccacattaacaattgaaagatgactgcttttaaaaaattaaaagggccatatagaaataaaatcacataaatttcttgtgttaaacatagttgtcatattggatgaggactaaacacctaaattcatccaactagtagtaatagaaaagatgaaacacacacacagtaaaactagattaatttaatttatacaaagggccagatatctcagaattcagacagtcagagatgttgactagagttaatgcctcttttaggagaggtaccaggtaagtgttctcaaagaactggaaactgagaccaccacctctggcattatctatttgtgaacacaagcaagtctgaatttttccgcaccatagctacctttcatgtaagcttcttttcttagaagaaaagaaggtaacatttgggtgtaattttttattaagggtgaaatttagtgtagagagtaaaggcatttggcatagaagcccttagttttttttgtttttaagttgaactgccagcctttatggattgcagtcttcgctgttttgattgacatttcccaattcattttgtattatttatttttttaagagacagggtctcactctgttacccaggctggagtgcaatggggcaaacttggatcactgcagccttgaactcctgggctcaagcaatcctcccacctcagcctcccaagtagcttggactataggtgtgcaccaccatccttggctaattttttaaatcttttgtagagacagggtagtgctctgttgcccaggctggtctcacattcctggcctcagttgatgctctggtctcagccttccaaaatgctgggattacaagtgtgagccactgcacctggcccccaatttcatcctttacaaagactactttcaaccataaatcaacggaaacttcagctccctcagacatatttgggatccaaggatattttcccaaatgattaatgctaatttcatatcaatacatttttgcaaaacctacaaaaatggactagtaaagaaagactcttaatttgggaaagacagttacttggagagaagagaaacttaagaggcaggtcgagttcagtgttcagaaatgagaggatcataaagagatagccataaaaatgtttctccctatattgcctgctgatagggtgtatcagtgaaggtcttactaaggaccttgtaccttttcagcgctgcactgcgtgctcatagggaggaaagataaatcatgtgttttttctgacctcaaaggagcctgtatctggctagagagacatgatgcagacacatgaaataattaagaaacaattaactgtagcaggtgctgaagaatataccaggaggtcagagaatggtagagctagtgtgggcgaaggtatagcccagagcatcatcagatgattcttccttatgcaaattcacatctcctctgggtcaagtatcatcctggcatgcagcagctccataggtaatgccctaaggctagcctgaggcaagttgcaaaagccatcatattgagtcatggcctttttttgtgtggggggaggggaatggcatccccttcctgtctgccaaatcaaggaatacagtgccctcctaaacctgctttgttttagtggattgttaaaaagaagtgaatgaatttatgcttcattagggaaaggttacagtggaatactgaggagtaaggggtatttctatttaacaaatgacataacttgaaggaatgaaatcataaggatggaatttcaggcattaataaaaagctgatgagagatactttgagacaaaagagccttcccagtgtaaccgagatcacagcacctacttcacatacacaggaaaccagtcctatctgtctctcccatagagcagtagctgccttgtttttcctccctcctccatcattcattctaaatctccagtcctccaccgcaccttatccaaaccctgatacccttaagtcacagatggtgaatcagtcaaaagtagtattaaaaactagtggtacacagctacacctggaatgcagtaagaaaaatacggatttctgtacatcatcttccctccctgctcttacccccatttaagagttacagggtcagaacccaagagtctgagtttttgaaagtccctaaaaattttggatgatcacctacatttagaaccactgcactaagaaggacaacaaatatgccaataaattctgttgccaaggaggtgattatgcaagctggaaccctgataacatgaggagaatcccacaatagccaaatagtccatgtactagttacattataataaagccaaaagcagcaggcctacctgactttctcctgaggtctatcatgagcttagagagaaggaacgtggacatatagaggtagctctagatggagaagggcactaggtgtcatggaaagaatcatgtgcaagaagtaaagaggtgctctgaatgtcctagccctgcttaggtgtctgtgtcctcacatgagaatttatccacagttctttcccgctgtaacaatctttggttccaactgcatttgtgagacagcaaaaagctatggtccagtctccttccattgtatcatctcatcaatgtatttctcccactacccttgtgtgaaatacaaacttttttggcttattgtgattatgcaaggtgtatgccaactttttttttttctccacatctttcagctttctgatgggtaaaaattttccttattttgctttagaaaaattctcattggcatagatctaatttcagggagcctcccttgaaagctaaataacattgagaattcatgaaaatataatgtagagcattatgcctgttagcatattagtttaaatagaagtggttcatgaaaatttttgaaatgccagaccctgtcctgtgttttgtattctcccaaatactcatccagatactgttcagaatgtaacatgattattttgaaataaagattttcccctagtttttaaaaaagttactttatacattaacccttatgttcctctttgatcaatttttccagtagtgtaaacagtcttcagggaagtagatttcttacagaaattgtcaagtggctctctgctgttagcatggttactaatcttttggttacttttcatattttttatactttctggaagtggacaacttacttgtaaataaaagtgcataatttgtattaaaaatttttagtaacaatctaatttgtaaaatagatgtgagcagcatgaatgtgtgtgatatgcgtacatacgaattatgtctcttaaaaatgtatcacagacatctttccgtgtccaaacaaatctacctcattctttctaatagccatatgggtataccataatatatttaactaggcccctattaaaagaattttgactcttttgtagctactatagtgttgcagtgtgtatctgtgtatgtatctttgtgtgtgtatctttgtacgagtgtacatatattttccccttggctatttcagatttttttttaggtttaaatcttaggaaaggttttgaaattgtcttaagtattttcagaagcattaaatcatggtttttttacatttttcttttagaagttttatgtcatctctatgagtagctttcagtaatttgttctgcataaaattcccgaaaacttccatttaaaaataggtggcatgactagactttctcagccgaaagagtgaggtcccaggaaggattttggagaagctgtgttcaaatatagctgctgacctgatgtctgcctagagtctggcaaggtgatgtgttgaatctagtgtctgcctgcatgccagcatccctttactgatgagatttgtggttttcatcacttcatggtaattatcccaagttataagatggagtctctagaaaatcagtagagtatgaaggcccaagtaaaatacatgtgagtgcatgtatgtgtgcatacaaattacttctcttaaaaacgtatcctgggcatttaaagaatgaggacctccgaaggattttgtggaagctgtgttcaagtacagctgctgagcgtatgtcagcctggagcctggcaaggtgaagtgttgaatctagtgtctttttgactcactgttttttttgactcactgtgctttgaagcccttgtcatttgggctcataaaatagatttctgtatactgtctctcctccctgccctcgcccccatttaaaagtatagtggcagaacccaagaatcagagttactaaaaactctctagaaaatttggatgatcacccacctgatcatgtcttttttactcactatgttttttttttttttgagacagagtctcgctctgtcgcccaggctggagtgcagtggcatgatcttggctcactgcaagctccgcctccctggttcacgccattctcctgcctcagcctcccatgtagctgggactacagggcctgccaccgcgcccggctaattttttgtatttttagtagagtcggggtttcactgtgttagccaggatggtcccgatctcctgacctcgtgatccacccgcctcggcctcccaaagtgctgggattacaggcgtgagccaccacacccggccctttactcactatgtttttaagcccttgttttcatttgctccactgtaaaacattccccaagccaatctggagctgaggcaaatttttaacaatttaaaatctggggaatataaatattggataatgatcatcctgaaaaaacaatgaaggtagtagcataatactttatatatcaataaaatggcaaaataagacagttgttgaaggacagaaagagtaactgaagttaggagcttatcttaacacattttttgtgtcataccataggcatcatattttttaaattttttttatttcatacacataggaaaatatatgtgtgtaagaaataataaacacctctttgtacctaccacccaacttaaggaacagctcattgctattccctttggtgctcgctggatgccctttcccagtcacatccccctcccttcccatctgcaggactatactagtaaattttgtattttttgcattattttgctttgttttatgattttactacctatctacatatccctaaataatacattatttagtttcatatgttttaactttatgttgtggaatcacattaaatgtagtcttttttttttatattatactttaagttctagggtacatgtgcacaacgtgcaggtttgttacgtaggtatacatgcgccatgttggtttgctgcacccatcaactcgtcatttacactgggtatttctcctaatgctatccctcccctagccccccaccccccgataaatgtagtctttataacttgtttttttaactcaacattgtttgtaagattcatccatgtaagctgaagcttttttatagagatctttgttaagccttttaatgaatacagtacatacatttctctgttcccctgttagtggacacttggattgtttccagagttttgctgttttgaacaacgctgctgtgaaaatgtctcctgaaacacatttataagagtttttttttccccaagggaattatacctagaaattgaataactagatcacaaggcatacacatctacaacttctgctaggtaatgccaaattgtttccaaggagcgttagaagtgttctcatcaacttttactagtgctagtcttttacatttgtggcagtatggtgggtgtgaaatatttatgtttagtttttcttggtgccatttaataatttttataaaaaatatttagaagtcaaggcagttttttgtttttgtttttattttttgcttgttttgttttaatgcagacattgagattacgacttggaataaacattggttgcaaagttcctaaaaggaaaactttttttggtattctggagcttttctggtactgaataaaataagtatgttaaattatgcatgtgtagtttagaagtcagagcaataattgtgattgttgaacagaatggcagtaaaaagtttctaaacgattgtactgtacaagggacacttgttgtgggtcagttttagcctccccaacttttatgttaaaagttgcaacaaggtttaagggcttatgtttgataggccagatggtgaccagctgtgataaaacacagggaacccttgcaaaggatttcaaaatttatgcagtagtccgccttatctgcagttttgctttccaaggtttcagttacccgcagtcaactgtgttctgaaaatattaagtgaaaaattacagaaataaagaatcgaagagttttaaattttatgcttcccacccatcccacctgggatgtgaatcattcctttgttcagcatctccatgctgtaggtgctgcctgccccttagtcacttggtagccatccaggttatcagattgactcttctagtattacaacacttggcttcaagtaatccttattttacttcatagtggccccaaagtgcaggagtggtgatcctggcaattcagatatgtcaaagagaagctgtaaattgcttcccttaagtgaaagatgaaaattctagacttatatataaagaaaagaaatcatatgctgagactgctaagatctatgataagaatgaatcttttatacatgaaattgtgaagaatgaaaaagaaatgcgtgctggttttgctgtcatatctcagactgcaaaagtttgcagccaatgtgtatgataagtgcttagttaaaaggaaaaaggcatttaaggtaagtatatatagtgtttggtactacctgtgatttcaggcatccattgggggtctcctgagtataaggggagactactcttttagtgttaaatgaacactaaggaacagagatggggaagaggttggagaagattagttcagcagtttgagtataggtaaacagttgtttgagaaagaagaaaaatgtgattagtattttaccttagcaatagtggcatagataatgataaattatagtcacacagaactcttagtatttacagaacgttcacatttgtgatcccatttaacaataactctgaaagaaaggtatcatctaccactgctttattgataaagatataaaaggtaagagagatgaaacatattggccaatgatacccatctggtaagagacagggatggggtgggaccccaaggctcttctcgccaagcccacggtttttttgctttatacttttttgcctcctgatcaccatggctgcagtttctactgtggacaatgtctgtcagcaagcattgatcccctgccttcagcactcttacgtcttagcaaggactggaaagaaaaagccaggagtttacagtctgctggagcaacagaaaagaatgatatgaaatatgaagagaccaaaatgatttataataaggtgctagactatgtagtaaaaatctgctttagctgtaagtcaaaagcaagagcagtcttttcagaatggaatagaaatgttggaattaaaggaattttcaaagttgtgaatttttttcaagataaacatgttttattttggtaattatggtattactaatttgataaccttcagggagccacctaatattatagaagatgtacatataatgacaaaagcaaacattttatttttaaggaccacaatctaatctaaaacaaaatttcccccttttctggtctttggttaattaaggacttatttaaatatcaaagaaagacacatagaaaacatttagtatatttctatacttttattaatgtcctccataccttacacagatacttgacttggctatggtctagataatccatgaaaatttaaaggacagattttaacaactttatgctaaattgatagatctctaggatcagattgccatcactctcagatgcgaagcttccaaccacttataggttcctgatatcttgcttttatacagacctaatttctcttcctttaaactttcttttcctcagttgctatttgattgaaatattgagtcattaaaaatttccaagtgggaatttttgtgtttctgcatctatcatgaagctgctcaaataagtaggtgtttgaataggagtagaaacagtaataggctgaagccagaccaatacagcttcagctaaatgccgaccttgctaaagtctgggaggaccggtgtggtattctacaatgtacaagtctgtagccggtgcccttaatatgttggcttcatgtctcatgactctcttctgtaaatatgcagtttaaaaaatacaagttattctgctgtagaagatacatttgcaaaattgatgtatcccctctaagtaaagttggctaaacaataaggacatatttataattaatgaatttgagaagaatgctgacgatatgcattattctttgaagttaacatttttcaggtcctaaataaacaaaaagtaggttacttctgtctggagtgtatgcaaggggtaccatcttgtccttggttcctggctgctattccaaggtgctataaagtcagctaaagagagcaatcataatacattgatagcatccctcaatgtgtttctgagctacttgagaatcttatttttgaataggtagcaggaaaccatctttgcagggcagcatgggcaaagggattggagggactattattataaagatccactgaactgcttcagtatcataatatcttaaactaaaggactggaaagagccagattccaatttaatctgctcttctatgaattcttagctgggttcatttaaaaagaaaaaacttgaagattgcaagattttgaagacatcttaaaataggtgaactccaaggtgcactttaaacttgagactgataactgaatactccttcaccttttgatctgatattgtcaaaatgaatgaggacttagtgctctagtaagtttggaacagaatgatattaatttattttctcatgattgattcttttttgctttttaatagattaaacttcaccgtagaacagtttctcaacctctggactattgacatttttgattggataattctttgctgtcagggctgttctgtgtgttgcaggatagttagcaacatccctgacaatcacaaatgttactttctgtctctatggatttgcctattctggacatttcgtataaatagaatcatatatatgtggcttcttgtacctggcttatttcacttaacatgttttcaaggttcatccatattgtagcatgtaacagcacttcattttctttttatggctgagtaatattctgttatgtggatatactaccatattttgtctatccactccttagctgatggtcttttaggttgtgtccattctttggctattataaataatgctgttaagaacattcatatacaagtttctgtgtagacatatatctttatttctcttgtgtggatacctaggagtagaattactggatcatatgataactctatgtgttaccttttgaggaactgccaaacatttttctacagtggctgtatcattttacactcccatcagcaatgtataagaattccaatttctctgtccttgcctatatttattaactgtcttttcttattagccaactgctgtggttcgaatgtttgtcccctccaaaactcatgttggaacataatccccaatgtggcagtattgagatgtgaggcctttaagaagtgcttgggtcatcagaggtctgccctcatgaataggctaatccattcatgagttaatgtactaatgggttatcactggattgggactagtggctttataagaagaggaagagaactaatctagtaagctcagccttctcactatgtgattgctgccctgtgtcaccttgggactctgcagagagtcctccagcagcaagaagttcttcatcagctgtggccccttgaccttggacttcccagcctccagaaatgtaagaaatccatttcttttttttaataaattacacagtctcacgtattcagttataccaacagaacacagactaagacaccatcctattgggtatgggtatctcattgtgttttttatttgtgtctcccaaatgactaacgatgttgaacatcttttcatctgctttttggacatttgtgtattttctttgaagaaatgtctttaacattctttgcccattttaaaattaggttgtctttttattgttgagttgtcggtgtgtgtgtgtgtgtgtgtgtgtgtgtgtgtgtatctagaatatatgtgtatgtatatatgcagatatattctaaacactagacccttatgaaatatataatttgaggacaatttctcccatttaaaaggccatcttttcacttcttgatagtgtcatttgactcacaagtttttaatttttatgaagtccaatttattttttaattctttgtttttggcactgtatctttaaaaagttgcctgatctaaggtcaaactgattttcacctatgttttcatctaagaattatagttttagctcttacatttaggcctttgatccattttgaattaatttgtgtatatggtgtgaagtagggctctaacttattcttttgtgtaatgatacctagttgtcccagcaccatttgttgaaaagattattctttccccattgaatggtcttgataccttgttgaaatcaactgaccataaatatataggcttattcctggactcacaattctatgagtctgtatgtctaatcttatgccagtaccacactgttttgattattacatctttgtacaaagttttgaaattgggaaatgtgagtcttccaactttgttcttttttaagattactttgcctatattccgtgttcgttgcaaactcatatgaattttaaatcaactctccatttctggaagaaaaaaagaggcaattgaagttcagatagggattgcattgaacctgtagatcagtttggggaatattgccatcataacaattagtaggtcttccaacccatgaatacaagacttctttccatttctgtagatatttagtttctttcattaatattttgtagttttcaatataaaagtcttgtacttcgattaaatttattcttgaatattttgggttttgatgcttttatgaatttgttttcttaatttcactttaagattgttcattgctactgattagtaatgcaactgatttttgtgtgttgatttttgtatcctgcaacctagctgaaatcattgattagcataatagagtatttaatagatttaggatttctatatataagatcatgtcatctgcaattagagataattttacttcttccctttcaatctggacattttttacttctttttcttgcctagttgccctagctagaacctccagtgcagtgttgaatagcagtggtgagaatgagcatctttgtgttggtcttcatcttgtggggaaacctttcagtttaagtgtgttgttgtggggttttcatagttgtcctttatcagattgagaatgttcctttctgttcctagtttgttgagtgttttctttttgattgttttaatcaggaaagggcattagattttgtcaaatgctttttctgcagctattgagatttttgtgtgtttttctggtcttttatggtttatcacattaattgattttcatatgtcaaacaaaccctgtgttcttgggtttcatctcacttggttatggtttataatcctttttatatacttgtagattcagtttgccagtattttgttgaggatgcttgcatttatatttataagggatattggtctgttgtagctgaccagtaagtatagtaagctgtatagtttactaagtgttccctctgttttgggggagactttgagaagaaggattgttggtaattgttctttaaacatttggtaaaattcactagtgaagccatctggggtcttctttggaagttttttgattactaacttaatgtctttacttgtttgttataagtccattcagatttttttctccttgagtcatttttgacagttggttgaggaatttgttcatttcatgtagttatctaattggttagtgtataattattcatagtattcctttataatcttatttttttgctgtaaggtcagtcataatgttcactctttcatttcggattctggtaatttaagagtcttctctccttttttttcttggtcagtctagctaaagtaaagttttgtccgttttcaggggaacagctttttttttttttttgaggcagaatttccatcttgtcacccagtctagagtgcagtggtgcaatctcggctcattgcagcctccgcttcccgggttcaagagattctcctgcctcagcttgccaagtagctgggattacaagcgcccaccaccacgcctggctaattttttatatttttagtagagacggggtttcaccatgttgggcaggctggtctcgaactcctgacctcaggtgatctgcctgccttggcctcccaaagtgctgggattacaggtgtgagctaccgtgcccaacccagctttggttatttttgttgacctactctattgtttttctcttctctatttcacttatttctacactggtctttattattttcttccttatgcttgctttggacttagttcttctttttctagtctcttaaggtggataattaagttcctgatttgaattcttacttctttgtaaggtggtcatgtactgctatgaatttccttctcagaaatgtatatgctttcactgcatcccttaagatttggtatgttgtatttttgttttcatttgtctcaaggtatagtcttctgatttccattgtgatttcttccccctctaacccgtttattatttaggaacttgttgatttccacatacctgtgaactttccagatttccttctttgttaattctcagtgtcattccattctggtccgagaacatactttgtatgatttctatcttttaaaatttatttggcttgtcttatgacctaatacattgtctatcctggaggatgtttcatgtacacttgagaagaatgtgtattctgcttttgttgggtagagtgtttgacaggtgtgttggtacatagttctgttcaaatctgtttccttgcagatttctatctagttgttctgtctattggaagtaggatattgaaatctccaactaatattgctgaattgtttattgttttcttcagttctgtcactttttgctttatatattttgaaattctattgttaggtacaagtaagtttatgattattatatcttcttgatagattgattcttttatcattatacagtgccctataagaacaatttttatcttaagtctatttgtctatattagtatagccacttcagctttcttttgtttactgtttgcatggaatattttcttcttttactttctatttgtgttcttgagtctaaggtgaatctctgtagatagcaattggatctgccaatctttgctttttatttggggagtttaaaccattgacatttaatgtaattattgatgaggaagattacttctgatattttgccatttgtttcctttattttgtgtctcttgttcttaaattcttccattactaccttctttcttttgtattacatattttctagtgtaacgattttaatttctttgtcatttcttttgttgtatgtttttagttattttcttagtggttgccacggagattttattgtcattttaacagcctaggttgggcacagtggctcatgcctgtaatcccagcactttgggagactgaggcaggaggatagcttgagtccaggagttcaagaccagcctgggcaacttactgagatactgtctctacaaaaaaatacaaaaattagccaggcatggtggtgtgtgcctgtagtcccagatgcttgagaggctgagttgggaggatagcttgagcccaggaggttgaggctgcagtgaactttgatcacaccactgcactccagcctgggtaccagggcaaaactagcccaaagaaatgaaggaaaaaaaaaatctaatttagattaatatcaactcaacttcaacagtgtataaaaactttgcctctgtatacctcttctgcttccactctgtgctgttattgtcatagattttcatctttctacactgtgtgtttatcaatgtagatttaaaaatattgcttagtagttgtctttagaatccgatacggagaaaaggagatataaacaaaagatgcatttttactgtcttgtatgtttacttatgtaattccctttcctgatgttgtatttctaaaggcaaagtagggttattgtgagtgtccttttgtttcaacctgaaagactccttttagcatgtgttggagatatgctaatgatggactctcacagtttttgttatctgggaatgtgttaatttatccttcatttttgaaggatagtgttggcaggatacagaattcttggttgacatgtaattctttcagcattatgaatatgtcatcgtactgtcttctgacctccatggtttctgataaggaatcaactgttaatcttattgaggatcacttgtttgtaatgacttgcttgtcgtgctgctttcaagattcattctttgcctttagcttttggtagtttgattgtgatgcatttaggtgtgtactttattagtctgttctacttggagtttgttgagctttgtagatgtatttcatcagatgtgtcaagttcttttgccactattttttttttaaataatctttttgcccctttccgctccttctgtcactctgattatttgtgtgttgctttgtttggtggtgtcccagaagtctctgagactctgtccagttttttcctccccattcttttttctttcacttcctcagactggatgatctcaatttgacctatcttcgagttcatggattttctcttctccaagtgacatctgtgagatgaatttttttctagagaatttttcatttcagttattctacttcaaaatttctctttggttcagttttatcattgctatctttatattattctcagtttaatgagatactgttttatactttcctttagttctttagacatagtttatgtcactgaatatatttaaaatagctgattttaagtcttttttttttatttttttggagatggagtctcgctctgtcacccaggctggagtgcagtggcacgatctcagctcactgcaagctccacctcctgggttcacgcaatgattttaagtctttgtctatgaagtctagtatctgggcttcctcaggcatagtttctgttttctttctttcttttcctgtgtacttcgtttctttgtataccttgtaattgttgttgttaactggacattttgaatattatagtgtaacaactctggcagtcagactgtctcccctccccagtatttgttgttggtgagtattgtagatgtttgtttagtgacttttcatggctaattctgtaaattttatattctttgaagattgtgggcaccctgaagtctctgtttgttagtttagtggtcacctaataattaacagagatttcattaaatgcctagaagcaaaatatcttccagtctttgcccatggcctctgtgtatgcattagggcaggccttgaactcttacccagggagtttacaaccctgccttagcctttactaccagcttctgcagagcattaaggtcaacaggtggtgagagtttggagcctactccatctttcctgagcatatacacagccctactcatgcatgtggccctctagatttccaggagtatgttggaccctttcaaagcccttacagactccccagcttttcctctcaatctttagactagtgtgttgttttcttcaacagttatctgtcaggcagcagcaaattaagagattagcataaatgttttcaactcctccacccgtcatgtgccccagggaagcactaagccagttctaagttaggcaaaataaagacaatccttttgaggtggtcttccatggagtcaccagacaggtaaaccaaataattaattacaagtctttggctggatacagtggctcacacctgtaatcccggcactttgggaggctgaggcaggtggatcacaaggtcaggagattgagaccatcctggctaacacggtgaaaccctgtctctactaaaaaatacgaaaaaataggtggctgtggtggcgggcgcctgtagtcccagctactcgggaggctgaggcaggagaatggaatgaacccaggaggtggagcttgccgtgagccgagatcacactactgcactccagcctgggtgacagagcaagactccgtctcaacaaaaaaaaaaaaaaacaagtcttcatgaaagaggtccattctgctgtctttcataccaggaatgtggaatgtggactgttattttcatggctactgctaagctaggaatcaagggatagatggggactgggtaaaacaccacagagtttgctgttcttaccaagaataagctggggaagagggttgtttttgtttttcagtaaaaattccctgggctgcttcaagccgttgattaattttcaggttccgaaaaagttcagtttgacagtttttgccctttttatttgcttttatggatatgtagaacttgagttcttttttccaccagttttgctgacattgttttaaaagcactttttgtaaaacccaaatgttgtctctctcaaggctagccaataattaaaaatactgttactcccctttgattttggaaatgaattcgtattgaccaaaattcaatactagaggtctttcaagctgttttaccatttatctaaactttagaatctaatgattcctgtacattgtctagcatactggtggtcctcaattgtcataagttcaactttggaacaaatgaactttttgtgtgcaagtttccaattgtttggaaattacattgatgccccctccatcaaactgttattcgtgggacatctaggaatttcttacagcagctgacaaatatttcaagtcagtgcctggtagtactgtccaccaggcaacagcttcagtagtagagcgatctttatctataaggcagtgtttgagcaattgtttattagtgttttcctaactactcagaagaactatcaggggttatagaggtagctcagagagttgggtgcaagtagagaaatccacccggcttgcattacacatcttatttctagagaagctttcctttgaagaaggagttctaaggtttaaaaaattaccttgaatgccacttatattgcattttaattttattttagagaaatcaatggaaagtagaaaaattaaggcactgatactagtgttaagaatgttggttaaagcttctggcaattaattttttatttccttttttaattttattaaaatttaacaattttcagtttatgctgtaatccagaccaaggtttcaatctaatgaagttaatgccagtgttgctgctacctattttgtctttagtcattcagccatgcttcctacttatactgaataagctagcttaatctaacaatcaaaaaagaaagctgttgcctaagttaagaaaaacagtttgaactgttttcaaactaaatacccagtagactctctagttgttgacaggagaatgcttaattcagaattgtcctgcagtagatcattttatctcattcctgttcttctataggatagcttatttgtttgaaattgtatttaatatgttgtgatttttgtgtgcttgtttctatttttcactggatagactcaagataaaacctggtaccctgcagtgtagctatcagtttatagcagaggaaatttacattagaacttggctgtgtatttacatgtatctaacttggaggtcactctgcttactgttgatatatcagtcatattagatgagtccctaatgagataccagaaaccccggaaacatcattaggtggaacagtgtccttaatgctttattaagtgttataggtaagacaaagcctagtactatttgtggcatcaaggttaggtgtttaaagacctgtattcttctattgtcatgttgaaattgttcccttgatgtagcaatagaaaattttagattaggcttaagttaatcagcaaacaaagataaaagtctgatactatcctaaatattttgtgtttctaaataatttaacagtgatccaattagctactcctgtagaaatgtaattgataaacttttcactctcttttaaattgccatcttgaattttacctgttttttaaagctgtctcaagtcctctctaaaaaaaggcagtcatttataaatttagaaaagcttgatagcacagaaagtcacagaaaaatgtaaacatagtttaaaactgaattgtatacaagccactagaagtacttttattaagtttacaaatattagtagagtggaactcatgcatttaatatgtttgaaacttttgatcaaatactgtgctatgaaaaacattttagataattattctttaatcatgtgtgtgtaaaatgtggctttttttgacaaccaagtagcttttctgtgtgccaaactgtgactttaaaattttaaagtactcaacagagtaaacaaaccacaaataccacttaaactgtacacatttgcacatgcatttcctataaatagtacatgggtttcaagtcttcacttttgaaattcagaaatgggttttttctccttccagtagaaataaaaacttgatttattttatttatttatttattttatttttgagacggagtctcgttctgtggcccaggctatggtgcaggagggtgatctcagctcactgcaacctctgcctcctgggttcaagtgattctcctgcctcagcctgccgagtagctgggattacaggtgcctgccaccatgcccagctaatttttgtatttttagtagagatggggtttctccatgttgggcaggctggtctcgaactcctggcctcaggtgatctgtctgtctcagccttccaaagtgctggggattacaggtgtgagccaccgcatccagctaaaaacttgatttttaaaaatccaaatcgaagacagaattgtgtattttagtacatttattagcagccttgacgctataccatatggctgtttatcatttaaacagcttgtaaaagcaaacacttcaggattcatgagtggcagaaggactgagtactttgggaaataagagagaacttttgttgaggatggttgaggaagagtccaagacaataataggcagaataagcaaaaatctagagactcattgtaggcactcaagtatgtatttgttagaatgaatggctgaacttggtatattgaggaacactgagaaagccatactgactggaagatagttcctacaagaaactggtgagacatatgttacagtctagattttggtgagccttgttaaagtttgggctttatttttatacggggagaaagtttcacaggggtttggaaatgaggcttggagctgttaatggggacacagtgaggttttagggtagtggctttcaaactgtttaaatccaaactttgatgataaccctgacataactattgtttataacttccatttcagttgtattggttttatcaaaacatcttcattgatcttactgattgcttcctatgcagattaatattataaatttgaatgtacaaaggaagctttagcagtaaaatagcaacttttatctgtcttacgtattggaggttctgcataagatttaattttttttttttttgaaatggagttttgctcttgttcacggggctggagtgcaatggtgtgatctcggctcaccacaacctctgcctcccgggtttaagtgattctcctggctcagcctcccaagtagctgggattacaggcatgtgccaccatgcccggctaattttgaattttagtagagacggggtttctccatgttggtcaggctggtctcgaactcctgacctcaggtgatccgcctgcctcagcctcccaaagtgctgggattacaggcgtgagccaccgcgcccggccaagatttaattttttaaaagaaaatattttgctaagggtttggaaactcttgttttagcaagaatggattaagactgattaaaactaaaggcaaagaggaggctcttatgtttggaattctttgctaatatttacacaatataattctctccacaaatatttaatggtaccagatattagatggttataatggcaaaagtgttcaaaggatgctatcatattcatgattcatgatcaaaatgaacattataaggctatccctcttcagaattaaatacgttactcctgtggaaaacttgcttttaatgtagaagttgtcccagagcctttcttcctttctcatgtcctcttatgtccactgctgagctaacatgggtctcactgaatgattaagaaaaaacatcttaggtggggagttctgtatatagtaaatgtttaatttattggggtggtgaacgggaagtgctgctggcaagagaggatgggaagagaaatctacccaaatccttacccgctttacagaacataaacttcctattcagtagtacacaataacttaacgatcaaggcatcttaacttttctgttttcagatgaaagaactatcgtttggcttgatcaagtatttagtatttattcgttcactcaagtgcttacgtttttttgttatctcagggttttacgttagttattaaccaaaagaactagttttagttctggaagtctaaaatatataagagaaggtgaggagtaataagagaagatgaagggagactttcggaatggcctatgaacttctagtaactataccaccttaaaatagacaaattacaatgcagttatgaagatatgtatttttcagtgaagacaactaaaatgtttgcacagaattttcttttttattgagtgttagaaattctattttggagatactaccttgcacaacataaaaagaaaaagtgagtgtggaatctaggaatctacgtggctctaggaaattttttaagtgtggaaactgaaggagagcaagagaaagggagcatggcattcccctgtttgtagttcatgaggtgggtttaaattgccttttgccaatgcagctgcacactgaggattacagaattctttttaaatgtttgtagaattatttttcacttattaggtaaaacgtgtattttttgattttctccaatttcagctttctcatgttgctatgctcaattttgtataccatatatagttttgttaaattgacaaagtggtgttttttgttcttctttttcccattggttaaaatttaaagagaaagtggaagctagaaatttatctaaaaaatgtaactttccctgtaattattaaagtatcaatctaaatttgaattttctttgtgcataatcttttttcaagctatttaccatgttgacaaacttgctttcctgtggcaaatacactagcaatacgttataaatatgtaactttcaacctatttacagttgatgcttttttagccctttggatttaaaatacaagcactgaagaggtgaggaagtaccactgctgcctcagcattatttcgaaattctgtttataaactatacaatttccaaggtcatgaatccagcacctttccaggtactaactattgggacaaagatagaatttgattttatttatttacctattgactgaagtctaacttaaatcttgcacctagtaagatcttagaaataacgtgtgtactctgacctgtaaactaatcctagtattctgtgtgtatattctttctcatttgggctcttaaaaggaaaagtaacgtacatctgatgatcattagcactgagctttttcagcaaaaagtatatgtttataaagaagtataggataatttagtaatttaataatgtgacaacatttgcgtgtgttttttttttttgagaaatacaaattgtgagaaacagaaaagtaaaagaagcagcagcagaaatatcactataggatcaaaagattgcaggaaccaaaactccaaaattattgggcataatgtactaaaaacagggcagtggaggaaagggacagtccagactagctctgagggtccaaagaaagtattaaatattgttactggagtgatttgctctgctatttgggcttgggaattaagtgaaattgttgatatactagacagatacttcccacccatttttctcttgataatcagggttcattttttctattttctatttctctggatgctccatttcttaatattaatattaatattaagctctcagtctttatgctaaaaattggttatttaaaacaatttaaatcaacttcagtctaattggcttaagttcaaatccattttaagatcgatattgtgtcctttaaaaattttatttaaaagatatttaaactgatgagaggatactacccattccactgataaactattactgtaagtttgtctattgagggctagttatttggtttaaaaatgctgagattatggaaagtggattggaatattttggagcaatattaaaaacagtatctgtaacaatttaataaacttataaattcctctttctctgttgatctatcttgaaaagacactctatgtctctaggcattccttctctgtggtgtgattggtagacagggagtaaacaacttactgtaaatgggcaccatgccagttggcttcaggcagcatcaagcttgtgactcacagtcagggttaggaaaatgccttttaacttgtttgtctctgcctcttttaaacattaaaggcacaactgtactaattattaagtatttcataaggtcttttagggcttataagatcttttaggaatggcctggaagttattagtactgtttcattgaatctgaatacctttaacatgataatgagaagtttttaaagggtggttttatagttaaacggaatttctcaaattggcttgctccttatgttgatttatttaggatcacatttgggagtttctctgccctactttcaatgtatttaatttactgaccatcactatttggggggaaaatgttatatgatatttagaaaccaagagttttggagtttttcccccattagatgtatttatttatttatttattattttttaaagacagggtcttgctctgtcacccaggctggagcacagtggcatgatcctagctcactgtattcttgaactcctgggctcagactgtcctcccacctcagcccaagtggctaagtatcaagtaagaatcacctggcaaattccaaggctgtataccagatttcctaaattagaattttggggttgggtatctgaattttagtaaagccctccaaatgtttctggtattgcttctaagaacaattgataacataatagctgtggccattataggggtattctgtcatatttagatataggcataccttgttttattgtacttcccaaatattgcgtgtttattttgttttgtttcacttacaaattgaaggtttgtggcaaccctatattaagcgagtctgtcagtgccatttttccaacagcttgtgctcattttgtgtctctgtgtcacattttggtaattctctcaatatatcaaactttttcatcatttttgtatctgttacgaccagtgatcagtgatctttgattttttctttttttttttttttttgagacggacttttgctctgtcacccaggctggagtgcagtggttcaatcttggctcacagcaacctctgcctcccaggttcaagcaatcctcctgcctcagcctccccagtagccgggcctacaggcgtgtgccaccacgcctggctaatttttgtatttttagtagagatggggattccccatgttggccaggctggtctcgaactcctgacctcaggtgatccgctcaccttggcctcccaaagtgctgggattaccgtgccagcctgatgttactattttaattgttttcaggcaccataaacctcacctgtataaggcaccgtacttaattggtaaatattgcgcatgatctgactgctcttccaactggccattccctgtctgtctccctcttcctgggactctcaaatccctgagagacaataatattaaaattaagctaattaataaccctacagtggcctctaagtgttgaagtgaaagagttgcatgtctctcactttaaataaaaagctagaagtggctaaacttagtgaggaaggcacatcaaaagccaagacaggccaaaagcaaggactcttgtactaaacagctaaattgtgaatgcaaaggaaaagctcttgaaggaaataactagtgctactccagcaaacatgtgaatgatcagaaagtgaaacagccttcttgctgatacgaagaaagttttagtggtctggacagaagatcaaaccattcacaacattcctttaagccaaagcttaactctcttcaattctatgaaggctgtgagaggtgagaaagctgcagaagaaaaattggaagctagcagaggtcggttgatgaggtttagggaaagaagccagcgctgtaacataaaagtgtaaggtgaagcagcaagtgctgatacagaaactgcagcaagttatgtagaagatctagctaagattactaaataatagattttccatgtagatgaaaaagccttttgttggaagaagatgccatctaggactttcatagctagaaaggagtcaatgtctggcttcagaggacaggctgacattcttgttaggggctaatgtagttggtgactttaagttgaagccaggtctcatttaccactccaaaaatccgaagacccttaagacttatgcttaatctactctgcttgtactctagaaatgaaacaacaaagcctggatgacagcacatctgtttatagtatgcttcactgaatattttaaggccactgtaaagacctgttcaactgctcagaaaaaaatgattactttcaaaatattgctgttcattgacagtgcacctgggctcacccaagagctctaatggaattgtacaacaagatggatgttgttctcatgcctgccaacacatcatccatttgtagcccatgaatcagggagtgatttcaagtttcaaatcagtacattttgtaaggctatagctgctatagacagtgattgctctggtggacctgggcaaagtaaatcaaaaaccttctgaaaaggattggccattctagatgctattaagaatttgtgattcgcaggaggaggtcaaaggatcaacattagtagcagtttgaaagaagttgattccaacagttatagatgaatttgaggggttcaacacttcagtttaggaagtcactgcagatgtggtagaaacagcaagagaactagaattagaagtggagcccgaaaatgtgacggaattgctgcaatctcatgagaaaacgtgaatggatgaggagttgcttcttatggacaaatgagcaaataaatttttttcttgagatggaatctactcctggtgaagattctgtgaaccttgttgaaataacaacaaaggatttagagtattacataaacttaattggtaaagcagcagcatggtttgagtggattcattccagttttgaaagagtttctactgtgggtaaaatgctatcaaacagcatctcgtgctacaaagaaatcttttatgaaaagaaaagtgaaacttcattgttgtctactttaagaaattgccacagccaccccaccttcagcaaccacctctctgatcagtcagcaggcatcaacactgaagcaagaccctccacaaggaaaaagattacaactcactgaaagttcaaatgattgttagcatttttaagcaatattttaagattaaggtaaatacatttttaaagacacaatgctattgcacacttaatagactacagtatagtataaatataacttttatatgtagtgggaaaccaaaaaattcgtctgacttgctttgttgcaatattcactttattgtggtctagaaccgaacctgaaatatctcagaggtatgcctgtattaatattattttgcaagtaaaaaacccagcatataaaaaaaacgtagaatatgttgagagttcagtaatatggatgaaaatgtttttctctaactgaagaacatgataaattataattagggaaggatataaaccaagaaaatatgtctgagatagccaattcttgcagttcataatatgaaaactcattataccaatctcagtaagaatacttttaatagctgttatttctttgggatatagaatttataaagtacacagtaatcttcttatgatcaatcctaggatcactttacaaccacttaccccatattacaatgtagtaccaagacaagcagaccaaattatagaaggacaaagtttttgctaagcatattttgtcatcagcataccgcattgtgtgtgcatgcatgtgtgtgtttgtgcatgtgtgtgattgtataaaatattagaaagccaccccagaaaagttaaatgactaggaatgttgtgaagggattaagctacccctaaaattatataacaaaactctcttcatctattattaggtcatctttagaacatcttctcttaaatttgttataggtctctctcatctgtttggattaaaattggtctgaaagcctaaaatggctttttacctatataattatttcccaactagcttgtagtataggtgcaaagctatcacacttgctaggttagtgaagtatgtaaaaactaccatctttcaattaggaaccatcggatagcttctacaggattgctggggagaacctttataaagaaagttatatctttataaattttttgtcattttacttagctgagaatataaaataagttagctaataatagagtagaaatgttttctgtaacagattaatattgatcaaatgtgttattaaatgctaaaacaccattttttttctctgtaagccatgtgtttcatgccacaacacaaaagggacaattgtctgtgttttatgacagttctgttctgtcagatgctgtttgttcattttggtgaataaatgaagagagccctggacacatctttttttcctcaacaaaagaggaaaattattcttgtctgtatgtctataatcctgactctttgaatggctttaatttttttaaagtcagcatttttttataaagataggtgtttggaatgtgggcgatatggctggacagttagattgggaccaaataatggaaggctttgaacatcatgctaagaggtttgggttttactctgaaggcagtagagaaccattatgtttttaagccaggattgacttgttctaagctgtaccttagaaatattactctggcagttgtacataggatgagctgtatgttgctttgttttgtttggggagacagttctcgaagagagactacatacgaaggcagttatatgagtcattactaaaggtctggcaagaagtagtaaaagcattaactggagtggtagcagtagggaaggaaataaaaggatagatgtgggagtcatttggaaagtatgaggcaattcattgaccttacagaatcactggttttctgcttccactccattcacattgacctttccaaggttatcagtgacctgcttgtccttaaattcagtgggcactttccagtaacctactgttggcaccagccctgtgctagacaacaggatcctgtttgtaaaggcatctgccagtggtttctgtgacacaattctgtttctagttttcctccttctacttctctagcctcttggcaagttcttctttcagagtttctcagagctttgtgctaggccctcttctcattttctccttctctaagtgatcccatccttttctgttgcttcagttaccatttgtccttatgcaaaggacagccatatgctactgtatctccagctcagatgtatctctttgcctcctgacccatatttccaactatctaactgggtatcttttcttggatgagttataggtctctcaaacacaacatgtccagaataattcattgacttattctaaggcctgcttcctctttctcctgtagtccctatctcaggaaatatatggtgctatcaaccccaaagcagaaatctggacataatccctaactacccttttcccctctctgtgcacataatttcagtcattaggcctcatagattggactaaataaatacctcgcaaacccttctacttatattcttaactgctcctaccttaagccaggctaccataattttgtagctggatgactgcatcatcatcttgactggctcccttgtcatcttcaatctatattctatactgcagctagagctttcaaacataaacatgtgatcagattagtcccctctttagaacaccctagggttctcactgtcctgagtacagtctaagggtttaccatggcttacagggtcttttatgatttggtgagctttttattgtataacctttctaaactgcctttacttccctctttcttggctctgtgtctttgcataatgctgttccctatacttcacctcacgtctaaccttcatctccttttcacttctcctcttcctccaaaatccagctgaatatcacattgtcatgcaggcccattcttgatctcccacgtttgggttagatatccctcttcagtaccatcaccgcaccaggtgtgtcccctatcctagcatttgcctcattgtattacaactactgtgtactcgtctctacagctcctgctagtctaaaagttttgggagagcaaaggttcatgtttgtgtttttcactgtggtataccccagtgcctagtatatgataagctctcaaaatatttgttagatgtatgaagaaatgagaaagagaacaggaagagggtaagtttcaagactaggaaacaaggctatgaaagctgcaggaaagcagcaggttaaaacctagaagaagagtttgttttaggaaatactgtgttttaaaccactataactgaagcaaaaacccaaggcctgggtgtggatagagtccactatctgataacagtggatactgatgcatggcagagttggagaggaagagagccagattccaaaacagaaggggtaaagtcttctaagaagatagattatagtaagaaggattaggggatagaaatatgagcctgttccactcatagatctcaaacatgaaatgatgagtcatcatgaagagagtaggcaattgtccagtgaagaaggggatgctaacccttcttaaccttgaatctctcaggtagaagcagttagagaaggaacagccatcatcagatagtgttgtaaggaaaatgatatccttggggaaacctgcattttggtaaagcaaagcaactaagaaagaatatactaccactgtttaacaatcgccacaaaaagacagtaggatcatctttgacccccctcatcctttctcaggaacttggaggactaagaagagagaaatctgtagaagaggcttctctctctgatcctccctccacttcagttttaccacatgtaatgcaacaataattaagaatttgtgtaaaatttcaccaggttggcatgcatggagagaaaaattattcagatgttttcctttgtcaataatacaaggagcatttgtagggaaaaatatttacaaatacagtaagacctattctctttctatatttatgggaaaattttaagttgtgcccttgtttcatgtgtgtttctatttaaagataccatacttaatatatattgttgattcattaacattgaactcatggctaacagcactataaatcatgtctgatcaaaacttatgatacatgtactttcttcgtaaggtacatcatagtcttctcgtacatgggaactctaggtagtacttcaggactatgcatagaggccattttaaacagcaaaattcccaacaaaaagcacaaaactcaaaaaatgtgccactaaatttaccatgaaaaggacacttgtttacagtttgagagctaaaacaagaaggtggcgtgtcacttcgtttgacttcagctgggaacatgcatatcagtcgactcaaattttttgctattctgtgcttatccacgaatcgataggaaagcaagtgtggatttgggggttacaaataaaatgtagcaaatgtgtaaacttgcagatgtggaatctacaagtagttagaatcaactatgttagtctgatcattaaatcagttttttaaagtactattgtaacaccttataacctgccccattcactgagtgttgtagtttatagtttcattgggcattttcagtagttttatctgaagtcacatttcaaattttgtaattgaagctccaaagtatgctaccggaaacacgagctgatgctgtgagacaaaatcaacaggtaatccaccatcacaactgtgggctagaatgctcaagaaaccttggaggcccagagagctgagatgaatactgaagaatcataggcaggtttactctgtcaagctgcctgtattttgagggtgtagtcctcaaaccaaaaagacaccaaatgaacaaactcagatggcctcactggggaacagagattgaaagctgacactggaatgtgtacttaaaaaaatgagagcccgttttggaaaggcagactgggcacagaatgtggagagctatatttgctaactgaagaaatttagactttatcctctacaaaacaaagctattggtttttgaaggttgcataaaagctgcattttagcagcatatattttggtagagctgttacctgcctgaaaacatcaatgtcatttcacacaaatgatacttatcccttggtgtttgatctaaatttctacaatgagaatgtgattttatagtctttactggggaaggaagtaggtttttcaggccgaaattcttgtgtagcaaaaattaacacttaagttagcccttggcaatctccagttctataatggtaaaatggatttcccagaaagtcactctctatccctttgaatagacattagaaataacatgtactttaagtgggatttacagaggaagggggcctttaattctttactagtgtgatgccctgtaaaaaaataactaacattagagttgaggcctagaaatagcagcactgggttaaagtctgttttcaagtgcaagtttttctttttattcgtgtgtgtgtgtgtctgtgtgtgtttcacatagaaggaggaaatgccaatttcagttcttacaaatattaatgactgcaacttataaaaatgttacagactatattcttcccttttgtaacagatgagaagattttgaaatttagtctctactttttagtttggtaagacaatttgaataaactgcaataattgcaaaagaattctgaatatttgaacatttgacattttctatgtcaaatatacatttcttgtactatataaacattctagaaaagagagacaggcagggaggaaagtgctcattaaaaagagcttcaccctctctgaaaagggatttcctttacagtgctgtgtactaaagcctgtgttgtaaatcagaaagcactgagcacacatgttgctgctttggtagcatcagaagtcgattttcattagccttataccattcactatttctgccaagcaatcttaaattataaaagaatcttatttgattttgtgattctcttgttttctgctcataaagaaaatatcctaaattgaacaatggcatgctacgtttttagtttttaagacagctaatgtgtaaaaagacatttaaagtatagttgtgttaagtttttgaagtttacagttgtttcaattttgctgctatactttgttaacatattttaggaatatttcattttagtcacaactaggatataaacattattttggtggcgatctccttgtaatcacgacgtcaaccaaatttgggaaattttgatttgttagatttataaattttacagtaacacaaaagtctaatttcctatatattttcaaggcccctatacctttgtcaaaataaagtatcaatgaaaaatgaaaaaatcataaactatgttcaggccaaactgatactgactttgttaaaaggctagatagaaatctgttttcctcttctgttacatctcctcttctggagaccactctgtgtggactgaaggtttgagatcctaggacctaggctagaacagattaggagattgtgctgtatgttaagtggcagataccatggaattctaagcctgttacgaaggaggagaagaagaggcacaatgaccctgacacagcccctgggttgaccacagcagatatctcacttgagcaagtagatatcatctcaattgcttgctgattatctctaacttgtcagtaacttactttgataacctagatttaggagtctgacagcatgcagtgtatgcctcataataatctgctgtttatgaaagtcataacattgtatgtttagcataatggtgaagagcctgccatctggaatggtctacttatttgggatccacatacagtaagctctcacttaacatcatcagtaggttcttggaaactgtgaccttaagcaaaacaacctctaatgaaaccaattttaccacaggctaattgatataaacaagagttaagttcctgtggcatatttctggtcacaaaaacatcactaaacttctaaataaagacccaaaacacttataatattaaccactgaaataaatgtgagctatatatatacatttaagaataataaaaacaaaaaataattatttacccaatttttggtgaaccagtgagtgatagtgatcatagtgatggtggatgaaatcaaggaataaatatttgcaaagtgaaaattgtaagaagcaccccctgtcaccacatagctcagaaataataattagggcaggcttgctgagcatttttaaactgcactgtttattgtcatgcatttgaatgattatcgcagactttatgaattttcattttatattaatttgtaggccaggcacagtggctcacgtctgtaatcccggcactttgggaggccaaggcaggcgggtcactggaggtcaggagttcaacaccagcctgaccaacatggggaatccccatctctactaaaaatacaaaaattagccaggtgtggtggtacacacctgtaatcccagctatttgggaggctgaggcaggagaattgcttgaacctgggaggtggaggttgcagtaagccgagattgtgcccctgcactccggcctggtgacagagctagactctgtctcaaaaaacaataataataatttgtattcattcattttccaatgtgttcattccagttcagggtccagggggcctgcagcttatactcatagctcagagcaactgaccctatagacaggacgccaccccattgtagggtgcactcaaatgcacactcacactcaaactgggacccttcagacatgccagttaccgtatcacacacagcttcgggatgtgggaggaaagcgaagtatctggagaaaaactacacagacatgggaagaacgagccaactctacacagacagtggccctggacagagctgggcaggcatcagttttttttcttttttttgtggggggtgagggtggggcatggagtctcactctgtcacccaggctggattgcagtgcagtggtgtgatctcagctcactacaacctccacctcccgggttcaagagtttctcctgcctcagcctcccaagtagctgggattacaggcgcccgccaccacacctggctaatttttgtatttttagtagagacaaggtttcaccatgttggccaagctggtctggaactcctgacctcaggtgatccacccgccttggcctcccaaagtgatgggattacaggcgtgagctaccgcgcccagtcagcatcattttttttttctcatcaacgttaaaacaatgttgaacaaaacattattcaaagacctgccgtatggctattttctagttgtgtgactttctttgggaaagttagcaaccctttctgagcttaaatgtcctcattcataaaatggggctagtaataatgcataaggtttttgtaagaattagaattaataaagtacttagaccataataactaattagtattagttgttgtctttgctattattttgatgtggtggttgtttggtttcacctgtgtactatcaggacatgctgaaataaaatttaagaattggctttataatattagaaaagcaaacttttgtacgatatgggtatgaaaaattgttgggagtctactttttctctcttacctaatttgtcttagtctttttaaagcttagattttccaaatgagccatagcaaaatataatgtttaaaaatgtttaaattctaagcactatgtcatagttaaataacttaaaggtgctacatcttatacagtccaaaaggaacataattagtaaaattctacaatttagaaaaaaaaatagctgacagtgactgatttataaaagtaaaatatcttttgttaatactaatattctttttataaattaattgatgacaaaaaattgagtgaatgagatttgcagttcatttatctatgatgctggtttatttaatctctataatttgctgtatttgaaagagcatagtgatagaggtcatgataaaatctaggcccagtgccacaactaaatccctgtaggaactctcaaggttttgatttcatctctgaatgggaataacaccttccaagaatattatgaagattaaaaagttacgtatcataaatacacacagagtaacaatactgggaatattgcaacttgtaagaaagaggaagcatatggcatattctgatggttagggatatggactctgtagctgggatgcctgaaagagaactctgactccactaatggctagttatatgaaattgtgcagataatttaacttctctgagtttgcatttttctttgtctatataatggggataataatagtacctacctcacacatagtgttaatttctattagtggttctcattaagatagtattgttgttcatccctggttgttagccatcatgtatctgagttagagagtcattgattttagaaagtcccgaggagactatcaggtcaagcaacctgcctcctgctagacaattagctttatccatgagttaccaaagagggagccgaaacccagggaagctgaaagagctgttgattgtcaccctgtgagttggtgatagaaagatatctggaatcccagtagttgcccatttcctagttctgggctctgcattgcactagaatactgtgccattctaaatatgaaaaggcagtatgaccattgtgcttgtcactttccattccctagatgctatcttatatttgtccttatgaaatttaacctgtgactttcagatcacttagaaccttggttggacagtgttttctagtgttatttagtatatttttttgtcatcttctgttgtctttgggttcccctaaaagagctatactctgggtgccaggaaacttcacacatgactgtcttctcttcctcgacttccctctctacttacctttccagctcgtagcaaatcagaagacttctctgacacctctctatgtctaaaggtcctttgatattctcacatggcggcatgaatcacagtgtattttaactggccttttccttgtatgtctcctacaatgagctgttgaagcttcatgaaaacacaatctgttttactcagggcagttataattccaattacaaagcacatttcctggctcctggctaggaactcgatcatttttcgatgcttccttgctcaggactttctgattccttcttaaaacattttggggcatctccttctcctggtttttggaaacatattctcatactgctatgaaggtttttactgacatttccaacttctcttaaattgattcagcaaatgtttttccataataaatgtcattgatatgtcatcaatatggagagcaacaacagaatgcattgagtaaactcctcccctggaggtctgagaatctagattccagttctcacagagccaccaccttggtgaccttggacagtagaccttctaagcctcagtttccttatcccttaagtggggatattaatagaacccattctcagagatgttgccaagattaaaataaccaagataattcctgtagatgatttggcatagtgcctgccacgtactaagcaagagttagcctccgtcattatagtatgatcataaaaaatgaacagactaaacgaagtaaccagaaggaaagaaattttaattcttaaaatgtaatagtttcttggtttttttttttctgtgaaacacctgcatggcacctttttgttattcatactgttttgactgtggctgtcgtagattcttgttgaaagtctgagagactgagacttgtcattttgaacatggcatcagtggaacagcttatgattcaataattgcatcatcctggacaagcaccagtagaagtgagtcaggacatgtgataaaaagacattcattttgcccctcctccctctctgtattttctttgctataaaattattgatgttaagcccatagtactaatatttcagttcaattcataataaaatttgagggcatttgaatatattatctgttgtaaattataattttatatttgaccacagagtatttgaagtgggtcttttctttccccaaaattctattttaataactaaaaaatattcttaggagaagtattatttaagaacaggtttatattaaataacatcatttcactttcaactttctggtggtcaaaaaatatgctaatactaattaggatatgatacacatgttctgttagaacagttttggcagttagaagacttctcttcttgtgtttgaaagggatgttacttggggtagttatgagccatgtatccagatgtcctgaaaggaccagtggtagatgtatttctatttttgtcttttcttttttctttctggcattctagttgctgagtgactgacttttgttttcagctcttctcacaatcaccattgttctaataactttgcttaaatagaatgtctccttttgctataagccatggggccatttaccgttaattttttaaagtactgaaatgagaacctcataaattaaagaacactcctgattctgagttagcagatcctactaagccttttgcagatggaaatttcctttaaattggtttgttttcctttaacattccattatcctattgttcattctttggagctgtgatttgtttaatatatttcaggcttcttaataaatcaagtcatgtaagttattatttggatcatttcgaaactacaacagcttatcaaacctctgaaagaagaattttgtgtttgcccacagactgaagaactgattcagttttattggctgagctaccttcattattcatatttaattcctggtactgagggtgggaggagggagaggagcagaaaagatacaactattgggtactgggcctaatatctgggtgatgaaataatatgtacaacaagcccccgtgacatgtgtttacctatttaacgaaccctcacatgtatccccaagcctaaaagtttaaaaatatatatttggtaaatcaattgatgtgttttaaaaaatatcgccttttggccgggtgtggtggcccatgtctgtaaccccagcactttgggaggccaagccgggcggatcacgaggtcaggagttcaagaccagcctggccaacatggtgaaaccctgtctctactaaaaatacaaaaaatagctgggcgtggtggcgcgcacctgtaatcccagctactcgggaggctgaggcaggggaatctcttcaacccaggaggcggaggttgcagtgagccaagattgtgccattggactccagcctgggcgacagagcgagactctgtctcaaaaaaaaaaaaaaaaaaaaaaatcatctttaaagagataactaacccttccccagaaggcagggccaaagtctaaggttcttccaggtcctttgtattccctataaattttagagtcagcctgtcaatttctatacacacacaaaaaaagcctgctgggattatgattggtattgcattgaaattaaatcaatttgggtataagagacttcaatttggggattgagtctatattgagtcttccaatccaggaacactgtatatctctccatttagtcagatatttagtttatttcaacaatattttcagatctttagttcctttcagcaatattttctcatttttcctgtaaagctcttgcacatcttttgtcccatatctattgtgtatatgtgttttgctagttattaaattatattaatataaattttattttccaattgtttgtcgcatatatagaatgttttaaaaatattgtgtcctgtgaccatgctaaattaactaattctagtcattatgtcttcattatctttctcttgaattttcattgtcttccccttctgggactccattcatatgtaaggccatttgatactgtctctcaggtccatgaagttctgttaatttttcttcattcttctttttctctgtgttcttcaactgaatgaatgccattaataatttggtatgtaatggctcacttaaacttccttttgtttttaagatatttctactctcagctgtgtctggaatcctttagtccggagccccaccaaccctcagcctagaaggaaggaggagaaggatagggtgaaaggaaggggagagcttctagcttcaggacagagatcagaacaaacaacagagcagtcatcttggataaggaaacttccctcaaacctattacttatatcctcagaaataagaaaaataatgcatttatcaaattaaaggattttgaaaaagggaacattcagagaataaaactaaactcttgaaagttaaaaggatgataacataaatgaaaagctcagttgaaggattgaaagataaaagtaagaaaatatcccagaaataagagcaaaaagacagcaatgtaaaataggggagaagataagagaattagagaaccagcttaggagttctagaaagagaaaatgtagacaacaaaaggtaagaaatcatcaaagactggagtaggggaggtcatgctatctgtttctttttctattttttattttgagttacatttttttttactgtgaaacaagcatatgtacatgagaatgaacaaaacaaatatgcagtcatgtattgcttaacaacagagataggttctgagaaatgcatcattaggcgatgtcatcattgtgcagacatcatagagtgaacttacacaaatctgaatggtatgtcctacagtacacctggaccatatggtatagctgttgcttccaggccacaaacttacagcatgttactgtactgaacactgcaggcacctctaatacatcggtaagtatttatgtatctaaacatagaaaaggtacaataaaaatacaatataaaagaggaaaaaaatagtacacctgtataggtgcttactgtgaatagggcttccaggattggaagttgctgtgagtcattgagtagtgagtgaatgtgaaggcctaggacatttattatatgaagtctactgtagtgtaaactctgtagacttaggctacactaaatttatagaaaaattttcttcaataataaattaaccttagcctactgtaacttttttactttgtaaacttttaatttttttaacattttgactcctttttagtaacacttagcttaaaacacacacattgtacagctgtaaagaaaattttatgtccttcttctgtaagcttttttccatttttaagatgtttttatttttaaaactgttactaaaaactaatacacaaacacacacattaacctaggcctatacaaagtcagtgtcatcagtgttcaaccttcacatgttatcccactggaaggccttcaggggcaataacaaacacagagctgtcgttttctgtgataacagtgcctttttctgatatacctactgaaagacctggctgagagtgtttgacagttaacaaaaaaaaaaaaggacaagaagtacactctaaaataatgaaaaaagtataatacagtaaatacataaaccaccaacatagtcatttattatcattatcgagtattatgtactgtacacagttgtatttgctgtacttttctataactggtagcacggtaggtttgtttataccagcatcaccacaaacataagcatggtgttgtattacaatgcacagctgcagctaagtgataggactttttcagctccattataattttatgggaccatcactataaatgctgtccatcattgactgaaatttatgtcgtgcatgaccatacatacaatttaatgaaaaataataataataaagctagcagtgtgtaattaccaaccagggcaagaaatagaatattgccaataccttggaggcctccagtatgaccatataagtttacaaatcctattttgttcctcctccccagaggtaaccactgccctgacaaatgtgatcgttgttttcttgtttttcttactacctatataaacatccttaaacaatataactcagtttgtatattttgaattccatgttaatagaatatcatatgtatatgaattttatgtgaatagaatattatatatgtcattttgcatcttgcttttttcattcaacattgtaggattcattcatgttgtagtgtacagctgtcgtttattcattgctgtatagaattatatcctcagagataagatatatggatgtttataaatcattccactattatgaacatttgactagtttgtagtttttatttaaccaaaaaaatgctgctgccaacattcttacacattttactgtatatgcacattaatttatttacaagtataaatttctttttgaatacatatctattgatggagttgctacatcataggacattcttgtctttgactttactggataataccaaactgtcttccaaaatgattacatccttaaactcaggacacatcttattgtcaaatgtttaatttttgtcagtctgatgggtatgtaagttattttattgtcgttttaatttgcatttccctgattactaattaagctgagtaacttttcatatgtttattggccatttggagttcctgtattgtaaagtataagtttttttgtccatttttctagttttctgtccttttagttgaaatccaaatttgcctaaatctgttattctctgagcacaagtaacttgggatgctttcctttagatttagcctaattctttatcattttgtcagcttgatggtgcttttaaggagatatatatgtgtgtgtgcgcacacatgtgcgtgtgtgtatatatatatatgtatatgtatgtatgtattttttgagacagggtctcactctgtcacccaggctggagtgcagcggcacagtcttggctcactgcagcctccacctcctgggttcaagcttttccctgtctcagcaacccgagtagctaggattacaggtatgccaccatacccgctaatttttgtatttaatagaaacagggtttcgccatgttgacaggctggacttgaactcctcacttgaactcctcacgtcaagtgatctgcctgctttagcctcccaaagtgctgggattacaggcatgagctaccgcgcctggcctggatattttttaaaaatattttttatctagcactttggtttttggcaggcaggttggcactcatagtctgacctaccatttctataaaaagaaacctgtaaatgttcttaaacagactttgaaccagtcttcctgattttgaacccctacctttacccccagtttttgagcctttcagaattttttttcataataattaggttgcttcttagctttccccactggtgacttaacagatcttaggaagccaacaatccttgtccatctgctttctgtcttgtgaactgttgctggtattgtctcttctctttattcttagaggtgtatgcttttaaaaacatatactgggtttgagagggagctgaaataaaagcatgtgttaaatataccatctttaaccagaactacatttgactggtcattttattttcaagctcacatacacttcaaacagagatatggctaaaggaattatcatgtgaacaacagccagggctctgaacatcacagattatatcatcatacttgaaatatttgaaattttgattcaaaatgagagctttatagctatgtcctcaatggactaagtgtttaagtacttaacatccaaaacattcttactaatcaagagaagacaaacaccccaacagagaaataggcaaattttatcaatagccagttcaccagatttgttttctgttagaagcgaatatggggaaatacatgtgtccatgttttgcctacttttcctggagcaggtaaggagaggcagtttaaggatccatgtgataaaccctaaagttgtccatcggctttccagtcccttctaggaatttaacttagggaaataatcagacatttgcaaaggtgtgtacagtggtatttataatagtgaaaaaccaaagaatgaccaataacgggagaatggaagttacagccaaatactttacaactactaaagaatcatgtaaaatatctattgacataggagttttatcaaaatgtgaagtatacagatgaatagtaccacacataaaaagcaaggtgcaaattagccatttatattgttatccccaaaataaatagatgcagtttttttaaaagatgcaggctatatatggaagtgtttgctggttttctgtcaaaagaatggcgactttattttctaatttaaactttttgctgttttctaaattgtctaaatagttatagtttttataatgtaaaagtatcttccaatttagcttcatttgacaaattaccttttcattctatctagctatgtaattctaaatgaatttacagcagtaatcttagagcagatgaatttacaacaataatcttagagtagactacggattagatgtaaaaacatgagttgggctttatggttacagagagttttcctcagtgtggggatcatagctgtattgagtttattcagttttcctttcccacatgaatgaaaaatggggccagcctacaactggaagggcctcggcatgtaccactgtactgtgtatgatgtgatttcttgatgctagtagggagagaatcaaattgcctcctattcaaaccaagacccacaaatagcgtcaaccagtcatttcagctactccctgcagtgtcaagaaggtgtgaacccctcatgttctctattgcatacccttgtctaattcagtgtttcttcttcttttcaggttttggctttatgctacatttcagaaatcataataaccttttctggtattattttattctttttcgcactgtgagaaaaattaaactttcaagtggatgcttcttataaactatttatacccttttgctcccttttgggaggcagggacagggacagagttcctcctcaggctaactaagaaaacttactgcttccaatgtaatttaaaagatctccctctttctattgctctctgtactcttaattcttttttttttttttcacagcagagacaagtgaacatttatttttatgcctttcttcctatgtgtatttcaagtctttatcaaaacaaggccccaggactctccagattcaattatgtccttgggcttggtcgactgctgtaggagtctcagggagccttctacaaatgctagagtgactcatttaccaacattaaaccctaggatacatgcaacaaagcaggactccttcctccatggaatgtgccgatttcagatgacacagcacccaatgtagaaaacgctggaatttttccttggaactagactgtgatgagaggtgcttgacatgaacataagctactgtcttttctttttttttgagacagagtttcgcttgttgcccaggctggagtgcaatggcgtgatctcagctcactgcaacttccacctcccaggttcaagcgattctcctgcctcagcctcctgagtagctgggattacaggcacgtgccaccatgcccggctaatttttgtatttttagtagagatggcatttctccatgttggtcaggctggtctcgaactcccaacctcaggtgatctgcctgcctcagcctcccaaagtgttgggattacaggcatgagccaccacgaccggccagctactgtcttttctttgacccttcctttccagtttttgaagataaagcaggaaataatcttctctgaagatacttgataaaaattcccaaaacaacaaaacgcatgcttccacttcactgataaaaaatttaccgcagtttgtcacctaagagtatgacaacagcaataaaaagtaatttcaaaaagttaagatttcttcagcaaaatagatgattcacatcttcaagtcctttttgaaatcagttattaatattattctttccccatttccatctgaatgactgcagcaatagttttttgtttgtttgtttgtttgtttgtttgttttttgagatggagtctcgctctgtcgcccagctggagtgcactggcgcaatcttggctcactgcagtctctgcctcctgggttcaagcgattttcctgccttagcctctcgagtagctgggactacaggcacgtgccaccacacccagctcatttttgtatttttagtagagacagggtttcaccatgttggccaggatggtctcaatctcctgacctcatggtctgcccgccttggcctcccaaagtgctgggattacaggcgtgagccaccgcgcccggccagcaatacagtttttagttactcgacatctttaagcctataactcttaggctatgcatagccccatgtcctaatcaggcattcactgatcccagcaggtctccatctatttgtaccagcctcctctttcctcccaatctcaaggttactcttaaatactagtaaatgcaaaaagaacttgtaaagtggcaaggcatggcctatcaaaagtcagcccaagggcagttttcagccctgcctcacctgggtctagttcagctgacggatgagctgattgatgcgttcaccccgatagccaggtgtgcccatctccttgaggaagcccactctatttttggtagcatgatgggccactgagaggtggaaagggcgcaagaaccatgagatctcctggaaatgcttccctgggaaggcaatttcatgaatgaggtcttccaagcaaatgaagccaaacttccccaggtgctcctcaatcactgtgttgtctgtcagagggatggtcttattcttgaccttggcttgtccacgtttcaaaatgagttctcggacagacttcagatttggaaatccccaggtcacataaggttccactatatgcagcatttttagattctagggggtaacttttacaaagataccactaaaaattttctttaggcgaagtcttgcagtggttctctgcacccgtaaactcacgccatcaatcctttcgatgcgtacaacaaaggccaaggaatgtttatctggcaattccaaggcatgaggtttcacttctagtcgtctgagacgcaccttgtcacgtttctgccgccaggaatcatgtaggaatgattccagtcgcttaaacctgagcccttttcctttcttctgtcttgctactgccatctttctagtggtgcagctactcaattctttttttaattataatttttattttaagttccagggtacatgtgcaggatgtgcaggttacataggtaaacatgtggccatggtggtttgctgtacctatcaactcatcaggtattaagcccggcatgcgttagctatttttcctaatgctgtcccgcccccccacccaacgggccccagttacactcttaatccttatagctcagatgttatgatccacagtgtggttcttacagaaagttatggattaaaaaaaaaaaaaaacactcaaagtgcccgaactttcttaaaataatcctggtacagctaaactcatgcactgactgtccacctaatatttaacagtctgtgttgtgatatattgttttaatgttctgaatgcttgtcagctttcagtattgaagatgtgaatcatttatcagcaatgacacatttagtctaaggttgtcagctatttatgctacaaattaatgacttgtccttaaaatatcaattttgtgattcatgttttggcaggtggttagatgttttgtgttctaattttaaactatggataaaggttttgtcataatcattgttttattggttccttttctcccctgcccactccccaaaaaaccctgcaattcttttttgttaaacttttattttaggttcagaggtacatgtgcaggtttgttatataggcaaattttgtgccacaggggtttgctgtacagattatttcatcacccaggaaataaacacagtacttgatggataggtttttagtcttcattctcttcccaccctcaagtaggccccagtgtctgtccttcccttctttgtgtccctgtgtactcaatgtttagttcctagttataactgagaagaacatgtggtatttggttttctattcctgtgttagtttgcttaggataatggctgccagctccatccatgttgccgcaaaggacatgatttcattctttttatcgctgtgtagaattccatggtgtatatgtaccacattttctttatgcagtcttctgttgatgggcttttaggttgattctatgtctttgctattgtgagtagtactgcagtgaacatacacatgcatgcgtctttatggtagaatcatttatattcctctgggtatatacccagtgatgggattgctgggtcgaatggtagttctgttttaagttctttgagaaatcatcaaactgctttccacaatggctggattaatttacacttccaccaggagtgtataagcatttccctttctctgcaacctcaccaggatctattattttctgactttttaataatagctgttctgactggtgtgagatggtatcccagcaccatttattgaatagggagtcctttccccattacttgtttttgttgactttgttgaagattggatggttttaagtgtgtggtcttatttctgggctctattctgttgcattggtctatgtgtctgttttgtaccaataccatgctgttttggttactttagccttgtagtagtttgaagtcgggtaatacggtgcctccagctttgttcttttggcttaggattgctttggctatttgtgcccttttttgattctatatgaattttaaaatagtttttttctaattctgtgatgaatgtcattggtattttgagagcaatagcactgaacccgctaattgctttgggcagtatggcgattttaacaatatcgattctttctatcccctgcaattctttgttgttgtatttaactatttttacttgtgaagttttttcagggatgattttgttgaaagtgacaactctaaaaattatgttggtaattaaaattttaagtaatgacttttattttcagagattccacttctcttagactttggagctgttaacagcagtgtccaatctgcagtggtactcagcagtttctgtttcctgcatgcagaactgcttatatgaaaacacagttttaaaaatgctttcttatggctgacattcacattcttattccttttgattcttttcaagagggatttggtttgttaaaattaatttttgcaatacttttatgaagatacaaactctgacaaagcttttaaaacaagtttgagagaatacagtattgatttcacttgtaaatctgacaattattttagaaaaaaggaaaatattatttactattattttgcttataaatgtttatcaattttaaagcttccacattgcacatctcccactacaacagtagctaccatttattctttctcaaaaaaagtgctaagtgtgcccttgaaatttttacattgtgcagaatatccctaaaattttaaaacaaaaattacatcatcacttgctttaaatgtttcttctttatttaacatacagtttctaaaatgttagcaaatagcattttagaagagacacgttacttttctaatgaatgttctaaaatgaaccacagtaacctatacttacttagactgtgaaaaacaaaacttatattctattgttaaattttcaaaagtgaaactacacgatagtttacttggcacatcactctgttattgtgaattgacaaatgtatatgtagacaaatatgtgaaaatcagagtacatatacattatatgcagcaccacaatacattttttagtatgttttgactgatatttaattatataatttaccaagaggatctcaccagaatgtagaaaagtattgaattttagaacaattcacatatttaaaaaaaatgtagtcagcccttttatctgtatctggagaatgcagggtaaaggaataatacatgagtattggtatttaaaaaaaggtgttaatttcttacctatgatacctgttactttgggtatcatttaacctttatttctgtgaaatagaggagttctaacatcctctaattattataatattgttctaatttaatctatcttaatctgtgatacagtttgaaaaccaagcttttactattggcatgtgcaaaaaaataaagcagcagtagacttggaatcttgaatgcaaatttagattttgcctcttaataaatgtataatatagtgttctgggaccaattctctaacatttctgagtcctagtttctgcatctgtcaaatgggattagagatacctactttcaggatgtgatatggtttggctctgtgtccccacccaaatcttatcttgaattgtaatccccatatattgagggagggacctggtgtgaggtgtttggatcatggaagtgatttcctccatgctgttctcgtgatagtgtgggagatcgcaaaacatctgatggtttaaatatggcagtttcccctgtgctttctctctctcctgccaccatgtaagactttccttgcttcctctttgccttctgccatgattgtatgtttcttgaggcctccccagctatgcagaactatgagtaaattaaacctcccttataaattacccagtctcagatattctttatagtagtgtaaaaactgactaatacagagaattggtactggcagggttgggtactgctataaagataatctgaaaatgcggaagtgactttggaactgggtaacaggcagtggttagaacagtttggagggctcagaagaaaactggaagatataggaaagtttggaacgtcctagagacttgttttgaatacttttgaccaaaatgctgatagtgacgtggacaatgaagtccaggctgaaatggtcccagagatgaggaacttattgggaactggagcaaaggttatttttgctatgctttagcaaaaagactggcagcattttacccctgccctagagaactgatgaactttgagatgatttagggtatttggcagaagaaaatttctaagcagcaaagcatcctagtggtgacttggctgattctgaaagcgttcagtcatgtgcattcacgaagatatggtctgaaattggaacttaggtttagaagtgaagcagaacataaaggtttggaaaatttgcagcctgaccatgtagtagaaaagaaaaccccattttctggggaggaattcaagccagctgcagaaatctgaataagtaacaaggagtaataagtaataataagtaaaaagtaataagtaataagtaacaaggagccaaatgttaataaccaagacaatggagaaaatgtctccagggcatggcagagatcttcggggcagcccctcccatcacaggcctgagaactaggagggaaaaatggtttcctgctcagggccttgctgctctgtacagcctcacgacatggtgccctgcatccctgatgctccagctccagctgtggctgtaaggggccaagttacagctcgcaccattgcttcagagggtgcaagccccaagctttggcagctttcacgtggtgttgggcctgcaggtgcgcagaagacaagagttgaggtttgggaacctgtgcctatatttaagaggatgtatagaaacgcctggatgtccaggcagaagtctgccatggaggcagagccttcatggagaacctctgctagggcaatgcggaagggaaatatggggttggatccctcatacagagtccccactggggcactacctagtggagctgtgagaagagggcctctgtcctccaggccccagaaaggtagattcaccgacagtttgcagtatacgtctggaaaagccacagaatgccagcctgtgaaagccacaggggtaccctgctgagccacaggggcggagctgcccaagggtatgaaagcccaccccttacttcagtgtgccctgaatgtgagacatggagtcaaaggagattttggagcttttagatttaagggctgcccagctgggtttcagatttcatggggcctgtggcccttggtttgaccagtttctcccatttggaacaggaacatttacccaatgcctgttccctcattgtatcttggaagtaactaacttgcttttgattttataggctcatacgtggaagggacttgccatgtctcagatgagactttggtcttggacttttgagttaatgctgtaataagactttgggggactgttgtgaaggcataattggttttaaaatgtaaaaagacatgggatttgagagggagcaagtgcaaaataatatggtttggctctgtgtccccacccaaatctaatcttgaattgtaacccgcatgttttgggggagggacctggtgggaggcagttggatcatgggggggttttttccatgctgttcttgtgatagggagttctcaggagagttgatggtttaaatgtggcagtttcccttgtgctctttctctctcctgctgccaggtgagacgtgtcttgcttcccctgccccttccaccatgatcataagtttcctgaggcctccccagccatgcagaactgtgagtcaattaaacctcctttccgtataaattacccagtctcagatagtatctttatagcagtgtcagaatggactaatacaggatagtaatgaagattacagaatatgtagatgaagaagtgctaagtaaatagcagctattattatgtagtcaaattgaatgtatacattgtggtacttcagtgtcctttaaattgaataactagaaatttgttggctttctcaatctgctcacatcagatgacatgttaatttatgcctatacttttttctagttaatagatataaatctattcactcaacttctattgacagaactggtagtgtggcaagacatctcatttctagttaaggctgtataatattaagttcattttacttaaattaactatggtttgggaaatgcttttcatgtcatcatgtatgcccaatttgatactttagtgggacagtatatttcagaaaaaaacaaatgcttccccaaaaattccagggttgaatacattagtcagacatataacaatgtacttcagagttcctctaagggcaaaaatcgtggtatgaatatacaaaacactcctatttatacttttgtatttttgaaatgtagtcttcatgttaatttagcatttcaatgaccagcatgacattatcttaataatttggaatgccaatatgttcatttaagacttaatatagtaagtatctaaagaaaaaaatggaagtgactgaatgcttttgtatctcttaattataatttgtgctccattgtgatatgaaggatagaaggggcaggatagatagaaaacagaaattaactttgatgtttaaccttaccttaagactgtctgttaagtgacccacataatcttaaaaaactctgtcaagcttaatggatgctactctgcaggcccctgccaggcaacagtcacaaggttatgaggtgcatagattttggaattaggcagagctgaattcagatccaggtgttgccttataatgcgactttgggcaaataaaaggcccaatttttgtattcttatctgtaaaatggactcagtaaaaattatttgagataatttatttgtgtactgtacctaggcatgcagcttgacacacagaattacaagtcagtagtttccagtatgattattattgtgaaagagatattttgtttcacctactgaaaacttttttcagtcttaaattttttatctaactggctgtattgcagatgtctgctatataacttttatataattttaaaaactatttctttcctccttgatcttctaggggtaaggttaccaatgttttcattatttactaaatatagcagcccccaccccttattcatggaggataggttccaaaacccctagtgtatgcttgaaaccacagaccacagataatcccaaatcctatatgtatattgtttttcctatacatacatacctatggttaatgtttaacctactaattaggaagagtaaaagagtaatagtaactaataataaaataaaacaattgtaacaatattccagcatcactattcttgtgctttagggccaccattaagtaaaataagggttacttgaacacaagcactgtgatactgtggcagtccaactggtaacagagatagtgatgcggtttggctgtgtcctcaccagaatctcaacgtgaattgtatctcccagaattcctatgtgttgtgggagggacccagggggagctaattgaatcacagggtctggtctttcccttgctattctcgtgatagttaataagtctcacatgatctgatgggtttatcaggggtttccccttttgcctcttcctcatttttcttttgccaccaccatgtaagaagtaccttttgcctcccgccatgattctgaggcctccccagccctgtggaactctaagtccaattaaacctctttttgttcccagttttgggtgtgtctttatcacaagcatgaaaatggactaatacagtaaattggtaccagtagagtgggtgttgctgaaaagatacccaaaaatgtggaagcgactttggaactttggaggactcagaagaagacgggaaaatgtgggaaagttaggaacctcctagagacatgttgaatggctttgaccaacatgctgatagtgatatgaacaataagatccaggctgaggtggtctcagatggatattaggaactttttgggaactggagcaaaggttactatgttatgttttagcaaaaagactggcagcattttgcctctgccctagagatttgtggaactttgaacttgagagagatgatttagggtatctggtggaagaaatttctaagcagcaaagcactcaaaaggtgacttcggtgctgttaaaagcattctgttttaaaagggaaacagcataaaacttcagaaaatttgcagcctgacaatgcagttgaaaagagaaacccattttttgagaagaaattaaagctggctgcagatatttgcataagtagcaaggagcctaatgttaatccccaagaccatggggaaaatgtctccatggccatgtcagagaccttcacagcagcccttcccatcacaggcccagagacccaggaggaaaaagtggtttcgtgggccaggcccacggtcctcatgctatgtgtaggctagggactttgtgccctgtgtcccagctgctccagctgtggctgaaaggagccaatatagagctcaggctgtgacttcagagggtggaggccccaagccttggcagcttccacatggtgctgagcctgtgggtacacagaagtcaagaattgaggtttgggaacctctgcctagattttagaagacgtatggaaacacctagatgcccaggcagaagtattactgcagggcagggctgtcatggagaacctttgctagggcagtgcagaagggaaatgtgggattggagccctcacacagaatccctactggggcactgcccagtggagctgtgggaagagagccgtcatcctccagaccccagaatggtagatccaccaacaacttgcaccatgtacctggaaaagccacagacactcaatgccagcctgtgaaagcagccgggaggtaggctgcaaagtcacaggggcggagctgcccaagaccatgggaatccatcttttgcatcagcatgacctggatatgagacctggagtcaaaggagatcattttggggctttaaaatttgactaactcactggatttcagacttgcatgggccccgtaacccctttgttttggccaatttctcccatttggaacagctgtatttaacctgtgacacccccctaccccctgccccccatccctccggcccttgtatctggaagtaactagcttgcttttgattttataggctcataggcagaagagacttactagccttgtctcagatgagactttggactgtggacttctgggttaatactgaaataagctaagactttgggggactattgggaaggcatgattggttttgaaatgtgaggacatgagatttggaggggccaggggtggaatgatatggtttggctgtgtccccaccctaatctcaacttgaattgtatgtcccagaattcccatgtgttgtgggagggacccgggggtgggggtgcagtaattgaatcatgggggctggtctttcctgtgctattctcatgatagtgaataagactgacgagatctcatgggtttatcaggggtttccaaaacttttgcctcttcctcatttttctcttgccaccaccatgtaagaagtacctttcacctcctgccatgattctgaggcttccccagccatgtggaactgtaagtccaattaaacctctttttcttcccagttttaggtatatctttatcagcagtgtgaaaacaactaatacagatggctagtaagggactaaccggcagggagcgtctccagtgtggatatgctggacaaagggatgattcacgttccagggcataagatttcattactcagaattgcacagaatttaaaacttattaattatttctggaattttccacttaatgttttcaaactgtggttgactgcaggtacctgaaactgtcaaaagtgaaaccacagataagtggggagtcctgtacctaagattattcctttaaattgtttcagtggatatgtagggacctgagtgtgaagtgagagcagcagcatcaaaacctgagggaaatccagatagcaaaagaaacttgtctagtatactggcatgacagagaaaccaaaaagttctcaagttaatgtgagaatctaagaattaaagaattaagcctttgcctttgagggaaggaaaggggtaatgtggctttaaatcaggttgagattggttctgagggttccttttccttcctttatattgatatgaatatagacacaactgttctgcatttccatttgtttttataaatgtctttttaggatttaggaactgctaattatgcaatatgagatatctgttagtttgaggaacatttgaaaatttggtcaaatgacacagatcgtcacacagttttaagacaaatgtttttacctatttgacctagtctggcaatccctatttgggcaaaaatcttcatttgcaggtcatgattggaggcaggcacagaaaaaaaattgccaccttttttgcattatgtcatcaagacatcaaacttcagcctacaaagtagaaagtgttatttctcaagttgaaggcctggatatacctcagcttctcagttctgacactttatcatagtggaaaatgaagaagattgcttaagaacactgatgttggtgtcagaaagacctgggtttgaaccctgactttactagttacttagatcactttaggcaactcaacttttctaaatcttgtttcttcatctgtaaatgctgaaaatagtacccacctcttaggtctgtggagaggattaaatgagataatctatacaaagaaagagcttgcataatagtgccaagtaatggtgaggttatacctgtattctgattataatctcataaatatttaccatgttagctgtctcagagttcttttgcaaaacagataaagatagaaagtataaataagaaaaataagtgaacatatactgaactttgtacaagatgctggcgatatggagagacccaagacatgggccctacctaaaagagattattgatagaaacaggatacatatacatcaaaaggtaacataggatcatctgtgcaaagtgctatatggcagtgttttaggaagtctagaagctgtcatggatcaggaataccatggtggacacttcaggcagggaaaacagatcttagcaaaagctactcctatcataggtacttgataaatatttgtagaatccaggatccctgtagtgataaagaaactacatggattatgtaggggagtgataagacatatgactggaaaaataaaaagaccaaattatggaccatactgagcttgtactataaacagtggaggagcccttcagatttttaatcatgttgagaaaagagttttagcagtgtgtgggggatagaatggaaagagaagccagtgccagaaggactacttagtatcaaccattgcagtggttaaagcaagaggtgagagaaggcatgcattagaatggcagcggtcagagtggatgggaaggaataggtcctgacatagtgttacagggagtaataaataggatgtggaagatgggttagaattggcaaaatctctgcatgtaagtctgggttactaaatatagtgagagaaattcaaatctctctttaagaatcgaataaaatatttagaaataagttactgttgtatttgaggtgaacacaaatggcatttcaaagatgctcgagataccttgttggaaaaagtcaataactgcactattgtctccaacatgttcttgccttctctgaagacatcatgttcctaattctgaattatgaaccatctattatccttgtatgctcttatgtgtgaggaaccataaggtgggaacaaaatccggtcttcattctagaaataactatgcgatcaaaaagtttttagtctttcttcttaccatactggttcttggtattctgtttaccattcaatgtactattattgcttctgcttaaaactcgcatcccctaatgcaagcctgagcaaacagaactgataacacacagcctgagaagggagtgcttggggtctcaagacttattctgtttttctccatctttgacacttggtttgaagagcaaagaaggatacagctgttaggaagtaagttacccaaacacagtgaccaaactggattaattcttccaatgagaaagaaatacattatttctgtgagacagattagactttaagtagcatagataacatgattatattctctctacaaataaatacacaggacctaagaaaccctttacagatccaagtgttttcctctccacttttccatccccaaacccatcttgcaagatatggccagcttatttggagttaattaaatcaagaccttcgttttacagacagggaaaccaagcccagagacactgagtagtaggccactggtgtcttagaggtctgaaaaatcctttactgaacattctcttgatctattaatgtataggttttgttgctgtaaccctctccccaagaggagtgaatataaatgatgcagagtttggatgaactatcttaataagaacctaaagttgaaaccaatgcaaacctctctcaataaatgcaaagcaaagagaataatcagtctttctttggcttgttaaataagataaaatgtgttctgctaaaaccatttaacagaaatattgtgaaaggtttcccctaaagcatttttctatttgatttgaaaactattccatagcttattatcaaacaaatcagtaatcctttagctaatgcagagataaatgggcagtcagaaaatataatcacctggtgtgtgcagctgagtatttacatttttcctaatgaacaaagataagaaaagtgcaggtgactttaatgtgtaaaaactaccttttagtgctagcgctagagggaaaaagaaattactggctcaagccaatcctgtacttgataactaagccgtatagtccatggcttggcttcagttctgttttgaatctctttttggacttgtcttgaatggactgtttagggctgcttcagtagtgcagttgttgcatttttaagcatagtttaggttttaaaatgtttctggtccctttttttttttcttttccactttatgttgcttaaagctttatggccaggttttctcatcctcagcattattgacatttgaagctggatacttctttgtggtgggggctgtcctgtgccttgtaggctggttagcagcatccctcgcctcttctcacttagatgccaatagcatttccccaaccgtgataaccaaaagtgttttcagacactgccaaatgtctcctagagagcaaaattgctctctgttgagaactactgtgttacggtgtttggacaaaaactgacaagccaatgggaatattctattggtagttgtaaaaaattaatccagttatagcagctgtatttctggaatttttttccatattaacacttgctttctgaggtgataatatctttgttttttttctcccaaatagatttcttgcattacactgaaaaattgctgattaattcacttaaattgaagactaagccaatcatgtcatttgggtaatagtttaccaactctgcccctttctctgtcagggaagcctctaatttagtaagcgatactgtatccttttgtcaggtacattaccattcctattagcaatagggcaattgagattgagaaagattaaaaggtcaccaagctattacattgtagaattaggttatgaattgtagcctatctggtttagaatctttaccttactagtctccataacaacaattcttccagtgtggtccatggggccctgggagtctccccttaaagggcagactattttcacagtaacacgtactttatttgccatttcattatgtcagcatttgcaataatggtacaaaagcaaagatgagtaaaactgttggcatcttagtatacagtagttactgtattcactgtcatgcacttaaaatctttgaagaagcaaaaaaattattaattacattaaatttcaacccttaaatacatgtggtctttctcatgtcagtgtgacaaaatgagaaggtgcataatccacttatatcgcatatagcatttgatagttgtctcaaagaaaagtgtataagattaaactgtgagttaacctactttttttcatggagtaccatgagagataaactctggttttcagccttgggtatttggcgatgttttcccaaaaatgactgaagtaaacttagcactttaaggaaaacaacttaaagtatttgttgccaattgataaaatataggtttcaagcaaaaatcagaatttttgaagacttgtatctgccactgtgagcttgacaaatgtgactcttttatattacataatgaactatgtcaacatttgaaagatctgcataactcagtgaaccagtattttccagatgactaatgcatgataatacaaaatcatgcatgggtaaaagatacattcaaagtgcaagatagactgacatatttcaatgtaacaatcaaaagttcattgataacagttttggattccacattgcaatactaaaacctttaaaaaacgaaattgtccaattttggtgtagtaatcagaaaaggcaatctataattacctgaacttaagtttctggaggaccattaaccttctacaggctcatggggaagactgtagcacttctctttccctaagatcctccagaaaggaagaaggtaatccttgggggtagggtagagacctattgtgtgatgatcaccaagtatgtaacaatgctttatataactctaatatatataatccacacaaaccccctaaaatggcactaataagggaatggactcaaagaagttaagtcagctagccactgtcacagctattagagcactggaactaggatttgaacccagatttgtctgtatgtaaagctgattctcttcgtaatagtactgagacacaagaggcggctacaaaatattctggtactccatcctagaccagagtttcaaggttcgttatcatttgtagcatgatactggatcctcacagtgcttgcctttcattcaggtgccaggaaacgtctgcctgaatgaatgggtgtaatttacctgcacattttacatgcttctctaggtgtgtgaataactcataatccatccatgactttcacccataatcctccttgtagcaattgctttgcttgcaacaaaactaagtagacatatctagctttatgcatggttttctctctctgaactctaacataaactcagcctcaggaattattcggtttctactacatttgccattctgattgggaaccaccagcattcaggtattcacctggaacaaggcattttgttccaagggttcctcacttaaaagcaagcaccctagcaatagttcataatggaacttcttaacattctcagaatgtttggcacagctgtgagtgaacacacattgagcaatcaataactattacagataatgatgcccttaagaccaggatattttagctttcccattcaaagggggtgaaatatgcactcttactatggtatacttttggttccttctgccatgtatccttaataaaagatgtcaattccatatggttttctcttgagttctaaccattttgttgtaccctagcccttttaacaatatcaaacttgcaactgaataccatttagcattcatccattttttccaatggtgttcattataggctatcttactcctcctatttgtatgacaaaaattggcttttttcaccgatgtctatggtacatctggcagctttccatgtactcagttcttatctgatgtagcccagaacgactgcctgaagggatgccaaaagcctgattgaggttccaaattttcagctactgtactatcaatccatttgttcatttttactttcccttgtcatctgtagcttacagttgagtggcctgaacatgttttgcatacattgtaatatctaagaatttgggaatacggtcctaggatttagacttaatactaccttccatttatataatacttactcataaaatcttcagtgttcctgaaaaagaaaaaggaacatgtattgagtgcctgctagaagcaggaacttgtagtagattttctatgtgttaccttattttcacaacacacacacaggtgatatccttcccagtttactgatgaggaaactcaggggtcaaagtagtagatacctacccaaggtaacagaagctgtgaagtggtacagctgggatctaaaatatgtcagcttcaccgtagataggctccctgatgaaccacctgccacggcccgtatgaccgcatccaggggtgatgatgtcattttcacagggttattgagagctaaaactacgaagtactacaaactattatttaaaatataaatacatactatatatgcatatgtgtgtatatataattaatggggtaaacattacagaatactgtcctaacctttaaacaatgcactcgttttctgtaaactaatatacaaacaactgtttggtccctaaaaatagatgtcaggtgacagagactggctgagcaagaataggagtatcttcagaatagaagccagaggagtttttgcttccccaacacattgtcgcaccattcactgttccaggaccttcctacttctctggaaaactctggcccaaagcagctcctctacattagtcacaagtttccattaatcaggggtggcctgtgccggacctacagcagagtcatttcaggttattctgttacaggctttcgacgtgtagtcagtccactcgcccaaatctagcagggaatgaatgccttgtaatacggaagcatctacaaattcttcttaacagtgttcagagaacaatgtgaaaccctggggccttttcccagaattagggtggtgggaatgctgtcctattgactaagcctgttaggtaagcaggcagttggcaagattcaggaagcttcatttgaagatagaatttagggcgatcgtttggatttactggcttaattacttaaggtaacatttataaaagaaattgtcattccattattattaccttttaacttttattcctaaacggaacattagcaacaaactacattacttgataaatgtaatttctaaccagattgataactagaaaaaaattttaagttactttgctctgtgaattagtttaaacatatttgtaattgagacttactactgttattggctgaaataaataaaagcaagagataataaagaataacagagacaacgaacacccaatttaagtttatttctaagttccatcttttttagagaaaaggcaaattaagaaaagtttagagagaggtactagtatatttatgaacttgtatagatgataagcaaaacggactttaatatgtagaattccagaatcaacaggttgccagcatccatgtttttgaagatttgcttaagaacacaaccaaaaatggaatgggcagtctctaattacaagcagaaggctacaaaatcattttagctgcataatacagttttggttctaaagtcagcacgtaagaggaaaattccttaggaaaatacaacattgaaaaccattgtgtcatgtaatatgaaatgcaataattaatttttcctccagtaatagaaagatcactgtttcattggtttataaaaatatatctttatcattaaatgtggcaaaatgttaagacttggtgaatattggtgaaaagtatatatccattgtacaattctttccaattttttttgagattgaaaatttttaaaacaacaaattatcttttaaacagctaataatcactagacctgcactctttgtggtgagactatgaaaaatgttagagacctagtaagagaagcagattcacatttctgtcttcttcttcaagccaaacagtcatagagtggagtgggcagaatggaactcacttttgaaagcctagtgctttgtccaatcttactgcaagccagacaggaaggttatagaaaatgtttctggatcagtcttctctgagtcatatgaaattgtggtttcagccaagatgacattaggaattagagacatgggacaaaaactttaagattgtaaaaaaattttgactctagtaggaaacatgggtagaattgtaatgacacttgattgaattttaaaagatgcctgtataagatcttaaaattaggaaaaaaattatggcctaagcaattaaaggcataggaggcatctttttgggatgatggaaatatcctctctcctgattgtgatagtagttacatgaatattcatttaacaaaaaccataaattatagacttagaaaacagtaaatgttactgtatgtgacaccttaataaacgtgattataaaaataaatcctaagcatctaaaaaaaaaaaaaaaaagaagaagaagtgaaccagaaccacaccattctattttggagacacttcaaaagaaatgacctcattcttaattttgtttaaagaagaatataacatgatttgaatatatttagctaggatattttagtgcctgctagcacttgaagccagagttcactgtgagcattctga

SEQ ID NO: 1473 - DNA, 4788 bp, Homo sapiens
tttttagaaaaaaaaaatatatttccctcctgctccttctgcgttcacaagctaagttgtttatctcggctgcggcgggaactgcggacggtggcgggcgagcggctcctctgccagagttgatattcactgatggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtgactgccttaataagaatggttgccttaaagaaagtcgaattaatagcttttattgtataaactatcagtttgtcctgtagaggttttgttgttttattttttattgttttcatctgttgttttgttttaaatacgcactacatgtggtttatagagggccaagacttggcaacagaagcagttgagtcgtcatcacttttcagtgatgggagagtagatggtgaaatttattagttaatatatcccagaaattagaaaccttaatatgtggacgtaatctccacagtcaaagaaggatggcacctaaaccaccagtgcccaaagtctgtgtgatgaactttctcttcatactttttttcacagttggctggatgaaattttctagactttctgttggtgtatcccccccctgtatagttaggatagcatttttgatttatgcatggaaacctgaaaaaaagtttacaagtgtatatcagaaaagggaagttgtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttgtcaaaaaaaaaaaaaaaaaagctcatattttgtatatatctgcttcagtggagaattatataggttgtgcaaattaacagtcctaactggtatagagcacctagtccagtgacctgctgggtaaactgtggatgatggttgcaaaagactaatttaaaaaataactaccaagaggccctgtctgtacctaacgccctatttttgcaatggctatatggcaagaaagctggtaaactatttgtctttcaggaccttttgaagtagtttgtataacttcttaaaagttgtgattccagataaccagctgtaacacagctgagagacttttaatcagacaaagtaattcctctcactaaactttacccaaaaactaaatctctaatatggcaaaaatggctagacacccattttcacattcccatctgtcaccaattggttaatctttcctgatggtacaggaaagctcagctactgatttttgtgatttagaactgtatgtcagacatccatgtttgtaaaactacacatccctaatgtgtgccatagagtttaacacaagtcctgtgaatttcttcactgttgaaaattattttaaacaaaatagaagctgtagtagccctttctgtgtgcaccttaccaactttctgtaaactcaaaacttaacatatttactaagccacaagaaatttgatttctattcaaggtggccaaattatttgtgtaatagaaaactgaaaatctaatattaaaaatatggaacttctaatatatttttatatttagttatagtttcagatatatatcatattggtattcactaatctgggaagggaagggctactgcagctttacatgcaatttattaaaatgattgtaaaatagcttgtatagtgtaaaataagaatgatttttagatgagattgttttatcatgacatgttatatattttttgtaggggtcaaagaaatgctgatggataacctatatgatttatagtttgtacatgcattcatacaggcagcgatggtctcagaaaccaaacagtttgctctaggggaagagggagatggagactggtcctgtgtgcagtgaaggttgctgaggctctgacccagtgagattacagaggaagttatcctctgcctcccattctgaccacccttctcattccaacagtgagtctgtcagcgcaggtttagtttactcaatctccccttgcactaaagtatgtaaagtatgtaaacaggagacaggaaggtggtgcttacatccttaaaggcaccatctaatagcgggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgctttttgaatgttatttgttattttcagtattttggagaaattatttaataaaaaaacaatcatttgctttttg

SEQ ID NO: 1474 - DNA, 2334 bp, Homo sapiens
atggactccaaagaatcattaactcctggtagagaagaaaaccccagcagtgtgcttgctcaggagaggggagatgtgatggacttctataaaaccctaagaggaggagctactgtgaaggtttctgcgtcttcaccctcactggctgtcgcttctcaatcagactccaagcagcgaagacttttggttgattttccaaaaggctcagtaagcaatgcgcagcagccagatctgtccaaagcagtttcactctcaatgggactgtatatgggagagacagaaacaaaagtgatgggaaatgacctgggattcccacagcagggccaaatcagcctttcctcgggggaaacagacttaaagcttttggaagaaagcattgcaaacctcaataggtcgaccagtgttccagagaaccccaagagttcagcatccactgctgtgtctgctgcccccacagagaaggagtttccaaaaactcactctgatgtatcttcagaacagcaacatttgaagggccagactggcaccaacggtggcaatgtgaaattgtataccacagaccaaagcacctttgacattttgcaggatttggagttttcttctgggtccccaggtaaagagacgaatgagagtccttggagatcagacctgttgatagatgaaaactgtttgctttctcctctggcgggagaagacgattcattccttttggaaggaaactcgaatgaggactgcaagcctctcattttaccggacactaaacccaaaattaaggataatggagatctggttttgtcaagccccagtaatgtaacactgccccaagtgaaaacagaaaaagaagatttcatcgaactctgcacccctggggtaattaagcaagagaaactgggcacagtttactgtcaggcaagctttcctggagcaaatataattggtaataaaatgtctgccatttctgttcatggtgtgagtacctctggaggacagatgtaccactatgacatgaatacagcatccctttctcaacagcaggatcagaagcctatttttaatgtcattccaccaattcccgttggttccgaaaattggaataggtgccaaggatctggagatgacaacttgacttctctggggactctgaacttccctggtcgaacagttttttctaatggctattcaagccccagcatgagaccagatgtaagctctcctccatccagctcctcaacagcaacaacaggaccacctcccaaactctgcctggtgtgctctgatgaagcttcaggatgtcattatggagtcttaacttgtggaagctgtaaagttttcttcaaaagagcagtggaaggacagcacaattacctatgtgctggaaggaatgattgcatcatcgataaaattcgaagaaaaaactgcccagcatgccgctatcgaaaatgtcttcaggctggaatgaacctggaagctcgaaaaacaaagaaaaaaataaaaggaattcagcaggccactacaggagtctcacaagaaacctctgaaaatcctggtaacaaaacaatagttcctgcaacgttaccacaactcacccctaccctggtgtcactgttggaggttattgaacctgaagtgttatatgcaggatatgatagctctgttccagactcaacttggaggatcatgactacgctcaacatgttaggagggcggcaagtgattgcagcagtgaaatgggcaaaggcaataccaggtttcaggaacttacacctggatgaccaaatgaccctactgcagtactcctggatgtttcttatggcatttgctctggggtggagatcatatagacaatcaagtgcaaacctgctgtgttttgctcctgatctgattattaatgagcagagaatgactctaccctgcatgtacgaccaatgtaaacacatgctgtatgtttcctctgagttacacaggcttcaggtatcttatgaagagtatctctgtatgaaaaccttactgcttctctcttcagttcctaaggacggtctgaagagccaagagctatttgatgaaattagaatgacctacatcaaagagctaggaaaagccattgtcaagagggaaggaaactccagccagaactggcagcggttttatcaactgacaaaactcttggattctatgcatgaagtggttgaaaatctccttaactattgcttccaaacatttttggataagaccatgagtattgaattccccgagatgttagctgaaatcatcaccaatcagataccaaaatattcaaatggaaatatcaaaaaacttctgtttcatcaaaagtga

SEQ ID NO: 1475 - DNA, 38596 bp, Mus musculus
  misc_feature (25545)..(25970): "n" at positions 25545 thru 25970  can be any base
  misc_feature (27817)..(27864): "n" at positions 27817 thru 27864  can be any base
ttagtgctaagaaatccagagagggagatgcggtgtgtctctggagcagggcatggctcagtgggacctgtctgccatggtgtgttatgttagaagctgaggatctgagtccggcttgctgtggtgctggtgagccatggaaagggatccaatggtggctactgccctgagtctctaccaggttgtcacacaaaattcactcatgtagcagagaagtggcacatcagagtcccttcctttctctggttctatctgctgatacagatgaaggaaatatatatatatatatatatatatatacatacatacatacatacatacatatatatatatatatatatatatatatatcaatcacctgaaacctccaatacagagacatggttctgatgaatggttttaaggaacaatgctatgtgcaggcctagtgtttaagaaccagtgaggatgacagagataggtaggtgcaccaaggtgagtggtggtgaattggatggccttggcttaaagacagagtccttcatcgggaggtgactcaccccaaggcccagccactcgaagaacagccagtggattggaacgtcccaggacagatgccacagccttgacccaggttggaggtgcacggatctcactagggtcagttggtcgtaggggaaagccccatggatccaccaggataagatgtttaactctacattaaacagaagatacactgtatttgcttggaggtagcatagtttttcagttgctggggaatgagagcattactggaataaatattggaacgtgtaggaaggcagagtcagctcatgagtgagaagagtagcttaagttacctttcagggtacttgatagagtaagaagtggccaggaatcctcccaaactgtgccccaggaggatcatggtggggattcccatggtctcccgccatgtctctattgaggtcacaaactcatcttcagctccttctgggtcccttgggaatgttggccttgagcttcgcccaaaaccaagcagatcaaaggtatgaagtgtgcggcgggcactcagtgaatccatgttgaggatccagaggcccacaccgcccccaaagccatgtaccatcaccagaggggtgcgatccttttgttctgggctcacagtcaccgtccagatcttgttctggtttgggagggatacataacgggccaggaacttgttctggagacctgggaagggaagaattcctgggtaaagcatcaagaatgcttcctgagagcacagacattttgcctagaatacactcttcagttttctctcctcttaaagagatcattttaggaagccctcctagtctccacagtgagttccaggacaacgagggccacatagaaagaccctgtctcagaagaaaagggtaataatgatgatgataataataataatgataaaagaagacatgctgaggaagccatgggaagcaagccaggaagccacattgctctatggtctctgcttcaggtcttgcctctaggttactgccttggcttctaaacttcatgatggattgtaacctgtaagccaaataaacatttcctccccgagtttgatttggtcaatattttaatctcaggaacagaaagtgaactaaaacagcctcatccatcttcggcctccttagcccggccttagacagaaccctaagtcaggttagcaagaactgtcacgtggtgtgccctgttcccccatctttagatctgatccagtgaaccaacttctatttttttgtgttaagtccttgacttttcttcagcaagaatcttgctgagttcactcagaagaaactccccgtcttgaggtctttagtaatctccatccactgaccctgtccgttccttagctctaagttccccagctgttcctgtagcatggggaactgggaatgttatcatcccagtgatgacaggtcgagggcgttgagggaccactgtcgtggaatactgtgttgtctgtctgtatcctccctgcaagccaatgattttctttcctctaacccatactctcctaatgaggaatcagggggctcagtggacccaggttggggaagatcctgtatcctttccaggccttttaaaggggaggagcaaactgtcccttctacttacactggaggatcctggcttccacattcttcagttgagacatggaagtggggcgccaagtggggagccagctactcagccagccctgaggcctacaagacacaaaggtacttactgacaacactggaaagaagccactgttcccagccttgctgatagctcctagagttatcagggtacaaggtgtttcccaacttcaggaggcctgcccttcatggtcttcaatatcagcaatgcctaagcagtccgatagatacactgttactctttccttaggcaaatggctattaagaacaatggcccttaacagatagcagataccatgtacacaaaacttgactcttttgtatttattaccttcctggagctttacaactcctctttgtttctggttattttaatctatgttcaaggagattacagagggagagggagagactttcactaatatttccattattctttgtcactctcagaactagccgttcttttagggtattacagacaaattcccatctgctgtcatgcatgcttctggaagtttggggtgctgttagtgcctgattggggaatccatccatcagggatgaatttagagctggggcaggcaaggaccaaggggtaagatatctggattcatgtcaccaaaagacacaggtggcctctggcccatttttcaggttgtaaaactaggagaaaacttgcctatgtcctagagtaaaactggtaacttatcctgctttccctttcacacccagtgactcagccactgaagagcagaggtgccaagcactggctctggagtatacagaactcctgggtctgaactatagacccacaagtgaggaacggaaggggttgaggtccagacatacagtgaaccttgacaggtgcctgccacaaatgtagttcttgttctacctttcctgtcttgcatgttttctctctttttgtgaactctgcctaggtgaaggtaagaggatggttgcagcaagggcttgtgggtttgagcaggagaagatgatggcatccttggcggaaccatcccagctactcatagcatacacaatgggtaccctgagtatcatgggaactcgctggatgaagcaccagtacctagaccacagatcttggccagtctcaaaagagagacttcctctttgcattgtaggctataacaagtcagaccatgacacctgaatgaaccccacacatctctaactctggacagcagagctcaagagaaatgcttccctatgagacagcaacactggcagcagtccacacaggcctggaaggggtgggggttgggggacagggagctatgggcacagcttggcctttcttctgtacaaacaatccagaaagagaaaaggcaacagtgcctgtcacactgtgtgtcagtgctattagggaggtgagagctgaggtgggagagtgaggcaagcagcctcttaacattgagcaagtctctgaatttctatgggcatccgcatctgttgctttatttgtaaaacggagctgaatggcctgagtcttctttggctctagtgccgtttcccgcaagtcactgtaggcaccataaatttcctcttagaaagcaatactcttcttgggcagttcttttaggtcccttacacgattgtttactattgatacaaagttatttcgttgttctgcagatccaaaaggacaaatattaggtcaagggaaggccctgttcccgtgaaacccttggagctgagtcattctcctctaagcaactttttcccgatcctgttagaccaccatcacacaggtggcatctcaaacttgatggccttgggcgagcagtaaccacatcccaatctaacaaacctacttctgaaaccacggcagtaagcatgtgtttatgattaagaacactatcaactaggattgcaagcagaacgtaaaggcggccaagggctaaaggaatttgcaagccagtttcacactaattccaccgtagtggagacttctttctcctacccatgccttgtccttcaagggcttttcacacccacgactttagttccgggcaagtctccacaagcaccacgtccgcatcgggaagagctagcttattctcgtgctttaccactaatctaactgggctaccaggggggcgatcgcgaagactagtggaaagtcagagtccccaggctgaacgcaaagcttaaccctcaacactctcccagctccgcagccttctcatctctcagcgctcccggggctcctgagcgcaacccatccctccctggaagccaacctgaaaggaaaggcggggagtctgaagctgtccgcaagtacagacagtccccggatcctggcccggacagatagagacagaaagagaaacggacaggagtaactcactgctgctccagatcatcagccatagtaaacaagccctgccgggtcgagctgagccagcccatccctccgctcgacgccagaaccagctgacccagggaagtatcggataacaaagggggcggggccggaggcggggcctgggtcgctagcggggttctagcaggcaaagttggcagaccgaccaactcagcacatggacagcaatcagttgggtgcttccttctgtttgctccctctggcctgcgtccaggctgaacactacagttccacaaaagtaggctcctaatccggatcacatccctttgggggacagtgagggagacaggaagacaggtagtttaaaactccaagttcctcactggaatgccaccagccccgcctccacacctccttcaattaaagagtgaaggaactgctttgcctcttgctcacgttctcaagcttccctctgtatctcaggtcacagacgcttcatctgccttggtagtcctatggaaatgatttagatgtccgtggagtcataagggtgcttcctataaaagggcctcggatattgtaacccaagatttcccggttccagaaatacaaaaagcaagctgcctagttaaattttagacagcaaagtttaaagctaagtaggctccctgtagtatttggggcatcctgtattcacagctctaagatgaggggtgacacctgtcagcataagcatttctctgttctggggatgtcttgcctcaacctactttccaaggaaaaagtagcagtatcctgcttccttccattcggtggacctcccagaggagggccagttaaaggcctaacgcataaggctgggcgtgattaggtatgtggatataagattaaggatgtgggatgtgaagtgacttaacccagaagttttgagcacatttcaggctggctcggcagagaggcgggacacatcttgaagctggcttcagaattcacttgaaatggcaaagggggtgtggcatccctggagcggctccctttccgattatccactgcagtagtttaatcatacttaaggggaaagaatctactgaggactctctctctctctctctctctctcactctctctcgctctctctcgctctctctcgctctcttacacacacacacacacacacacacacacacacacacacacacacgtcaaggtgtatttgtcctgggttggcctcacattggatgtgtatctgaggatgatcttgcttccgagtctcctgtttctatctctggagtgctgggattatagggtgttctgccaggcttgttgattcaagattgtggatcgaacccagggctttctgcttgctagctaggcactttagcagtggagctatgttcctagtcctacagtacttttctttggtcttcttgaaagacctaagtgaacctgagatttattctttccagaaacacaatgttaaactgatcattataagggtttaaagttgaagagaactggaattttcagaaatgtccatccatgattttagccaagctcagtggtcccacaattcactatacacagtcattgggtaggcttgataacaacgcagcttcctgtttcccatcctcagaatctaattcagttagtttggtttgaggctagaaagctgcttttcttttctttttttttttttgcattgaaggtgctggtgttccagaagacacactagttaaacaaatagaaccaatggtcagaagtctgggttaagttcaagttctttgttttgtcatttatttcctgatcttgggcaagtcattttgtctggctgctgcttcttctggagtgtgtggcttgtgagaattcactaaggcaattcaaagaagatttagcatacgtactttaacaatgatgtatcttatgtccaaagccaaacattatgttacacaaagaatccaatgataaaaagaaaggaagtcatcttttttggtggtccccctacagactccccaggctggttttggagagctggcaactatgtagtcagaacttagttcaaacttccctccttctaaaagagacccccatcatcagggcaccacatgactttagtttattttcctcagaacaccattttaaaaggctcttgcataatccatactcatttgcccctcctccagaaattaagtttcagggggggaatcttgtctgtttagcaccctgctttgctccctgcccacagcaaggtatgtgcttggcatttggtgaatgcatggacaagcaggctagtaagcatgcctgtctgacagaatgaagcattaagtgctaagaatgaagtactaaattctgagggtactaagtactaagtagctgacagaatgaagtactaagttctaggacaacaaaagctcccataatctgataacctataaaatgtgggtccttttgggaaaggctgatcaggtgcgactggtattaggactttagattctagaacatatatgaggaacacagtgcagagagcattagtattctgtctccacatgttccaaataagcattagcatagttgtttagaaggaagaaattcaagtatatggaaaatgttctttataatgaaagttatcctaaggtatttccagaattgatataactcaggattgagtagatcttctagaattatatacaatgaaatgaactcttggtacctactctagacaggcctctggagagaaaaatgtattctccccttcttatcttgaagtcaagacacatatggaagaatatatcctatcttaaaaacatatcttttaaaacatgcatgatttgatacataaagtattgtactcttttttattttttttctggttttgtttttttgagacagggtttctctgtgtagccctggctgtcctggaactcactctgtagaccaggctggcctccaactcaggaattcacctgcctctgcctcccaagtgctgggattaaaggcgtgcaccagtactgcctggctgataatataatttcttaggagaaagaatgaaagaatcacagagtatgccccctctactctcccatatcttatattgtggagcaccttagtaatgaagcctctaaggtcttctctgacttctgatttgacttaaaacctaatttgtctttgccagtcatcagatttacagtgctagcgtcatcttttgcatgcccaaagtattggagctttgcagtatggccgagttttaattatttggagaaacagaggtcgttcatgtcagaatgaataattgttagcaagtgcaaacatcttctgggcatttaccatgggctctggtctttgctgcttaatgtttgacattatttcatttaaccccaacgaaaacagtgctgtgattcaggtattgttatttccatgtcatggagatggaaaatgagaccatagtgacatatacctgtaatttcagcactcagtaagcagaggcaggaggattgcaaatttgaatccattctgggatacatagtaatttccaggttaggctacataaagaaaccttgtcaaaaagaacacaaagaagggaagcaagaattaaatgttaagtgatcagtctcaagtaattagtagtatgtagaatcaaagtttaacaccctctttgtctgactctggaacttgaacttttatctactatccctctgcacatgagctttttacacatagtaatgttctgactcacactactcaaaaccaatgaccatatgatttcctattgagagtttagttaagttcatatactgaacacacaacaaaacttttccgtattgttaattcaggtagctgagaaaatctggagttcagaatggctttgtctcagaatgagtatgcttgtctcaataagtgatgtcttgcattgattctgtcttcctagggagttcctatgaagatgttaatgacaaagatcaaaggctaagatgcgtctggaaggtgctgggatgatggcacaggaacttctggaagaattcattactggataattagaaacagccagttagcccatttggccttaagttgactaccagaggaatgtgttctacttgtgctgagacagggagaagggttcaattgcagatgcatttcatattatgtggagtaggaacccgtctggttatccttccacatcccacccactctacagtaacacaagagcacagaggctacatttctaggagtgcaaacttctctcttatgaatatgtatttacctcttttaacagactaaggctttccaaagacacgagtgattcactggaacctgggcagggctatttaagtcttattggattgtggcgctaagtgtttccgggctaaatacagataacaagcgacagtagttcagttgcgggtttagaaatgctgctcaactagttaggcagggcagttggaagtgtcttaaacgctgaaatgaagtaccggattctatgcgggtagactttttaactgaaagatgagatactaggtttagaaggtcgggttattgtgaacttgtaatggcagtgcaaacccgaaggcagaacttaagttttcttcagctaaaacgctaaaaagcagttaattgtacttgttaaaacctcaaactttcaattctttttctataaaatgattcagaggatcaggttgaaacaaatatgctctttggagccattcaaggaatattataacaatacctgttgtacgatgtcagtttgctgctgatcctgacccttcactctacgcacaagtgactatctctctttttagacagtgactgattaacctaaaaattcctacaatataactacagctattggacctccttggtactcaacgagcgtttgttgaatgaatgaatacctgctggcttaggttcttcgtggggcccagattcagccttccagttcaggatcctgtagaggtcaaccctctcccgccagtgtaaaccggcgcttggcccgtataagcatagttctcactgcggaggaacttgacctgctctaatgattggtcataggcatctgaagatagagcttttaagagaattagggccaggcaggttaagtccctggaccgccagcttggtctctaagcagattctcaagctagaccactgagggggatcaaagagagccggaactctctgggaagcgtctctgtccgctgttaaacctctccccttgttccggtcacaaatctcgtcgccagagcaacagtgggcgtcaacaaacgcagggcggaaataaggctatagtacacgtctccagagggggagataggccctgcgcaggagcattaatttatttccgtttgtagttctcagtctggatcagcagcctgcgtctgcgcattaattgtgacgtaccaatgctggcctttatgccggagccaattggcccgccggtgtgggcgtggctagggcccgctaacgcgcacgcgcgagccacatagtctgtggtcgtccggtatccgaagtccccgtgttcgtcatgtcggcgtctgtggtgtccgtcatctcccggttcctggaggagtacttgagctccactccgcagcggctgaagttgctggacgcctatctcctttatatactgctgaccggggcgctgcagttcggctactgtctcctcgtgggcaccttccccttcaactcgttcctctctggcttcatctcttgtgtgggcagcttcatcctagcgggtaatgattctgtaacctggtcataatgtcccactttggcgcgcagcttcgtcctcacggtaccctttggtaatttgtagaaggccgtcgtctgtgaagtcacgcttacttcttgggatccaggaagcaggctcagaaatgtcacgtttctaatgcctaacaggagttgaaactgaatatgtaaagaaatagctcttctggtgttcgtcgcaattaatacttctttaaggaaaaatatcctaccttgatgaaactttaacacaaatttaaagttggtagagctttaaattaaaatgccaagctgagccatttctatcactttggcctaatccctgcttcatctaggagaagactttagtgatagtataggaatataaatattagtgactgcttgtgaggaggtaatccaattgatgctggctttttagttgcccctacttatttctgtgcataatttatgtgctttttctctttaccctcaactcaatttttattcacacaattgtgtattagctcttctttcgggtctacgcatttaataaccttacagacttccaggtttaatgaggattgccgccatggatttcatctgaagtctgacctttcttgccccatggaactgagagaatactgggaacaggtttggctaaagaatgttactaccaaatgtatcatggtcagtcagcagtgttttgggggtttattagcaattgttttcctcagtgaattacagctggtttgggcagagacaaaatatagcattggacttgtttggagacttgatttagagtcttaacataaacctcacgtcacatgtacacattcacattgctaggtcaggcccactgggaacaattttacttttcagaacttaaataggtcccagccgacttgtgccccagtcagagctagagctgcaaagtcagcttattcagtggtcatcatattgtctttgggttttggtccagtttctggaggctacaccctaaccatcaggatatgttagcaccattagccaggtctgacaaacctctctactgtgcccaatactgttcccgacaactttattaaccagccaggagaaagcatttgctgagaacctcttacttatttagcctctggtgatggaagtgtaggaacagggtggggctaacatctgatttaagtaaggtctctcctgttgaagccacccatcttcacaagcctctgagttaagtcctgacttaccagaactacatagaaaaaaagtgatttgctggaaagttaggttagtgtgctcacactctctctttcatcccatctgtctttcctttccttttcttttcttttcttttctttctttttttttttctttttggtagatgacttttgctttttttttttttttttttcttttaaagatttatttacttatgtgagtacattgtagctgtcttcagacacagcagaggagtgcagaagatcttattacagatggttgtgagccaccatgtggttgctgggaattgaattcaggacctctggaagagcagtcagtgctcttaaccactgagccatctcttcagcaccagccccagccccagccccagcttttgcttttttttttttttaaatgttcttttaaaagtatttttgtgagcatctttgtgtgcatataatgtattgtaaagtgtcattatgtgtcagtgtgcatgtgtgtgtatatggaggtcaaagagcagaagtattcattggctagactgaactggctggtggatagagaactctggggagggagtgtcttcctgttgtatggtgtcttgtctgcctctctccaactctctgcaactccacagttaaagatgtgccagcaaaccaggtccttatgcttagaggcaggcactttaccaactgaaacatctctccagctcctaagtcctgtttttgtgcctgttgaggctgaaatgatcaggtttcagtgggaggtatatatatggcttgttattgactagactgcttagcaaaggaacactgttagtagtgaggtcattattaggagtgagggcattattattagtgaggccattattagtgaggacattattagtactgaggtcattattagtagtaagattggtgttagtagtgatatttacaaatcttttaggtaacagggaatagggtgagagaaataaaattgggtttaaggaaaagaaaagggtttctgataattcattgttgctgaagaaagttatcatttgcattctcttcccttcagtgaactcagggtattttgtcactgagctaaattctcagatccattcatcatccacccacctatccatcctttcttttttttttttttttccttttaatttctttttttttttttgagacagggttttaatgtgtatccctgccttgctggaactgtagattgggttgaccttgaacacagagatcagtgtacctccatgttctgagtgctggggttaaaggtgtatcagcaggccggctgccatgtttcttttgacagcattcattttactaagtccaacttcttttgctaggccagatcattgcctggtaacttgttttagtgaaaaattagaaatctggctgtttggccttcgctcacgttgttgagacaggggacctcaggcctggtgtttttgacttttctgtggtctttgggaagagcctggaaggggcagctttgctgagggaggttatagggaattctgggggaggattttgaaagaccaagtggcactaatgctggagctttggcctatttctgtaggagatcatctgagaattaacagtgacagcacaggcagatagatggctcagtgggtgagggtccttgtcaccaagcctgagcatcacctgagtttgatccctggggcctgggtcgggaggagagaaccaactcctgcattcttctctcacctccacatggacacactcacactaagtaaagcgtaaatagcatgcacacctgctgtccaacaacagttctctttttggaagtgaagggcagacttgaagttgatgttagttgcatgtcctgggggaggaccctctttggattgagtctcttcatgcttttggctggttgtttcttttgcatgtacatttgctctttagaaattggttaggacactgtaaatgagtttagaatgctggcatcaaacatttgaatcctgaaaagacacaatgctgtcttctgtttcctcatggctgggtggcttatttagggtctcaggaagggacttgaggtgagagggcacgagggatgggcttattcagcagcggatagtgtagtgggtttttaaaggacctcagggaagtcattttcctatctcagccatgctcagcagctgtctgtttatcttcctgttagctatcactagaggaggaacatctgtcgagtcagagttaacattccagtgttggtagtctttgtagtttccttttgtacctagctgggagctgctcatctcaagaactgtttagggagattaagtggcaattagttaagtctgtctttaaagtaagtcttactaggcagacacgccaccactgagcctcgtccctagtctgtgaagtcattgttttaagttactttacaactttggttcgtccgtactcaagcttatggaaacagttttatgggccggagagatggcttagttggttagagtgcttacagcggtgagttcagatacctagcaccaatgtcagaagctaggcatggtacctatgcctataaccccagtgctggagtgggggtgggaggcgcagggcagcatctaagaggattgctgagtcttgctggctgccagctcaggttcaatgagagaccctgtctcaaaggaataaggatgaaagagagcaggacacccaatgtcctcggcctctgaaagtatgcacacacaggcacgtgcatctggacacacgtgcacacacgccatacacacatataccacattcatgtctctgtctcacacacacacacacacacacacacacacacacactcacacacacactcacacacacacacacacacacacgacgacatttacaaagtaaagttttagtactcgcagttaagaaatcacagaggagtttgcatttgagagacacggagactaacatggagtgttttttgtctcaaggaagccattggcttatgtggactggggtggagctactttagggagtgtcctttgatctttggattcctctcagctactgtccaggaaattgggagtttgccaacttcgtggctgattgtctggtttctaaatgtcctatccatcacttttttattctcggtgtctcaggctgcttcctagctttgcagcccgtgcgtggtatctcttttagcttgatctgatttgcacgcctgatcatgttacttaaccaaatttgtctgtggtttccaaagtagagtttgtgttttgtttagtttgtttgttttttcaggacacaggctcttttgggagctgaccttgttaacaccaccctcttcatcattgtctagtgtcagtaagtcatttgccattccgaggttcttgtccctttctttactctgcagagcttggttcacatctgacccctctcagttcacggttgttgactcttccagtggacccagggctctcttgtccttgcttgcgtgtgtatgtgggggatgaggtaaggaagaggagaggtgggactcttccattagcctgtatttcttgtacttgtctgccctctgggaggcgagggcaggcgctttcatgcctgcatccttgtgcttgttaaattgtgagcacagctgtcttaatttaaggaagatggaggactgtttgccaggttctgtgctggtgtgctgtggattcagctgtgaggatcacagatgcggctcctccttaagagtcttacagtctgaaggaggatgcagacaggtctctgtggaagtattgctagtgaggacaggagcctgatggctccctggccctttcagtgctcatgcagtgtgtccctcgtgtgtccacttcccagaatgtgcttcgtaacttctcacagttttctccatttctttgcctgtattcacagtttatcttatatattagttttttactagcaaagtgagagtagccaggagtctgttcatcttctagtggctcacacctgctcctgtgcctctgctgtttgattccccccccatgtcagctcttgcacttagatacacagaggcaccagtcttctcttggtggctgaacagcttctgtggtgatcccttcattcagcattgtgggttttctctattgagtcattctcaagttttagacttgctctaatattgtctaatcttacagttgaaccaggcatggtggtgcatacttttagtcttagctcttgagtgaccgaggcaggaggatatctatgaatttgaggccaggctggtttacatagtgagttccaggccaaccaagaccctgtctcaaaaaggaaaaagaaaataagttccagtcgatcccaggcactgctagcaaccatcgctagcatcttttccttctcccttgttgtagagcttcttgaaggagtagttgctgtgtctccctttcccccacatatttctcagtgctcttgtgctgtggcctgtccccaccacttcctcaaactattttcccatgtggccagatggagtagtcatccgcctcactttacctgactgctcagcattagtatttagctcaaatggctggttctttctgagtgaaacactcgcttctcagcactcttgtgactgcctcttcctcgttcctcctcacctcctgctggcttttccttcccactgtgctgggcacttcattttgtatttctttccataggtgaatttttttttttttctcaacagggtttctctgtgtagccctgctgtcctggaactcactctgtagaccaggctggctttgaactcagaaatccgcctgcctctgcctcccaagtgctgggattaaaggcgtgcgccaccactgcctggcaccataggtgaatttaagttctgtatcctgtccagttggttcaaaataccaaatctacttgctgacgtatttctctttgatgtctcttcaatcgctcatgtttacatatcccaaatggacattccccttacccttcttcccagccatctgcttctttaccagccagtgtacagtgtcagccctgggtaggttgttcagccagatatataggaggtctttttgatctcataatttctctcaactcccacatccatttcaccagcaagctttgtcttctctggaatataggctgtctctatctctgtttctgcctacttttaccaccttaaccctgagctcttcatttcctaagtcattcatctttagtcctgcaaaccattctttatgttgcagtctggccttttaaagaatgtgagtcgttgttgcttggctagtcgaacccttgactgttgcttcattgccctttggctaagtctagactctgtcctgagtcctcaatatcagtgaccagatagcttggaagtggcaagactgtttttactatctgtattgctctgccccagatctttatgtgcctggctttttagcctttaaatggtctttagtagcatttttaaagacacgactactggatacaacagccttctagtctccttatcttgctacattttctccacagtgtgtaccccacacagaatttccttgttggtttgcagactggagacacttgtttgtctccacggactataggtccctcgggagccagagtcctgtatctggtcctgccatcttcccagcgtctagagtgatgcttgactcatagcaggcgcttgttacagcttttgctaaacacatgagcctttaaggagatgatgagcagaggtgctggatgggcagtcaggaggctgtcggtttccgtctctggaagtcctcagggagacgctgaaccctcatttctggagcactttctttatctgtctgtgtccaagccagctgagggatatggcatacttacgagtgacacaggatttggagggttggtggttctcatgctcatcaaatccaggacctggtaagtgtccttcagacaatttcccaggctcttctttggaggctgcttccagctcacctgtctcccaccacttcctggacattgctctagtttgctttctatggctgtgataaactacgaccagtagcaacctggggaggaaagggcttatttgacttacatggcatagccctttatcaagggaagtaaaagcaggaactgaagtcaagaccatggaggactgctgcttactgcttgctcaacccgttccttacacaaccaggaccacctgtctaggggggatagttgcactgcctacagtgagctgggtccttccatattagtcattaattaggaaaatgcaggagggatgactcagcagttatgaatacttttatagttgcttttctagaggacccaggttcgaattgaacctggcaccttgagggggtttgacatgctcttctggcctcctatgacaccaggtacacaagtgatacacagacttacatgaagacaaaatacccaataaataaaataaattttttaaaaggaaaaaaaatgcccccaacccccccagcctagtctgatagaggcaacccaaagccccacatgcagttccccagctgaggttctcatttcagctgactagtttgtgtcaagttggcaaaaagaaaaaaagaaaagaatccaactagcataggcattttatgcaccagatggggtatttgaagggctagagaatggctcagcaattcagagtgttggctattcttccagaggacccaggttccatccccagcacccacatggtttctcacaaccatttatgtaacttcagttccggggtatccagtgctgtccagtaacctcaatgggcaccaggcgcacacagatgatgcatgtatacacatgtaggcaaaacactcatacacatacactaaacaagtttttaaaaatggggtgttgatctcaatggcctctgaggtccactggatagttgtggggttgacttgtgcactgtaacttaatttgagttgttatagtcattttaaggtgactagcagctcatgactgtatccactggcacaaagcttttctcttgtcccctcatagttactccagacactacctcattttctatcccagtgctgttaacagttctgtatttatttctctagagtttttgctagctgacaagtaagtgatagactagatgtaaagtaaatatgaacatagtaattatatataaaagttacagttttagaaagagcagtttggggcccacggcagagcagctgcagaagcaggcagacctgagttaaggtcccagcactccaggtctgtcacccagggtggaggaaggggaaggcaggcagaccttgaacctcattggctagccagaccagggagtctaagcttcaagtagaatgtctgtgagaatccatgagttcataagaactcccttctcaaaaataaggtaggtggactggaaagatggctcagtggttaagatcacttcctgctttcagaggatctgagtttgattcccagaatccacatccaacctccaggaatgccctcgtcagccttttaggagcacctgtatacacaagtcatatagacatggcacacagtgaagtgcgcgtgcgtgcacatacatgcacacacagatacacagagacatacacacatacacagagacatacacacagatacacacacacacacacagatacacacacacacgcatgataaaaatgaatctgaaaaaaattaggtgggatgtgaatgaggaagattcctgaatttaacctctgacctccacacacatgtatgtgtgcacctacccttatgttcagcacatatgaacatgtacatatacatacacaaaatacagacatttacacgcaatactacagacacatacaaaaagagagctgacatgagttagtgattttgactatttttttcactcagtgaaagtgaatagctttcttgttagtgtatagagaatttcccttagtctgaataattgcataggatttcattgcaggtgtgtagtatgatttaattattccccttggtgacatttggagcatttctttttgttttctttcaattttgcaaacctactgtgttttgtaaaacacattcattgttaaaaggtaaaaacattttaaatactaagtggtattgccagtggctttcccccagaggtggactagcctggccttttacagcaaggctttaagtggttttcttactccagccagtgcccttcataaaggtcagtgcacttccgaagtgtgtctgtgcttaggttgatgggaactgttgccatggtgatgaactctggaggactaatctgatcattctgtcttctcagtggattctttgttaatgttggagtggatgctagcctgaagcaggtgcaataatttattgaagccataaaaggtgtttgagcagagaatgcccctggagctgcttttcatgtctgggtgactggctgccgcctcgttagagacttcagggatacagaaacgtgggagtagagatcactgtcaagagtcttgtgtgttggatcttctgttgtcttttgtgacaaataaagccactagaactttaccaaagacagtgtatctacagcaggaggcccttgtggaccttcagctgtactcctgatctctgccgtgtatcttctggtagaagatgattaagatgctatagggtcatcattcatcccagtcttcgttactgctgcatctgtagcccgtgtaggcataattagacaccttgaagtcaaccagcttaagagtgcttaggcagttaggaggtgtgagtaagcttacagctttagcacctctgatgtgttgttttccccctttattgttcctttaataacggaaagttaagattgtaaaggtatataattttatgagttttagttttctatttacttttttcagtttttagttattggatgtgtgtgtgctgtcaggcttgtcggcaaatgtcctccccagaaagctacctcacaatcttagtgtgatattttttgagacagtgtctgatgtagctcaggttccccttggacttgctgtggacttggagatgaccttgaatgattcgcccttacacctgctcctgcagtgccaggctgcagcggtgcagcaccatacctagtttggggtgaggttttagacactccggtctaactatgatgacttggatcaggacagaacgttatcactactgtacaggtttcttgcattttaagccatgattctgtcctgagagatgaaagtcactatctgtcttatgctactgtagatttactcagcctattttgtttatttgtttttgttgtcttgactttttgagagagtgtcttaactctgtagtccagactggtctccgaacttgtggctgtcctccttcagactcacgttctgggatcacaggtgtggaccaccaggtctggctggtttgcctggtgttaaggctccttatgtatgaatcatctagtgtgcactctttatgtttgagttgtgctgcatagcgtggtgaattccacctaacttggatgtagcagaagttccttttcattgctgtttagttttttcttgtctacatgtggtatgtagtctccctgtactgttaatagacattaacttttctagatggtgtacatacatcacagggatcactcctgtgcgtgcctcttggctgtggtgctttcattttattagagactttccatcacgggatatatttgtgtattgattagcaatcatttgttttatatttctgaataatgacttttgtgttttgtttcttacccagtttgcctgagaatacagatcaacccccagaacaaggcggacttccaaggcatctctccggagcgagcctttgctgacttcctctttgccagcacgatcctgcaccttgtcgtcatgaacttcgttggctgaactccgtttccttactgtggagttggagattggcggagcgtaagtggccatcccagccttgtgctgctgtgctgattccagcaggtggattagatgggctggttctggtcctggtcggccgagttcccatggtacagtagggtgtttgcaggcttgcccagcttcagtgggcagcagtttcatcgcgctcgtcagcctgtgggttacaggtgtgctcccaaaggcttttgaagaaagataaactgcaagttttgcttttagatttgttcttgagttttttcccaattctgattgccattgatgttaaatattaattatggccattgttgcctggtaggtactcagagtagtgtgaatgtatgacagctgcttcttaggaatgtgtgccctgaactcaaatggtaaagttggattaacttgtgagaagacttagaaccagacgggtagcattcggtttgtttgcttcatcccttgttaagcacgaagccatcttgcccccccaaacaaactttacagaattttgatagggaaatgcaggtaggcctagatctcttttgtagagctgaaaattctctctgccctcccttcataggttgtgtgccctcctctccactctcccgtcttgtctcagttacttcattaatgctgtgacaagacaccatggcagaggcagcttgtggaagaaagtgtgtaatttggtattcattgctgcaaagagctagagtctatggctgtcagggtggggagcatggcagcaggcaggcttggtgttagggcagtagctggcagcttacatcttgagccacaagcttgaaacaaagctaactgagagtggcatgggcttttgaacctgaaagcctactcacagtgacatacctcctccaacaaggacacacctcctaatccttcccaaacagttccacctactgggtggaagcattcaaacataggagcctgtggccattctcattcaaacctctacatcccagaagcagagtcttaagcagtgaaacggacatgatttttcccagcacataccaatatttttcctttgatgagagaaaatgagccgggaacaatgcagttgcttcccagatgcacaggcgcacgatgtagagtatcctctgccgcttgatgtttggccctatgcccatgcaactcagggacgaatgcctgtgcttttcctttcctttgcacaataagatttcgtactattgcttccaggtggcaagagaagagaatcttaggaaataataaccttttgggagaaaatgtcccaggtccaccctctttacatcactacatggaaacctgtgtgttggtactgagagcctcagaaacctcacacgagaaccagggatgcatggtgtgtgcagaatcgcccagtcccagattgcagtgcccgtcactttgttgaaagtagtaggctcctagaaaaggtggggaaacgctcttgtctggggatcgccctgcacattttccagaggcctttgacccgatacacgctagctaccctgtggtcccacacatctgtctgtcccatctgtgtggttttcattcagctgtgtgctctaatggtcacactaactcagaaggtaggatgaaaaggaaaacaaaaacaagaccactcagtgcgcttataaaacactcattcctaagacactggcggtgttgatgcccttattctgtgaaatgaattacggggctatagggcagcacagttggggctagattctcatgttgctgcctaacattctccttattttccagttgacagatgggcattttaaaaaatttaatgaatttgaaggtggtatttaaaaccaggaagaaaaggcatatcaaaagaaaatggcattgcgctgtaaaagtcagtgtgacttaggggggccagtgaagggcagttgcttcaagtggcgctcactgcatgtcctacaagtgcttgtgagtatcatttgactttcagatggcctcaagcaggcgagcctgccattcccatttgcagactgggcactgagagacccagagagcacgaggagaaatctttcatttgtttttgctttgaaacagactctcgcttcaaatcagttacgtactgaaggatggccttgtgttcttgaccctccaacccttgcctcccacgtgctgggattgcaagtataggtcctcagttcctgggcccaattttagatcctttttctaatttaaaaatttttaattttaatttgcatatatgtatatgtcttgtgggtttatgtatgttagtgcaggttcccatggcgaccagaagtgatgggtctcctggagctagttataggcagttaggaactgctcattgtcgtgttgggtaccaaacttgggtcttttgaaagaccagtttataatcttaactgctgagtcatctctccagctccagtttcaagattgttggcttgtttgtttgtttttgtagacagggtttctctgtgtagttctggctgtcctagaacttgctctataccagcctagcctccgactcagagatcctcctgtgtctgggattaaagatgtgtgccatagtctgaccggtttcagggtttttaaaagaaaggatgaaaagggaaatggcgcaccattgggttgcatttggggagttcacatacctggcgatatgggccatgggactggggaaagtgacgtgggcaccaagaataacacaacgttagtgtgcttgccttcctggatggaggttgttgccagaagcctgggctgaaattttgttagttctgcttttttaatattatggggagagtctcttactatctttaaaatttcgtagcatttaatcctagctagtgctggaaggctacctttaatcctagctagtgctggaaggctacctttgagctgacagtactgtttattactaggcaattctctttctttctttttttaatttatcataatttagtaatctagagaattaccttgggaagggactcaaactgtattccttttttccatctccatctttatttttaattaattaagagacagggtctccttatcccaggcttgcctggaacttgaaaaaaaaattgttgtttaaaatttattagattttattgaggggggaggagctggtgtgtgtgtgtctgtgtgtgagtgtgtgtgtgtgtgtgtgcctagaacacatgtggtgaacaggactgactacctctgaaagctctctccaccgtgtaggtcctagggatcacactggggcatcagcatccagggaagtgcccatcctccctgagccagcccacttgccctggactttaaagaaaaaaagttttaatttattctttaacaattttacacatgtttgtggtgtattttggtagtaccgcccctacctagtaccccaccacatgctcttttcaaattattttataacctaccgagtccatttagggcttcctgcatgcatatgggcatggggccatctcttcagtctagatggtaccctctgcactctgccgccatctagtggatgcacctttcctatgctgggagtggatcacaaagcataggagttgtattttggtggaacaactaaagctagttcctttcccgtcatgggagggcagcaaaggcccaggtaagcgtaaatgccgaccaggggtttctttccatcctggctaggagacggcagtgctgagctagggatccttagcaggacccaggcttgtcttcctcacctgtgctgataaatgcaggatttcacagggttccctttgtcagtgtctggacttggctttcatttattctagaccctttattgcctccagctcggagtgccccctggcaatactgttcagtgtttagttgatgagcgagtgggtcccctaactgtatctcggtgcctcagccctcagggggctgggaagtcaggtaacttctttatgattggtcttaatagttcttaaaaagcattaattgattcttttaatttgtggctgaattattctggttggtcttttgaaggcagagagctagacagatgtagttagatttattcgtgtgtgtgtgtgtgtgtgggtgggtggggggggggtctgtggatatgggcagcatggcagatgatccaaggacaatgttcgggggttgctctctccttccttccaccgtgtgggtcctggggatggagcgcaggttgtcaggagtagcaggagtacccactgatccagctctttttttttttttttttttttgagatagtcttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggccttcattgtaatctcttacagctgttaactttcactaatacagttatgatgggcactgtgctgtggactccattttggttcgagttctctctctctctctctctctctccctcccttcctccctccctccctttccctcctccagttgttactttttattcatattctcatgggtgactaaacattaaagttcaaaataaaatgtccagtgttacagaactgtccatctataagatgcttcgtcagcaccacatctttaggattcctgtgtcttccacatgcaccttatatcagtgcatatagttcccctgcctgccctgtgcacggggagacagatagctgtgtatgtgcctgctttgaacctgaaggaacttggcctccgcaaaatttcagttgactttagtccttggtactaagtgactgagtgggcagttaatagtgaatgtttggatcctaagctctgatattcattgctctctatttttaaggacttttgagtaatgattatatatatatatatacacatacatatatatatatgtatatgtatatgaatgattatatatgtatgtttatgtatacacacatacttagaggattgtgtttgttaaaatattaaacatgcttaaatgggaaaggttacgagtggtttataagaagggataaagacagataacccaggtgtttctgcaaaggcggcatcattaccgtggtacaggagagaagtaggagcatgcatcttgggagagctgaggtgacctcacacagcacctgggtcctctgagtgtgtgtgcgtcccacccacaacagtggtcattggtcacatgattaatgttgcttggtggacttctgaaaagggactcaccaaccaaggaactaagttttaatttccttaatttatttatattttatttttatcagacagactcttctgaatccttagctagccttggactcaatccatagttaaggaagaccttgaacttctgaccctcctgcctccccaaggcctgggactgcggacgtgagccagcatgcctgacactgtgggctctgggtgttgtgatgctacagcatcctgccacctgtccccgcagccctgcctgcccatgatttaaggcggttttaaccagagttaaatacatgtgtgtagctgctgggtaatgtgttggacagaatagctgtggataaaattcccaagctaccaagttgtagatttatcatttctaaaggagaggattggcttagttgctttctggagtgtccttcattttagaagttatgatctgtgccttgtagtattagagtgattcaacagtgctctgctctcgggagttgagcacagttgtctctgatttatatcacccctagttccagctctgattgggtggtcaggatccagggaagggcagcatttgatcgtatctgtccaataatgacagtctagagaaggttctgggaaagagcccacagtcccaggagctgttgttattttcatctatagaatgaaatatagaaaatgtcattttcattatttcttatattttttcttgctttctattagggtgattagaataggtgggtcagatggtgctgtttcttcctgggggacagactggggaccccctcacctctctcagtaggtgccttccattttgcgtgtttcagtgacatcagggaggagattttgaggcagtttttgatagcagcctttattctgcttgcagatataaaagcattcttgtgagttcctcaccggtccattgtgccagcatttcagaaaccccaaggcctctgtttgagcacttgccaagtttgtcctcactggagaagacaaaacagnnnnnnnnnnnnnnnnnnnnnnnnnnnnnnnnnnnnnnnnnnnnnnnncatgtttttagtatcagaatccaccctgctcttagcagcagcctggccccactgcaggcattgctcaccttaacccaaagtaacttatgagacgtgagaactaaattacctcttcacagacctgactctttctgaggttctgagaagttttgtccacgttcttgagtctgtcctcaaactgaacattagtgctttgaggaatatgagggccaggaaggtgagtggctggtggagagttaggattggtaagtcaagagctggctgccagtctccagcacctcaacggcctttttttccttttctttttgtgagcttggaatttctgtgtgagcatagtccttctagaggctactctcatacaacgcttgtgaaacactggccatgttctggttattgtagcctggtctaaacactgcgatgcacttaggagtgcggcagctgtcttgtgggttgagagtttagatggaaggatttgggacatgacacacctttgtgcttctttcaggctcactctttgacgtcccctggatcagcattcttgagctggcagcttgttgcacatggcttcttcagattcgtgcttgactacgagtctcactggttgtgaggtggcacgtccaaagaactcccttcgctctatcggaccaactccacagtgtacgtctgttaacacagaatctgcctcccctcactgtagcccttactttccatattaaaaacatttcagcctccaagtgccattggttccttcatgtttgtgtgtccgtttccctcggctcagtgcgctctcatgacttgctcccagctgtgactcttcacctgtgacccttcacctttgttttcattaagtagttgtcattgctgacaacctggaaaatggcagtcctttgtcctttgctcggtcaggcaatcctttattaatccttcattgtctggaacggcaccagtgaacacttgtcagaaactgacctgtgtgctcttcctgctacgtccgtttccataagcttctgggagagtgaaatacatgtgtgtctctcgggcagtatagaacaagtgcaaagtgtgtgtgtgtgtgtgtgtgtgtgtgtgtgtgtgtgtgtgtgtgtgtgtgtggtgagagagaggtgtgactgtgactgcaggcaggtgtctctgtgtgtattgcattctgtgtgactctgtatgtgtccgagaggctggctgtgctgcctgtggcatgtgactggcgtgtgtgcgcgtgcacgggtgttgatttctctcacattgtttcccaaagctccctcacaagccttggtctcacgtcacagttgtcttcagagggtccagttctcctgaagtaggtcaggaaatgaagctcagatttgtgcttaagaccataggtcttcacaggagatcactttaaagacaaagccggagtagagtagcgtctgccggctgaagtctaggcatcctgtatccagtgagctctgtgtctctcaggagcagtaagtttgccatatatggggaacagccctgtcgtgttccctgaagctgattaccaaatgacccgtgctccagaagccctcccgtaggaccgcacgctgccataggctgaggaactcacagttctgttgcccgggtcacactggatcaaatcagtcttgggtgtagctgactacccctatcctggatgattgaggcttgccattcagtgggtagtcggccattagtggtactggccactgttggagctgttggaaaaggagactcccaggccttacccccaagcgacagaagcaaagctttgcattttaacacggtgccaggtgtggtggtgtgcacccggaagtctgagatgcccgcatttccagctctgggtgtatcctgcaactacccggaagcttaacagagcttgagcctctccattctttattagctctctgcttagctagacatactccagagtgagttaacaagccttttaggaatggttgggttcaatataatgacaaaacctggcaggggtcctgtgggccaaggctgagcactgaggagaagttcactaggatggctgagcgatcagtgtgctcgacactcgtgcagacatcctgcggctttccccggagaagtgggtgaggtttactttggattcaataagcagatatttcagatatgaaaagcaatcggactttgagagcaaaggaagacgtcacaacaatacgcgtgaagatttacatttctcgcagtggcttagagccacctgggccgggtactagtttccaggcgcagatctgcttttgtctcggggttgtgattttccccttggactagccttggcggcaggcgtagcttgctgtgagtctgtaccatttacaacagtacaaactactttcaggggtcttgagttcaaatttgaaaatgcaccataggtttgctgtagactttagttagcttgctctgtggctctcagttccataactagttgagttattcctcaactagggaagggccttccacaaggctccccgggcagaggggttggttttgctgactcaggtactgtatgggctgagggatggatgtcctgctgtttcctgcagcttccagctcacacctcctctgtgtgtgtgtgtgtgtgtttgggggggggttatttttatttcctgtgttcaatctgtggggctgcaagccatttaccacaactactgtacattgttccttgctcggcagtggtgggaaacagccctttgcaccctctgcctacacacttcctgtcaccacggcatgcaaatgttcctcctgcttcctctcccggcagcctgcacctctgctctttgatcacgtctgtgatcttggcccacaaagcgctcttgttatgattgttggaacatacttgggggaagtgacagagatttgttcccttctttgggaaagtcagcaagccagccagcatcagctagtttccagcacctggaagctgctagctcagttgtagctctggtgggttgtggactggaagtctaggctagtgtttgggtgcctcatgacttaagatttatcttagggttttcattgctgtgataaaacgccatggggtggggtggggggtggaagccccatgggaggaaagggtttgtttcagtttacagctgaaatccatcagtcggggaatgggggaagtcggggcaggaacgcaaggcaggagctgatgctcaaaccaggggtgaaagctgcctgctgccttacaataccttgctcagcctgctttcttatagcagggccagcttgcccagggtggcaccacctacaatgggttgggctttccctcatcagttactaagaaaatgcccccacaggcttgcccaccaatctgagggggacttttttcaattgacatcccttttcccaaatgattccagactgtcaaactgacatgaaaactagccagtataagacgatagctaattaaaaaaaaaaaaaaagttttccctgggtatgtgtggtcctttaccttgaataagaactttagtgagaaagaaaaaagtgagaatttctgtcagactagacagaaatattttacttacttaattttgaatttataagtctgagcacacaattttttttcctaatgtgggcagcccggtattgtggaatgtgctttgcatgatgtaaagtgttgaattgagactgtgttccgctacatattgtcttttgaaccttagaggaccctctgtctgtacaattctgtaaataattaattaggtgcctgggctgtgcccagtaggcatgggctataaagataagaagcagcctcgctgtctaggggtgagtaaacccactcatgccctgtgtgtctcgcacggtatcaagtgcctgttcccatctgccgttgaagttctatgatcccgtgaggttctctaatctcacagggatgtagtctcctttctccaagtggggaggtggagcgttgggttgccagtgttaggatgtgaatcttctttctgactcaaagcatttatttgctttggatgagctaatgactaatgagtctgggagcggtgatgcttcacgcatcagctacagattcaccggccctcatggaaggcagcagaactgacatctctcacatgatgcttcctccctcagcaccatatccagccggacggggtcttgccacggacctcgctggccagtgggaggagagaggtcccactagggacccattcttgctgctctcacagggatggaccactttgctttaaaaaattaaatattgccgggcgtggtggcgcacgcctttattcccagcactcgggaggcagaggcaggcggatttctgagttcgaggccagcctggtctacagagtgagtttcaggacagccagggctacacagagaaaccctgcctcggaaaaaaaaaaaagaaaaaaaaattatgtcatttcccccttccctccttctccctttcatctacttccctcccctcaatactttctcaaattcatggcctctggcctttttaattgtgataggtgtgtgtatgtttatgcacacacacacacacacacacacacacacacacacacacgtatgatttcagagctgaccatctggtgttggatagctggttggggggcttctccctggggaagaatgtttcccactgtcagtgttgcttggctgctgcgctccttgtttagggttggagaatcccccctcacatttctaagacgcaatctcagagcacacttcctgtttctccggttcttacagtcgttgtgcccccaatccccttctaagatgttccctgcgcctcgggtgcaggagctgggttgtcgatagatccgctggagccgggcaccccaggatccacggtcctctgcctctgacagggtgtggttttctttctgtatgcgtgcgtgcgcgtttgtgagtgtgtcagaggacatcttggcaggagtcggttctttccttgtaccatgtaggtactaaggttcaagcttgggtcaccagggcgtcactaggtgcctttgtatacagagtcatcttgtcttctgattttgccttatcactgaacttctgacccacggggctggcaaggtggctcagagagtaaaaaccccttctgcgcagccccggtggtctgagattgaccccccccgccccccagcttccacgcagaggtagagaactgactattgaagttctctgaccgtcgcagggcaccgcgccacaccatccccgccatgagactgagcctacagtttatgcatctattatgctatgtattccctcagcaggggagccttgtccacccatgctccctggagtggacagggctcgggtttgccattctaattcagtcctaaagaggaaccaagtaagtgcacacaatcacagctgagtcactgaagcagaatgtcagaaactggtctggttaggggccctgcctagctgatggctgcacctagcactaggacttcgtgttcgctctgtttggtgggaaaccaaggcatttggactagtccaccgtgtttttttgtttgtttgtttgttttttgtttttgtttttttgtttttcgagacagggtttctctgtgtagccctggctgtcctggaactcactcaggagaccaggctggcctcgaactcagaaatccacctgcctctgtctcctaagtgctgggattaaaggcatgcgccaccactgcccggcccaccgtggtcttatataagccagttcgtatgtttcctaagttgtcaaagaggcagagaaatgcgctgccttggttcaggtttgtaggatcgaaggaggtaatgtttgctttgatgttgagcaagcacacactatcgtgactcgggattctagacgaggatgttgcccgctcatgtgatatcattggaataactcagccagggtcagcaaggagaaggaaggatgccctagagtcgataaaaatcatgtcttgcgccaggcatggtggcgcatgcctttaatcccagcacttgggaggcagaggcaggtggatttctgagttcaaggccagtctggtctacagagtgagttccaggacagccagggctacacagagaaaccctgtctcgaaaagccaaaaaaaaaaaaaaaaaaaaatcgcgtcttgcagttttgttgaccacagtcttttaggtttaccttgggtatttcctgcccagactgaccatgaaacagaccagttgctcccacaacctaaaccatgttatttgatccacttcactctcaagttctgccagtcccatcttacgtctgtctgtgcttcttccatctggtgttttctttttttttccttggttgataaatttaatgtggatgtttcagagaatggaaggaactggatggtttcaaagtggatttcaggagggcttcaaaactggaatcctgtggcctctctttttgtttttgtttatttctgtttatttgtttattttggagacagggtttttctgtgtagccctggctgttctggaactcactctgtagactaggctggccttgaactcagaaatcagactgcctctgcctcccaagtactgggattaaaggcgtgcgccaccactgcccagccctgtggactctggaagggtggtatgctcacatttccaggacaaacacaccctaggatattgtaggacacactggctggaggaggaatgcttctcagaaaacctgccttgaggggaggtgcctggagagattgtatcctgctactactggctcaaggaatcctacaatcagggaagcccctggggtgccagagaggagggaaaaaaatgtgtctcctcacaggtgatacagtgagaagcatcaggggggccatgggataccgtggggtcctgtggtcctgaaaaaactgtgaccttgcaaaagctggaagtcatggaaggagtaacagatgcgcgtgatagaagctactggggccacagtcacgggcgaggtgggggaccgctgctgagcgggggacctggcgggccccaagcctatgtgagcgccggcatcctcacgcagcaggctgcttttatcgcagcatgggggtgcatgggtgcatccgagcaagcgcgcaggattatggtccatcctttcgctcgtgctgccatcccactgctttgtgtctgcctggggatttcggttcgcgaagcattagcataccattatctcctcagacaacagggagagaaggtgggcatgcattccggtctccgtgtgaataatggaaaatggagagagacaggggaaagttaaatgtgccacgaaggacactgaagcttacagaccctgctttgcctgacccctgcctgcctgaggactgccaggaagatattaacagaggccataaaattacagccattacgtctgtctcccatgctcacacagtgcccggactgtctgtgccttgactttaggcaatcttgagtttaatttacacacactgaggtgcagcaaacccaggctttccagctggatgcattttgacaggcatctaccccgatgtgcccatcatccaggttcagatcaaccgccccgaattccaaacccttgttctcctttcccatcagtcctttctccctagagacacctagcatgtgagtacctgttatgggcgacccctttggccatttcttaaactttagttgtatggagtcagagtccctgaaacctgacacagtgtctgccctttaacaggtatcccgctggaagaaggccttcgtttctaaactacctgagagaatgttggtacaaagaggagaactgaggctgcgggtttacaggctacagagtgaagtcatggatcctgggcctgccgggccccatattccatctcctggcttccaacagggtagtttctttctgggtttctcttgtagctgggtctcctaaacctgggcaggcagtgccccctgctgcctgaaggcctgaccctagactctttgcaggcagagaggatcacacaagtctggagtccagtgactggcacagggcaggaccctgtgaaacagaagccacttgtcattttattttcctttggaaagagtttttccgtaggatgcagggattttctttatcccgaataaacacgccgagggagaaagccttttggtggagtactgctgcccccgtgtggctaccttaagacactacaacagagtgggactcccaagacgaaagtttttcaggtttcaggttctgcgacttcctaggaccctgagagacagatgtccactagggttatctcttgacacttaaatttcctcctggagtggaaatgagagcgaatggggcttcttgtggaaggtatctgttggggaacgagctttagctgtgtgtgtaggcagctgcctctttcacaacctgtccagcacaagctggactggacatagactttctcccttgaactaagtatatagacttgtctaatttgagggcaatagaggtcaggggagggggacttcttgggagtggagccgcagtgcctccccagccggctgctgtgaatgggtgttaccaccaagacctgcaagccccacccaatgtgctctccgtggccttcttttctgcacctgtggttgggctgcggtgtaacggcccagcctacctcttctgggcacgtggcccggagagatcttatctctaactctgtatttttaactcctctttccagaggatgtggcttctgcgggagagcttcaaagggggacctgtttgcccatgtcagcaacctgacgtcatggaagtgggaggctgttcagacccaaacacctggagggaagtgggaaactttttccatttcctgttctacttctggctattgattcactatctgaccagcttacccatttcagggtgcagctgtctgtgtgattcttggaggaaatcctatgccttgtgtgtctgtatgaaaggagacagctgtgttacccatgtggcttttacccaaagcagggctggcgatccttcagactgccccccaccccaccccacccccacccgtagccagtacatgcaagagttacagtatttgacaggtctctcacactcacctctgggaaatatccctcggggacccagacttcaatcttgtccagggcggggtgggctggatatagacttcctgctttgtaaaccggaagcccttcttcccacatgttgctcgaggaactaggtttcagtgggtttgtgtgggtcactggggaaactgaaatggacattaagtgacctttggccctggatgctggttctcatgtaggaccagagtctttagacttttagaagccagtgtttcctggtaactgtcctgcaggattcagtcaacagtcatgaggctaatgtgagtctgaactcttcaagggcgcaccactcaagctctgattattctaatagtttttgccaagctactctattccttgcaaaaccgagacagtggctcacctggcctctgttaacgccaccacattccctctccagctcaggtccctcccagtgactgtgttgaccgtcatggggtcatctgttggtatctgttgggtgcaaggtactgcactaggtatggaggagctactggtgagcaaggtattcctcctatccgaagggtcatctatagtcccttgccaacatgtcacttggtaataaaacaatattagatttgatatagacatgagctttgggagttggattttatggtataccccaaacaaaaatgagacaaaactaaacccttgaagcctcagggggcggcctgagtggtcagagcacacacctgtccagcctgcctgtttctggactgaactgtgactccagctgcactggacaacgttgcagaacactttccacagttctagccttggaacgtgaagggtccatttttttttctgccttcagagctggcctgcagaaagcccttgagggagtaagggcatttatctagactctagagatacccattttacagctggccctggcaaggagtttgctggggtatgggtgccttctctttgggagttggtccagactggtctgggagcagtggcagccttgtgaccattgtcatgtcttcaggtttcctcagtagcctcttccagactaagcagtgagagatccagagtccgacgtggaagagtctctgcctgttccccacacttgttcagctcctgtggagatttagcctcagctgtgggagaaagttcttgttctgattggatggcgatgaagttgactttgatctatcagtggcctcctgtctgccttgtccaggcctcgcttgagttggggctggaagctatctatattcacttcaccgctgtgggaggcccttcaaatccctcccacgtcacctcactctggtcctcaggtgacgttagggttcttgtgacctctggatgttgctctctggggacactgggctagcatggttcaaccgaggctgggcctctttcacgtttagtgaggaggtctgtctttgattcctatactaccttctaggcttcttactctgtcccattcccacaaggtcccccttcagcctctgcattatggcagccagtttttaggagcccggcatctcctcagccacccacgctttctttgcctggattttttttttttttttaatagaacaaagtgaattaccactttaggagcaaggaaaaaaaaaagacaaactaatttgccctaagttcttaatggttgataaaggcttgctgcactaaccttcccatgggc

SEQ ID NO: 1476 - DNA, 638 bp, Mus musculus
cgtccggtatccgaagtccccgtgttcgtcatgtcggcgtctgtggtgtccgtcatctcccggttcctggaggagtacttgagctccactccgcagcggctgaagttgctggacgcctatctcctttatatactgctgaccggggcgctgcagttcggctactgtctcctcgtgggcaccttccccttcaactcgttcctctctggcttcatctcttgtgtgggcagcttcatcctagcggtttgcctgagaatacagatcaacccccagaacaaggcggacttccaaggcatctctccggagcgagcctttgctgacttcctctttgccagcacgatcctgcaccttgtcgtcatgaacttcgttggctgaactccgtttccttactgtggagttggagattggcggagcgctcactctttgacgtcccctggatcagcattcttgagctggcagcttgttgcacatggcttcttcagattcgtgcttgactacgagtctcactggttgtgaggtggcacgtccagagaactcccttcgctctatcggaccaactccacagtgtacgtctgttaacacagaatctgcctcccctcactgtagcccttactttccatattaaaaacatttcagcctcc

SEQ ID NO: 1477 - DNA, 341 bp, Mus musculus
atgtcggcgtctgtggtgtccgtcatctcccggttcctggaggagtacttgagctccactccgcagcggctgaagttgctggacgcctatctcctttatatactgctgaccggggcgctgcagttcggctactgtctcctcgtgggcaccttccccttcaactcgttcctctctggcttcatctcttgtgtgggcagcttcatcctagcggtttgcctgagaatacagatcaacccccagaacaaggcggacttccaaggcatctctccggagcgagcctttgctgacttcctctttgccagcacgatcctgcaccttgtcgtcatgaacttcgttggctg

SEQ ID NO: 1478 - DNA, 44325 bp, Homo sapiens
aagtaaaacattcccctggacatttctttcaagcccagcaagctattaattatggtcataaagttaattagttccccggacttccagttctacaggtctgaaaaacaggattactgggtccaggaaaggcccagttctggtgaaaccaaggctcggctgggagctgagtcattcttctcgtagcaactttttcttactcctgtcagattgcgaactgctagtcacaccacctacaggtggtatcccaaacctgatgcccttgaaagagtggtagcaaatcccaatagctctaaatctgaaaccattgcattaaagatgttgttacgattattaaaagcattatcaactaggatcacatgcggctacgtgtctcggtgggcgacagctaaagaaacttgcaagcccgttgttccacaccaatttcagcgcgatggagacctctccagtctctccacatcttctctttgccgggcggagggaggaggctctctccatccccacgactgccgttctggggggcaagtcgagacgagcacgcctggctgctacctccgcacccgcgtcccacaagcttgctttcggggatctcacacatcaacatggaatctctccagaggccagaggagaatgaggggcactcgcgaggactaaggtagaaagccaggatccccgggctgcgggcgagcgcgtctcccatggctccccaggctcagccgctgcctcttctgggcaaatgcaaagcaagcaacgcacccaccccccgccctccccggaggccgacctggaaaaggaagagcgggaaggtgtctacaactgttcctcagccacagacagtcccaggatcatggcccagagagagagagagaaagagagaaagggacaggattaactcactgctgctccagatcatcggccatagtaaacaagccttgccaggtcctggcgagcccgcccagcgcctgacgccagcaccagctgacccgggaggccgcggggagcaagggggcgtggccgcgcagggggcagggctcgcggcgggccggcggtcggcggtgggaccctcaaaactctgcaacttggtttcagctagtggggcccttgctgtgttttcaatcactggcatgtgtcccggcagagatgtctctgacggtctcagaatgggacagtaatcctggtcacacatttgggggagtccttgcaggagctccgacagccctcccttctctcataactaaaaagtggtagaactacgcctgcacgctcgcacccactctttgggcttcccattgtaactgtgtcctcctgaaatcgacccttgttaatgttccttctagtaagaggcttaaatgtttgtggagacaacgccattggttgaatgctcctacaaagggcctggatgccagatttcgaaactaaaatacaggacacctagttaaatgtaaattccagatttaaataaagcaaatacttttttagaataagtatgggccatgcagtatttgggacataagtaggcatcctgtattttctctggcaaacctaaacctatatgacatctgccaaaatgggcatatctctgctctgatgttgactctgaccccaacctattttccagggaaaatatagctcaactccaggtcaccctcagtttggaggataacagttgaaggactcaccaataaggctaggtctcctttcggtatgtaaatgcggggacagggagataaggctggcttggcccagaggtcctgagtgcacttcagtttgctcagcagaggagctaaatcttgaggctggctgctgaatttgcttgtaccggtaaacagggcctgacctccctggaactgtcagatttcagatcatccccttagttaaaaccagactaggggtggggcgcggtggctcacgcctgtaatccctgcaccttgggaggccaaagtgggtggatcacttgcggtcagtagttcgagaccagtctggccaacatggtgaaaccccatctcttactaaaaatacaaaaaattagccaggtgtggtagcaggcacctgtaatcctagctactggggaggctgcggcagggagaattgcttgaacccaggaggcggaggttgcagtgagccaaaattgtgacactgcactccagcctgagagacagagtgagactccatctcaaaaaccaaaaacaaacaagcaaacaaacaaaaaaaaccagactggggagtggtggaggatgggtgagagaatgctggtgcacaggggtttatcaaagcatttttctttagccttcctgcaggacccagatgattctgagatttcttctttgtagcaacacagtgttaagctgatcattataaagacttaacgtttaggagaaccagcatttatagagtttaggggcttaggaatttgccagatgtggtacaaagtagttcaactagcagaggacttgtctctttcatgcaaccttttttttttttgagactgattctcactgtcacctaagctggaatgcagtgtcatgatcatggctcactgcagccttgaactcctgggctcaaggggtcctcttgcctcagtcttctaagtagctaggactacatgtgcccagctaattttttttttagtttttgtaaagatggggtcttgttattttgcccaggctggtctcaaactccttggctcaagctatctttctgccttgggctctcaaagtgctgggattacaggggtgagccaacaaacttggcttcgttcaatctttcaacaaagcacagtggttctaaacttcagtatgcatagaatcatctggtggatttattagaaattcagatttctgggctgggcatggtggctcacgcctgtaatcccatcactttgggaggccgaggcagatggatcacgaggtcaagagtttgagaccagcctggccaacatggtgaaaccccatctctactaagaatacaaaaattagccaggtgtggtggcgcgtgcctgtaatcccagctactcaggaggctgaggcaggagaattgcttgaacacgggaggaggaggttgcagtgagttgagatcgtgccattgcactccagcctgggggacagagcaagactccatcttggaaaaaaaaaattcagatttctagcacctaccctctgagattcagattcagctggtttggcttgatgctagaaagccgcatttttaggaagcaccgcagatactggtgctccacgagactcactggttggttagaagtatagattctggagtcatgaagcctggttaagttcagtatttgctttgccacttatccactgtaaatccttggccaagttatttagcatctcttaatttcttcctctggcttgtatcttgtgagaactaaccaagataattcaaataaacatgtggtacacttatttgtgatacgaatattacttatttttgttgttgctgttattcaatgccaagaattatgttgagcactaaaaatacaattatccagcctgggcatcatagcaagactctatctctacaaaaatgaaaaaaattagctgggcatggcaatgcacaccaaaagtaacagctactccgaagggtgaggcaggaggatcacttgagtctaggagtcagaggttagagtgagctataatcccaccactgcactccagcctaggtgagagtcagactctgtctctaaaaaaagaaaaaataaataaaagcaattatcaaaaggaaataaacaacctgctctagtggtaaacacagactttctatctgttgctaccctaggctgttcttggctttgcagagctgataactttgtattcagagctcagctcaaacttcccctcatctgaggcatttcttgaccacaggatctaaagagagccccccatcactctgtcacattaccctatttttattttcttcataacacataacattatctgaaattatcttgcattgtttttactcatttattatcagtttccttccactagagaataaatttcctgggggaccctctctgtcttgttatctgctgtgctcccaacacctagaacaaagtgtggcagagtaggcactcaatatttgttgggtaaatgaagaaaagtctagtgaagaggcagaagcataaacaattacctatgaaacaatatactaagtgtcaaaggctttgggagctacattctaaattgtaccaaatagaaaattccatactgtatcactcccagacaggacaataaaatctcccacttttctgaaaacctgtaagttgtgagatttttttaggcaaggacgactacacatgaactggtattagatctctctagaccatttctcaggagtgcagagaagtgtttgtattttgttttcatgtgcgaaatcagctttaaagtagaggtttcttggaagtaggaaacttgaatggatggaaaatgcctttaataaccaaagttaccacagtttttaaggtatccccagtgctgatgtatctcaggatcaggatggatccgctagaattacacagagtaaagaggactctcggagcctactctaaggcaggcctctggggagaaaatgtaagttattttttttctccttatcatcaggacaaagcacaccatgagcaagtatgagactccaacaagtgtggatggaaattaatttgacaaatctgaaaccatctttgcaaaattatgactgagacagtgaaagagatctaacttaactgactccatctcgcttctaaccaggttgtccttgttcattcctgggcataggctgaactaactttgggagaaacttagtttatagtttgtggtttgtgacagataacagccctttcccggggctgacttccttgttgcctggagactagattgcctttgtaacactaacattagccataagattggaaattatggtttgggagtcatgcagctggaggctacaagattctgaccctccctagactgctcctaagatcagtgcttgagatatttggtgacccctgcacttgatggatcagctggtaccactcagattgatgaactggctcatctgatcttgcagcgccccccacccaggaactcagggcaagaagacagcttggactccttattatttcttccccgaccatcaggactcgtggctcactggcttccccaaccaagttgtccttaaaaactctgatccccgaatgcttggggagactgatttgagtaataataaaattccgttctcctgcacagctggctgtgtatgaattactctttctccattctaattgcccagtcttgatgaaccagctctgtctaggcagcgggcaaggtgaactccttgggaggttacaaaccctctttctatgactgtaagtcatcactgagtattccaaaagtaggtggagctgataaactgatagctcaggcctggcagctatagattattcttgtttcaaatgggtatcactgccatttgaataaactgtgaacaaggtatatctctttgactgaacatagaaatgagtggaatagctcataagttgttctgtccaatgacagccactagccacaagtggctacttagatttaaataaaagccaaataaaatttccttagtcacactgtaaccaagtatccccatttttctaagagatagtttaatgatttttaaaaaatctctcttcttttcccccttctcctcacttcctccttagctctttagaaatgcaattgtagccttttacctcctctttatcagacactccctatggggcaggttcatctaactatgtgcttagaagctccagagaggaactctcacccaccgggaggttgccttgagagacaacagcctatctacaacccaaagtatgcctgctacaaagctttctcttacctggagagttttggccacttttacaacccagtcctgcccacaaaaggcaccagcagtcactgtccagtagataaggcactgaaggtagtatgcagaccccccaaccactcgcttcctcccctcgtgccattcatgccagcattccatgccccatttcaaaagcaccctctttctgctccaaaagtgaaatggtacccttaaggcagaaaacctgtacttcctcccctaaggtagctttggaataaaatatcattttctttataccagatctcactcttgttaagtggactctgcaagcagcgagagagtgaacctgcatttgggttacaacactaactagtttaagtgctcaatagccacatatgtctagcagttactatactgggcagtgcagagacattatcacagaaaattctattgcacactgttgctcaggcactgatgatttcagccccatgttgtggtgagtgatctgctcttggaaaggacaatatagtggactcactttcgggtgccagcaagggggcaaaactgaggcttttttgagactcccaaacagctaggagggagggaaaccagacaaaggagctgaaaagttgttccacttcatcagaaactgaaaggatgaagggatatgggttcactgaagatatttactgctttactaggacttgatcagaaacttgatactttaaaaatttgactttgtgctgtttgcaacttgattctccttaaatttttatttctgaaaataataacctattttatctgttctattaggaaacaaggagagggggttttggtcacactggggccaaagtttagaaggtagagattatatatgcaatagcagttaacagaagcaaagaggggaatcttaaggcaaacgtgacaatgcaagggaaaggaaatggaaaagacattcttttccatgcggagatttcctttagaagagttattgtctactcaaactttggaggatttgtgtttcttttggtaaataatgtgatttctttttgtagaggatgtatgatgtaaaatcatggactttgcccttaagggaaccctcttgctcctccactcttccattgttttatgtaatgaaacccctaaagtatactctgacttcagtttcagcttataaattagatctgccctttaagagccatttgagttgcagtccctccagtgctatcttttgcatacccaaattattgggggcgctgtagtttggctaacttttaatcattcagagaactaggagaagcagacatggttaattactaggattaatgatagttaataagagcaaacatttactgaacatttactgtctgccaaacactatgctaacagcttaatgcttaacattatctcatttaatcctcacataatttcaatgagccaggtattgttatttctgttttatagaaaaggaaaatgagactgtcagactgagtaacttgttccagattagacaactagtaaacagcagaatcaaggttcaaacctaggactgtctgattctagagcttgcactcttatccactactctggacaagaattttaaactatattaatattctgatttaaactaattgaaatcaacactagtgttagcaatttcctattgacagatcagttaaaaatgtttcaatgattatagaatcataaaccgaatagagaagtaggccttttcttgctgttttaagtagttcagaaaagccctagtgtagtatattggtgtgactagcaggtctcagaaacaaatgcattcaataagtccatttggtgtttttcatctcttcttctctcctgtgagagttcctggggagatcttaatgatgatagttgacatggatcaaaggcagacaaaacataagggagaaaacactggaaggagcctggctgatggaacagaaactccctgaagaatccacacctgaatgattaaaaagcatcagcctagcctgtaaagtttgaagttgaatattcgtgaggaagctaccctcctacttgttgatgaggcagagagaaaggttcaacttgtcagagaaattgatgcttcctgccatattatattgaaataagaaccagcttgttatccactctttttttttctttctcagcaacataggtttaggctgaacttatgttcatatagctgcacaaatctccacgggtatgaatataaatctatctattcaaatagactctaaaggtttcttaggttatttctcttctttctagaacttaagtaaggctttgatcaccactgataatacatccgttagttaatgcgtgtagagtttccagtctaaaggcaaataaaaagtgaaaaggggccggcgcagtggctcactcctataatcccagcactttgggaggctgaagcaggcagatcacctgaggtcaggagttcaagatcagcttggccaacatggcgaaaccccgtttctactaaaaatacaaaaattagccgggcgtggtggcaggtgcctctaatcccagctactcgggaggctgaggcaggagaatggcttgaacccaggaggtggaggttgcagtgagccgagatcgcaccattcactgcactccagcctgggtgacaagagcaaaacttcatctcaaaaaaaaaaaaaaaaaaagtgaaaaggcaggaacgctgttgttcacctgctgttttaggaattttgctcacgtacagttcaaaatattaagaagctgaaaataaagtacctggtcatgtgtggaaaaacttacagctaaaaggtgagatgaactgggtctagaaggtcggattcacgtgaaattaaaagggcaacgaaagccagaacttaatttcttaaaaaaagttaaaacaggccgggtgcagtggctcatgcctgtaatcccagcactttgggaggccgaggctggcggatcacaaggtcaggagttcgggaccagcctggctaacaatggtgaaactccgtctctactgaaaatacaaaaattagccgggcgtggtggcgcgtgcctgtagtcccagctactagggaggcggaggttgcagtgggccgagatcgcgacactgcactccagcctggccgacagagcaaggctccgtctcaaaaaaaaaaaaaaaaaacagttaaaaccctcaaaataatcccacttgttaaaatacaaaacctgaaaccatttcagtttcttctgcaaaatgagttggagagagtagggttgaaccaggcatgctctttcgggcctttcgacgctgacatcccgggatattacaccaggttcaagataccagcttgcggaaagagagctgctaaacttgaccatatgctttttgcacgacattcgacagctgtccctcccttcaccagctcttttaaggctgcaaatatatctgattcacgtgagagtccctacaagttagtacaacgtcaggccccaaggaggcgcccaataaatgttggcattgcagggccagatcccgagttccagttcagaaccctgctgaggtcaggcttcctccctgcctcccgcccctcaccacacccactcactcccccaagtaattaagtctaaactggggcctgtgcagtgattggccgcgccgggtctcactgcggatgaacttgacttgttccaatgatctgtgacagacatctgcagacagcgcccttaacagaattagggtcaggctggtatcaaaccccaggaacgccaggcattgcctcaaagtagatgcaaaccgttaaatcttccaggactcagaaggaccagagagagccggatacctctggttagctacgcggtccccagtaaagcttattcccctcttcctcccagtgtgtcttgttgccagagcaactgtgggcgtcaccgagctgacgggcggaaacagaacagaaagagtacacgtccccagctcattgatagggccattgcgcagacgcattaacttttctgagttgtagttgagtctgttgatgcagtccgcgtctgcgcattagttgttacgcgccctggccggcctcagcgcctgcgcaaattggcacaccggggagggcggagttaggtcacgagggtgcgcatgcgcaaacagcacatccggtgtggtcgacgggtcctccaagagtttggggcgcggactggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcgggtaatggttctataagtgatcataataataatgtgttactttggtgtgctgcttttgttttcatagtactctatatcagaccaccgccccttgaagttatgagaagagcctgcattgcccttttgttgtgaatggggaaattgaggctcagaaagcttagattatatgcctaataccaaacggctccgtaggagttggacttaaaagtctaaagaaaccaccttcgtgccgctactccacttggtgatccacttcacttaatattggtccggggaaaaccctattccaactttaacttaggtttaacacaactctaaaattagtagacttttcaaatgaaaaacccaaccttgaatcatctctgtcatcttggcctaatcattaccaatctccggtgaaacgtttcaatgaaagtgcaaagaatataaatactggtgcttttcttgttgaatcatcctttacttgattttgccttttagctgctactactttttttcttgttgaggaagctgttatttcactgtcctgaacccaatttttgttcacataactctattttagccttatttttccttttgattccaggatttggtaaccttgtagactgctatatttagcgagaacagtctccatcaatttttgttaaaatctgacttttcttgcccaacggggattcagtgaatactgaaaacaggcgtggcctctatcactggtatcacctgctactttgactttgaaaacatgccagcattcatggtttcttttcagtgtgatcatcagtcaggtcatcagttgtattttcagtccaatatgaggcattatggtaaaagctttggcacatgttctttatccgtaaagagtttatggtctagttggggtacagacaaaatacagcattggaattgtctggaggcctggcacagtggctcatgcctgtaatcccagtactttgggaggccgaggtaggcagatcacttgaggtcaggagttcaagaccagcctggccaacatggtgaaaccccatctctactgaaaatacataaattagccaggcatggtggcacacacctgtaatcccagctactcgggaggctgaggcagaatcgcttgaacccgggaggtggaggttgtagtgagccgagatcgtgccattgcacttcagcttgggtgagagtgaggctcagcctcaaaaaaaaaaaaaaaaagtctggtgacagtggtgctgtgcttaaagttacagacctatagaatgcttattgtacatttacattgttctgacacaccagagatatttcttagaatttaaaacaggtctgaggatctaatgacttgtgtactgaagttgcagattagccttttgattggatatttagttaccatctttgacttttgtcctagatgaccaagacctagttgtctgtggtggcgtccttgccttcaggatgtgttaaccatcatccgaccagatacactacccctttgctctaagtattctccaccacccacccaccgccctctgccacggtactatatgtttttattagccagcccggagaaggaaccttgatgagaacttttgatttaattttgtttgatgtttttgtttccaggtctggaagagtaggagcaaggcagggtctgaaagctgattttaaaaaagatgccttctccatgtagaagtcaccctgccttcataagcctctagggtctagaatgatttttcatggatgctttgaagaatgtggtttgctgaagagtgggcatggactagagttatagattatcagtgtaataaagccagaaggtttttttgagcaaatgactttcacttatgccaagacctgtttttgagcccgttgtggctgaaattgaattggcagactggactgcctttctcctctccagtgggaactaggtggcttgtcattgaagaaaaacctagtaaaagggcatattagtaatggggccaataagggggattaggatttccagatctgttagataacagataatagagctatagaaatgaaagcaacttcaagaaaagaagggattcatgataattcttagttgccacagaagggtatgatttacccttcttttgacagcattgactttcctaaatcctgcctcttctgccatttgttagcctagatcatcaactggagactggttttaatgggaaatttggacgcttatcctttgttttgattgttggcaaaggtagccttgttcctttttatggtgctggggtttctaactttcctgtggaatttcctgttgcaagagaatggaggagtccagtgagctgggagagggaaatgtaggcgatactgttgaaggattaggtagtgctgggtgctagatgtttgaatgccaggccaaggaatttggactttttttgagatggagttttgctcttttttctcaggctggagtgcaatggcgatctcggttcactgcaacctctgtctcccaggtttaagcaattctcctgcctcagcctccgaagtagctgggattacaggcatgtgccaccacgcccggcgaattttgtatttttagtggagacggagtttctccatgttggtcaggctggtctcaaactcctgacctcaggtgatccgcctgcctctgcctcccaaagtgctgggattacaggtgtgagtcactgtgcccggccaggaatttggactttatcctgtaggtaatagtaaagcttctgaagatgcttttttttttttttttgagacggagtctcgctctgtcccccaggctggagtgcgccatctcggctcactgcaagctccgcctcctgcgttcacgccattctcctgcctcagcctcctgagtagctgggactgcaggcgcctgccaccacgtccagctaagtttttgtatttttagtggagacagggtttcatcgtgttagccaggatggtcttgatctcctgacctcgtgattcgcccgcctcggcctcctaaagtgttgggattacaggcgtgagccaccacacccggcactgagggtgcttttttaaagaaaggaaaagatttaaaattggtgttagcatgtaggatgaattggagggaaatgttctttaatcttctctatttttttttggcagtctattctcttctattccctctgcatgtgttagtttagcatatgctctttggaaattgaccagtacattttaaaccaattcagaacgctaccaaacctttaaaaaacctgttgttattgggcctgatggtatgaaaatagtctgttttcttctattccctcatagctgagagacttaaccatggtttcaagaaggaaccagaggtagaaagttgtcattgagagatctttttttgtgtgtgttttggatcatcagagtataatatattggctttaaaaggacctcagaggtagaatatttttctatttgagacagatttcaaacatccagtagctgactgtttatcttgtagttagatatctctagaagaggacatctgtcccttttttagagttatattccagtgttggcaaccctttagtttccttttttgcccaactgaaagctgtgctcatttaaagtgctatttaggagggataagtagaaaacattaagactgtcctcaaaataagtctttggtcttgaaacaagttttaattcatttcccaactttcatctgttctgttctctaatctatatgaggtaattttgtcttaaaaaatagttttgtttttcctagtttacaaattcaaaaccagtttgaatctgtaaggcaaggaggcctagtccagagttttctgtctcacgggagctattaggctgttgtggactggggtccagcatttcttttggaattatccatcagatctgtggatcctaatattatctctcataactgttatccgagagattagaagtttgccacccatgtgcctgatagtcttgtttctaaatatctttcatatcattgctactttttcatcctctgttttagcctctcaatatctcttatgaagactactgtaatcctccttactggccttccggcctctggtttccagtccatcttctactgtgtttgcaggcttgatttgacttgcaaatctgattgtgtcactcccatgtacaatttgtgtttcccaaagtaaaattaaaactttttttttgacatacaggctctttcatgatctggcttcctcgctgtctgcagcttcatctcttgcctctgcctcctctatactctgctccaacagtattgagctacttgtcattctctgaacactctcatgtgtcaaactatttgcctttgcttgactgccttcaaaattccttcactttttagacttctcagctcaagtgcaatttccttttttttttgttactgtttttaaagagaacaaggtcttgctatgttgcccaggctggcctcaaactccttggctcaagcagtcctgcctcagcctcctgagtagctaggactataggcacacagcactatgcctggcttattgccctttggaacccttccctgactctccagcagattgaggtctttcctctgtattcctttttcaccttgtatgtgtgtgtgtgagagagatatggcattgtgctgtatttgggtgtctgccttctctctggaaggtgagcccttgagggcaggggctgtcttctcatctctccatcctcagtgctgaacactgtatatgttaaatggtgagcaggcctatagtcatgtcaggaatagtgagcaatgatgtgctaggttctctgccaaggtgctgggaattcaactgtgaagcacacagacgtggcttctactctcacagagtttgtaattagtgggaaatacagacaagtaaatatggatatggtgctgatggagaattattggtgagaatgggaacacaatgtgcatccaaccctgcctagtggtcctgcaataatatttctcttatacattcgccttcctaaagtaggcttcataaatcactctatttttcctcttttcctttattcttagttggtgatcttgcttttattttttcactaaaaaaaagaagtagataagaattccttcatcttttcaccactgaatcataacagatcacctacttttatacccatactctctgacttctcatggtggatgatgtgtctctttcctgtgaaagctctgcttgtgcagaggatccagtcttcccttgctcactcagggactccgcttctgcaattattcctctgttccgtgtcattaatttctgtttctctcctggatcattcccatcatacaaacatgttctaatattgtctatttaaaaaaaatccgtttgaccacagataatcttctagctaccatcccatttcctttccatcattacagaatttcttgaaagaataattaatgttcctacttcctcccttaactattcattccttaacccactcttggtattggtctgtcctcgctacttcactgaattacttcactgaaactactcttgccatgttgcaacgtttagcatttaatgtaggtattggcttctgtgtaaaaggaaagttttttcttgaatacaacactctcctgcttgttctgtctcacctcactgctttttcctttctgctgttttgtgctgggcgcttctctgactgagagcatggttgtagataccttcactttgtatttttttttaaatagataaacttaaataacacctgtatacctacaactactcctttatatttttagttttgaactgtcccccgaattccaaattagtaaatccagttgccaacttgatgtcttcacttgatgtctgatatgtaccttgaacttaacatgtccaagatcaaacctgctcatccagccatctgcctcttcaccagttagtacgtggtgtcaatgttggttgtggttttttttttttttttttttgagacatagtctcactctgtcacccaggctggagtgcagtggcacaatctcggctcactgcaacctccatctcccgggtttaagcaattctcctgcctcagcctcctgagtagctgggattacaggcacgctcccccatgcccggctaatttttgtatttttagtagagacgaggtttcgccatgttggccaggctggtcacgaactcctgacctcaggtgattcacccacctcggcctcccaaagtgctgggattacaggcgtgagccgccatgcccggccggttgtgtttttaaatgaagaaatttaagtttccggggtcccttgatttctcttatctcctgcatctgtttcatcagcaagctctgtcttctccaaaatatagcctgtatgtctttatttctgtccatttttactaccattcccctgagctctttgggtcctaagtaattcttctgcttctttttattttttatatttttgagacggagtctcgctctgttgcccaggctggagtgcagtggcgcgatttcggctcactgcaagctccgcctcccgggttcacgccattctcctgcctcagcctcccgagtagctgggactacaggcacccgccacaatgaccggctaattttttttttttttttgtattttttagtggagatgggtctcaccatgttagccaggatggtctcgatctcctgaccttgtgatccgcccgccttggcttcccaaagtgctgggattacaggtgtgagccactgcgcctggcctatttttatttttatttttatttttttgagacgcagtctcactgtgtcgccaggctggagtgcagtggcgcgatctcagctcactgcaacctccgcccttggagttcaagcgattcttctgcctcagcctccctagtagctgggattccaggagcctgccactgcacccggctaattttttgtattttatttttagtagagatggggtttcaccttcttgaccaggctggtcttgaattcctgaccttgtgatccacccacctcggcctcccaaagtgctgggattacaggcgtgagccactgcgcccggccttctgcctctttttaaccttgcgaaccattatactgttccaccgctcttataactgaatccatactgttttctgaggcttaccatgcccctcaggatttggcccttgtgtccttccccttgatcactatagtcttgttggtctgtccttgatttttttttttttttttttttttttttgagatggagttttgctcttgttgcccaggctggagtgcaatggcacgatctcggcttactgcaacttccgcctcccgggttcaagcggttcttctgcctcagcctcctgagtagctgggattgcaggcatgcaccaccaagcctggctaattttttgtatttttagtagagacggggtttctccatgttggtcaggctggtctcgaactcccgacctcaggttatccacccgcctcgacctcccaaagtgctgggattacgggtgtgagccaccatgcctggcgtctgtccttgtgtttataacatgtcaagattgttcttactgtctagaatgctctgcccccagatttttacatggttggttccttatctttcaaatattggtcttaaatagcaagctcttaaagagaccttctgttatgattgaatttaagaaaagcttcccagtcactctttattatcctgttttattttcttcatagtacatatctctacctagtagttcctggtttatttgttaacttattgattatatgtttctctccataggagtgtaagttccttgagagccagactgttttgttctgtgccatattcctagcacctgaaatgatgcttgtcatgtagtagatgtttagtaaatattttatggaataaatggacatttaaggggatagagtaaatcagaattgctaaaatggaacagactgcttgaagaggtagtaaatttccatctttggaagtgcccagggagagactgaaggatcattggtagtggagcattttgaacaggcttttttttttgccttttttgtttccaatgcatctgagagatgtgatatccttatcagtaacacaggctctggaaagttgataattctccatctggaggtggcttaccagattctgtaagtggtgagtatactttggaaagcttcccacgtgattagtacgcctccccaagcatggccaccccctaccacctcttgggcattgtatacatcaaatggggtgttggtgtttatgacctctgaggtcctttccaactttgtgggactctgattcatatgttttcattgaaataatctggttaccatgatcacaataataataacatcaatttattaccttatccaccttcatggataatttttctttttttccctcatatttcctcaaaactcaacaccgtgttctttactccaatgaccactattaatagttttctatttcttcagatttttttctagattctaactgaaatgacaagataattatgtatatcattatatgtaaataaaatattttactttttttttgagacggtcttgatttgtctcccaggccagagtgcggtggcatgactgtggctcactgcagcctgcaacctctacctcctgggctcaagcaatcttcccatctcagcctcccgagtagctggggccataggtgtgtgctaccacacctggctaattaaaacattttttttgtagagacagggtctccctatctttcccaggctggtctcaagctcttgggctcaagcgatcctcccaccttggtttcacaacatgctggggttacagttgtgagccaccatgccctggccaagtgaaattaggaatgggctgggtgtgggggctcatgtctgtaatccctacccttaggcaagcagaggcgggaggattgctgggcaacatagggagaccttgtctttaccaaaaacaaacaaaaaaattagctaggcatggtggtgcatgactgttgtctcagctactcagggggctgaggtgggaggattgtttgagcccaggaggtcgaggctgcagggagccatgattgcaccactgcactccagcctgggcgatggagtgagaccctgtctcaaaaaaaaaaaaaaaaaaaggattggctttttttcacttaataagtcttagatatgtttgctgtcaatgtacagagaatttaccttattcttttgaataattgcatgggatttcattgcatgtcagttgtatagtttaatccccttgatgtttagactgttttaatttttttttcaactttacaaacatactttcagaatgtctttgttctgtaagataaattcctttgtcaaaaggtaaaatcattttaaatattaatggatattgctagttgctctcccaagtggatgaatgaatctgtactttctacagcaggggtttacactggttacccttgcttcagtcattgtctttaatatttttaagggtctggatacctgaaaggatcaatggtgcttccatggtgtttacatgtttaagcataatgaaaactgttgccatggtgacaggctctggagaactagtctgatagttttctggcctttggattagatttgtttgttgctttttcttagttaatgatgggatgatgctagcctgaagcgagtttaggttttcttaagcaatgtaataatttatcacaggcataaagatacttcggaagagtgtattcctggaactgcctgtttttttttttttgtcaatggtgactgttagaatcttcaaggggatggagtgtggcagtggagagttctcatgaattatctctcttaggtcttctgccttttttgagacaaataagcagctgctagaacttcgagatcaaagatagtttatcgagaactgtgaggttctcaagaatgagcgtgctatctttataaactctgctacccattaaatgaatattctattagaaaataattcacatttttataactttttatcattcagcccggaccctttgttgttgcctcaagtgcatccccatctaggtataattagaaacctttaaatcagcagataagagagctttgtgggttttttggttatatatttttttctctgagaaagcctctaggtttcagtgtaactctgagaagtaatattttttttcctttaacagagtgcgaaatttaattgtacaacttgataaatttttaaatgtacctgtctaaccactatccagatcaagatgcaggacattaccagcaccatagatgcctccttgcatcttcccagttatcctctccctgtgaaagataaaaaccactatcttgccatagattggttttaccaagttttaagctttttgtacatggaatcatatagcatatacttttttgttttgttttgttttgagacggagtctctcttgcccaggctggagtgcagtggcgcaatctcggctcactgcaacctccacctcctgagtttaagcaaattctcctgcctcagcctcctgagtagctgggattacaggtgcgtgccaccatgcccagctaatttctgtagtttttattagagatggggtttccccatgttggccaggctggtcttgaactcctgaccttaggtgatccacccaccttggcctcccaaagtgcggggattacaggagtgagccaccgtgcctggcccttgttttattttttaatttttttttttttagatggagtttcgctcttgttgcccatgctagagtgcaatggcacgatcttggctcacctccacctccacctccaccaattctcctgcctcattgcctcagcctgccaagcaactgggatcacaggcatgcgccaccatgcccggctaattttgtatttttagtagacaaggggtttctccatgttggtcaggctggtcttgaactcccgacctcaggtgatccgcctgcctcggcctcccaaagtgctgggattacaggcgtgagccaccgtgcccggccttttttttgtttgtttttggtcaagataaaacatgacaaaatttaccattttaaccatttttaagtgtatagttctgtggcattaagtacatgtacattgttgtaaaatcatcatcactatccatatccagaacttttttgtcttccgcaactgaaattcagttcccattaaacagtaactcctcatcctcctctctgtcagtccctggcatctaccattccactttctgtttctaggagtttgactactcttgatgtcatataagtgaaaccacatggtatttgtccctttgtcatggcttatgtcacttaaaataatgtcctcaagattcagccatgttgtagcaggtatcagaatttccttccttttaaggctgagtattccattgtatgtatacatcacactttgcttatccgttcttctgctgacacttgggctgctctcaccttttggctattgtgactaatgctgctatgaacatgggtatgcaaatattgcttgagagcctggttccatcccccaccctcccaacctcccagatggagtttctctcttgtcacctaggctggagtgggacggagtgatgtcggctcactgcagcctccacctcctgggttcaagcgattcttctgcctcagcttccctagtagctgggattacaggcgcctaccaccacgcccagctaatttttgtatttttagtagagacggggtttcaccatgttggccaggctggtctcgaactcctgacctcgggtgatccgcctggttcagcctcccaaagtgctgggattgcaggtgtgaaccactgtgcctggccgagatcctgctttcacttcttttggatatgtacccagaagtggaattgctggattatatgatatggcaattctgtttttaatttttttgaggaaacgcagtactgtttttcacactggctaccctatttgattttcccacttgttagtgcacaagggtttcagtttctctgcattcttgccaactcttgtttttttgatactagacatcctaatagatgtgaggtgatatctcgttgtaattttgatttgtattgccctagtgattaatgatgttgagcatcttttcatatgcttgttggccattcctatatcttctttggggaaatgtctattcaagtcctttgcccattttaaaatctggttattattttgttgttaattgcattgtaggggtactttaatatattctgatattaaccctttatcagataagtgatttgcaaatatttttccccattccgtaggtgccttttcactgttgtgccctttattgtacctttatcacagaagttttaaactttgatatagtccaatttatctatttttactttgttgactgtacttttggtgtcatatccaataaatcattgctaaatccaatgccataaaacttttgctctgttttcttctaagagttttttagtttttggtctttatccatttcggatttaggtctttgatccgtttcgagttaatttttgtagtatatggtataaggtaagggtccagcttcattcttttgcctatggatatccagttttcccagcatcgttggttgagaagactgtttccccattgagtggttttgtcagtttggttgaaaatcatttgattttgtatacgagggtttttgtgtgtttcttaaaaaacaaagcaattaaattgattcattttttaactgtagtaaatgtatttttaaaataaacttataatggaaaacctgaatcattatccctaaatagaaggtcacactaaaaataccatggagctaggcagatgtgttcacccgtgcctgtggtcccagctgctcaggaggctgaggtgggaggatcgcttgggttccagtccggcctgggcagcaccaccagaccctgtctcctgccgagttctcagtggctctgtgtggctgcatcccagaatattcctcatctaattgagggggtacatttgttcccccagcatatacacttaggctctgccctgtggtctctgtgtgggagctgggcttttttgtctttggcttcctctgggtacctgccaggttccagctggtttggccagccagtgtgtattttttaagttttgtccgggcacggtggctcatgcctgtaatcccagcactttgggaagccgaggcaggtggatcacaaggtcaggagttcgagaccagcctggtcagcatggtgaaaccccgtctctactaaaaatacaaaaaattagccgggcatggtggcgcatgcctgtagtcccggctacttgggaggctgaggcaggagaattgcttgaacccagcaggtggagattgcagtgagccgagatcatgccactgcattccagcctgggtgacggagcgagactctgtccccgactccccaaaaaataaagtttttgattgtgttgcccaacttacttgtgcaattcatccatttttgtgtatagcagaagttctttttcattgcagtataatattctattgtttgtatatgctataatttatccattttactgttgatagacattagattgtttccagtttggggctatctgggtatcatttctgtgtatgccctttgatgtatatatgcattcatttctgttagagtagaattgttgggtcctcgggtatgtctgtgttcattagcatatttattttatacttctatataatcatttttttgtgttttgcttcttgtgcagtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgtaagtgatgatcatagtccttgtcctataatgttgattttaggaagagaaattggatgggactggttttgatcatggttggccaggctcccatactgctattgacatttgcagaattttccattggtctgcaaagtatgcattaatatcatcataattcatcagtgctactgctcttggtcattgccttgtctttctgttcttcaaatcattaaggtaatagaaaattaatgtttgtagctagtacaataatttctgtaccaataactccacgaaaataactcggagattttggaagagacataaatggtaggttttgcctttagatttgttagttaatttttttctgattttgatctcagatgacttttaatgctggaccattgttttcatagcacttaaatttgatagcatccagtgtatgttgaatgaatgactgtgggcatttgctaatatgtgccttaaagtagaaataaatggggaaattgggttaacttgggagaagactttaaaatataagatgggatgctgcttggttcatttgccattttcacttttttagcagtagagttctttctcccttctcccaaacaaactcttacaaaaagaatcttggtatataaagcagaagtagaattggagttttttttgatggacagaaattgaaaagccctctctgcttggccttcatcacatatggtacgccctcccctaaatcgctccctcccaagcagagttctaaagctttaataaatatatggctgttttccataccgtatgtcaacactgttactttatatatgagacaacagaggcctagaacaatccattggccttccctggccacatagttaagtgtttgcagtgaagtgccctagtctagcggtgttcttggccccgtactccttccggtatcccatgtagcttactgatgaatgcatgcaatctttgcctttgcattgcaaaatgtaatgttctgggtggtagagaaaagagaaccttaggagatctcatcctatttgggggaaggatatcctaggaccaacctcttcctgtcaccacttggaaagctgtcatttttatactaaccagcagaaatctagtataagagttagagcatctatgtgcaaagtggatgcaataatgtggaagtgactatacttccttttctgacatgaattagtcatttacttataatatgttacctaaatcctttcctttgatactgcctcaaaaacagttctgttagttcaggtaaggtatcattttggtagtggtaagttgacagtgaggtttatttcagtgaaaaactttttttttttcttttctgtttttttttttttttttttgagatggagtctcgctctgttacccaggctggagtgcagtggtgcgatctcggctcactgcagactccgcctcccgagttcatgccattctcctgcctcagcctcccgagtagctgggactacaggcgcccgccaccacgcccggctaattttttgtatttttagtagagacggagtttcaccgtgttaggatgatctcgatctcctgacctggtgatccgcccgccttggcctcccaacagtgaaaaacttttaagaaccactttgttctgttattttaatacaatttaactcattagacacctgattaagacttgagttatcctcttcctcccttcctccctccccttctatgtgccagccaatgtcttgttgttgggaatataaacaatattgttggctgggcgtggtggttcatgcctataatcccagcactttcggaaggcgaggtgggcgattgcttgagctcaagaatttgagaccagcatgggcaacatagcaagaccctatctcaattaaaaaaaaaaacccaaaagtgtggcttctgccttcaagacatgtacagtctagtaggggagaatacgtaaacataacagttaaaatacagcccatttagggcctcgctataggtttgaacaaagtgctgcaaaaatccagagaagagagcagctgtaccatctgggagcagggacagcagatgagttatctgagcaatggataacagctattgctagttaaaatgaactgttaccagtggataaccttgaatgcaggtagaaaactgacccaccaacattgaccttctcacgcttgcaaatatgagtaacccttgggcttcctgatagagccttctggaaaggtcatgtcttctgattgcttactctagatttctgaagttctttttttctagatgagtcatggtgtgtacttaggaaggggacacagcaaacatttcaaggatgttttctaggctcagggagataccaaatcatggaaaattatttcttagggctgtcatgattggaggaggactctactgcagagagcttagtatttcaaaattatgacaaaagcaaagacaaaaaagcagtctcagcagaaactgtgtactgcagaccatattaacaacctaggaccacctgctcagctgggaattatgggcccaaagcatagcaaaatcctcaatcccagattgcagtgttaaatctttctatggagagtatgttcatagaaaaatctttctctctgggggattgcccagattgtttttcatagagatccttcatttgaattatactatactgtcctgctctcagtttttaaaaatatacatttatttgctccttttatgtgcttctaactcagctatatgtgcactgtgccacagcactttaaaaatagttccaagtaaattctcaatatttataccagctcagaaggtagaacaaaacagattgaatgtctttatattttccaactaagttgagagtttgatattaaaaaaaaaattctgtaatatagctgatcttacatgaatttgggggtgacaaactctaacctactctgaaagaggcaggtcaaaagaaaatggcattgggttaaaaaaataaacaattcaaggggaagtaaggaagttaacagataatgagtgctcagtgtgtgctatgctttaagtacttcttgttctatatcattttattttcagaataatttcacgaggataggcttgctgttctcatttacagatgaggaactgaagttgagagagcctggctaggatggctgagcacggtggctgatgcctgtaatcccagcattttgggaggccgaggtgggtggatcacctgaggtcaggagttcgagaccagcctggccaacatggtgaaacctcgtctctactaaaaagacaaaaattagctgggcgtggtggccggtgcctgtaatcccagctactcgggaggctaaggcaggagaatcgtttgaacccatgaggcggaggttgcagtgagcccgaattgcaccattgcactccagcctggcaagagtaagactctgttttctaaaaaaaaaaaaaaaaaaaaaaaagagccccttgctagaaatcttacaactaatgtatctatccaggtgatcaagaaagactcaatattttttattttttagactatacaaatgaaaatacaaaagcaaaaattctcccagtgagcttctgacccccagaaatccatgcacacctgaaatgatcagtttttggtgtgtaggtggcggcatatttttgaatgaatccatgacagaaagaagctcagtggatttcagtatttaaaaatgtatatactttagttttttccatgtttgttcttctgtgtttctttgtgaaattctttttttttttttttttgagacagagtcttactgtcttacccaggctagagtgcagtggtgcagtcttggctcactgcaaccctgcctcccgggttcaagcaattcctgccgcagcctccccgagtagctgggactacaggcacttgcccggctagtttttgtatttttagtagagatggggtttcactctgttggctaggctggtgttgaactcctgtcctcgtgatccactcgccttggcctcccaaagtgctgggattacaggcgtgagccactgcacctggcctgtgaaactcttttttttaaaaaaaaaaaaaaatctcagtccatctcaggtgttctgaagggtaatgaggaaaagaaggacagaactgtattggatcacagtttgagaattaaagttcctgatgaattgggccctgggtcagaaggaagggtgaactgggcccaaagggacaaaaccttgcttgaaaatgtgctcagctcccagggagatagttgccaaatgcctgtgccttgttagcattgttttgtttttataatggagaccattctctcacaagtcttaaaaaattcagtgtttgatcctagctggaacaagggggctacagggttgggcagaacattttaaactctgactggcagcactgtttacaaacatgaaattatgttggcttttcgaattcagttaaagtatagtaatctagaaaattacctcgggaaggggaacttgatgttattctgtgggctttgctgccacctagtggatggtatgtttcatgtgttgagcggctactacaaaacatgaggagttgagtttgggggaagaagctactgatacctgtgttaaaaaacctagtttctttccagtcattggggggcagcagaggtccaggtgggtttagatgctgggttgggggttgctttacattctggccagaagtgggcaatgtcgagttaggaacaaaagggcatagaaccctaaagtggccctagattttgttgtgtgggggaagaccaagactgtgcacatagacccgcaggtttcccgtttgatttctttttttcacctccttagtttgagagcttctttttttggtttgttctacgtcttttattctcaatggtgacctcccacgcaataatctttaattttttgttggtggaggggcccatttagtttttatttcattttctctttgatatttccaccttatattgaattaggtcctgccgccaaataagctctctcagagggaactgtcctacatttgtaggaaatctgaggtagtcacatcataacttttttcaactcatttttctctgtttagaaggtgagattaattatatatttttttatgtgctggggtctcgctatgttgcccaagctaggaactccctggggtcaagtgatcctcctgcctgaggcttctgtgtagctggacctacaggtgtgtcacagtgcctggctctgagattagttctttacctttcattcttaaaactttgaatctacttattttatttgctaaaaagtgctaattgatgactttacttgtttattgaactctattttatatttggtgtatttaaggctaccaaagaaaaaagaatatcgaaatagatttatatttatgaatttcattgctgccctaacttactgccttattttctccatcctcccagcttggatgactcctattccaagtcattcccacccctcaggttgcataggagcccttagtctactgcattcctccagtgctgcacttatcacattgttatgaaactattcattcactttcttctctctcccactggactcaattgtgaacagtaacagtgtgtgtttgttgaatgagtgtatgaatgaataaaccttttttttttttttgagacggagtctcgctttgttgtccaggctgtagtgcagtggcatgatcttggctcactataacctccgcctcctgggtttaagcagttctcctgcctcagcctcttgagtagctgggactacaagtgtgtgctcccacgcctggctaatttttgtatttttaggagagacatggtttcaccatgttggccagtatggtctctatcttttgactttgtgatctgcctaccttagcctcccaaagtgctggaattacaggcatgagccactgtgcccggccaaataaacactttttaactgcaagaaaaagttatgttattaagttacttggatgctaaaacatggaaagtggtacgaaagaaaaaaagccaaggcaaagattcataggagaggctgtggggtggggaagagcatgagacaagaagtcagaggaggggctggtgcggtggcttaggcctgtaatcccagcacttggggaggccaaggtgggaggatcgcttgagcccaggagtttgagaccagcatgggtgatatagcaagaccttgtctctaccaaaaatcaaaagaattagaggggcgtggtggcgtgtgcctgtggtcccagctactcagaaggctgaggtggaaggattgcttgagcgtgggaggtcacggctgcagtgaactgtgatcatgccacttgcactccagcctgagtgacagagtgagaacctgtctcaaaaaaaaaaaaaaaaaaatcagaagacttgtattgtaggctttgctctgttaactagttgaatggacaaataaacttacctctgagcctcagtttctctgtctgtgttgtgagaggattggtctggatgttcatcaaagtctcttgccactgttaatgcctctcagcatgattcttgatggttcttttgtgtttgaggaggattgtactgtttttgtggatcctcatttgggctttgctttctgttttctccttaatcgttgctttttattcatattttcagattcccattatccatttataggaggcagaaagttaaatgattataacaagatgcacatatttgtatgaagccttttacaaaaagtaaacatttgtaaaatgtcttctagttcccacgttaacaggcttgtaggattcacatacattccacatatacttttacatacatcagctcatgtgatccttccttcctacccagtgatgtggagacagacaaatagtagtattcctattttacacttgaggtaattacaccttggtgaaactttagttgatgtatccaggccctggaactaataagtgactgagggggaactggataacagacatttggactctaaacctttatattccttcctgttatgtttaggactctcagatgatggctttatatatatgtcatgttagagggttttcattaaaaatattaaacttttctttttaagaaatttttatttattttaaattttcatcagagccatcagactggattcttttcttttttaaatgggaaaaatttggcagagattgataggaaaggatgaaggccggctatctcaaatgtttctgcatagttggccatacttaatatggtccaggagaaatggaggagaatgcaggtcaggagacctgactttggctagggagggtgatcctggaccagcactgtccaacagagctttttgcagtggggaaacattcagggtctgcaccgcccattatggtaaccactagccacatgtggttattgaacatttgaaatgtggctaacagactgaagaactgaatttttaatttaactttgactaagtttaaatagtcacctgtgtctagtggctgtggtgttggacagcacagctctggacagatttgtcaacactatcaggttacagttttctcatctctgtaatgaaaggattaaagaagctgatctctaaagctcctttcattttttagaaatacacagtctgtgccttctaaaactggtgattcaaattgagctgtaaacctagaatttctgcagaatggtctttgattcacattatttctaatttcagttttaattgggtgactagaatccaggatgagatgaatttgaaggaaaatcagtatttgaacatatctgcccagtgctagtgtctgaatagagatattgctggagaagaatacagattccaaatagaaatgaccctggctggcattatcttttctatctctacagcgtcatttttaacagttctttgtgttatgccttgctttctttttagatgattagaacaaactgattaaatggcactgtcttctgcccaggtgaaatagactgaagtcacgctaacttttctcagtaggtgtcttcattttgcatgtcttgatatcaggggaggagattttattagtcagtttcctgaaacctttatgccctggttaatagttgaaaccattcttcttagctgttgagtagtcaattgtgtgagctaatatttcaaagaatcctagaacctctgcttttagaatagtgtctggtaaatagatctgctttaaaagaggggaagcagatctttgtaaacagaattttctgaaaaccactatcaaagagacttactctcatgagtcaatttttgcctttcacgtggactggcctcagcatcttagatttaaatgttttaatataataaaatctttaaactttgattttgtactaaactaggatttcttttatatttctaaaagtgtcaaggctttgttcactgaaaatggcattatgatctagtcctctctcaccttggccattagaaatgtaatgtagccaggcatggtggcctgtgatcccagcactttgggaggctggggcgggtggatcacctgaggtcaggagttcgagaccagcctgaccaacatggtgaaaccccatctctactaaaaatgcaaaaattagctgggtgtggtggcacacgcctgtaatcccagctactcagcaggttgaagcagagaatcgcctgaacccgggaggcggaggttgcggtgacccgagatcacgccattgcactccagcctggacaacaagcacaaaactctgtcttgaaaaaaaaaaaagctgtaatgttatattggctgatagtctattgccagagagtttgctttaagaaatttgatggaatgaataggtgagtttgaataggtctgtttggttttgtttggcactgtgaacaccttttgcttcctgttattgctctttcttttatacatttcttataataccactgattcaggaatgttctgcaattatgtagcatttctgtaaataccagtgttagtgaaataaaagcattctggctgaaagtccaaaatctctcctttaagttctgatgccagaatctccaggttacttacttgacccaatataccaaataaggtagtgccctttttcctcctggggcagcccggttcttctgaaaggtagtatttcccagcctcttttgagtcatggtacacgtaggagattgcagtatttttatggcacactgggaaaatcagttgcttatagctggagacattggagcccctaaggctggaggtcactttccaaccagagctgtgctggagtccagtaggtgggaggctgtgctttgagggactaaaggaagcctgtatcttgtggtgagggttccacctcacaagttacagatctcagttccatttggctctagcagcaatgtggccacttctgttgcggttactctttcttcacctttttcttgccaaaaataaacttatctttaaatgaaaactaaattatttcttatattttggtcctttgttatagctgagattgggaatttttctttctttcttgaatccttacttccctaccctgcctccccaccaatggaaatctgtgcttcataagcattttagattccagaaagctctttaggttaaactacaaccctctcacctcaaagaatttgtgggccagggaagtcagtgacttatgtgaagtcttgcggctaattaatggtagagctggagttaggacacatgtctcacagttcctagttcgttttgctttgatgtgcttgaaattcagttttgacattaatttttctggatactactcccataaaatgttctttgaaaaatacttgcttctttctagtttttctcgcctggtttaaatattgtcctgagtgtgggaaccccataactgtcttgtgggttagaatttagatggaaggatttggggccctgtctctagtatcataagacatttaaccttgctgcttttttcttctaggttcactctttgaatttcctggataagagttctggagatggcagcttattggacacatggattttcttcagatttgcacttactgctagctctgctttttatgcaggagaaaagcccagagttcactgtgtgtcagaacaactttctaacaaacatttattaatccagcctctgcctttcattaaatgtaaccttttgccttccaaattaaagaactccatgccactcctccatatgcctctggctctgtttttattctttgctggtatcagaatcctttttttctcttcagtcctctgtgctgaactctttatgagttggtaacttacagctgtgaacctgcctccttgttttcattaagtatatttgaagttaatggcaaaaggcagtgctgacaaccctgggaaatggcagtcctttgtcttcttcctggagcaggtaatcctttactaatccttcgattgttacaggtgcttccactcttatgacagtgcattcctggaactgcatcattatgcactctgctagaaattgaactaagtatgtgctaccacatttacatctgtttcaacatgttttagtggtaaaagtgaaatatatttctcttaggcagtgtagacagagtgaaaaatgggggttatgtatgtgttgacttataagatacaatattttccaaagcaccttcacaaatattctctcattttattcttgcaattatcttaggggttcctgtcctcattagttaggtgaagaaattgaaactcagatttgtgacttgcttaagatcagagttcatgacaaagcttgggtggaatgtaggtctgctggctgaagtctgtcatgttcgcagccctgttttcatcttgggtgctgttgggttgctatatatggggcggaagctatgttgagaatgccactacttaaatttagccaactaccgagaatgatgagtttcaagcttctccaacttggctgcacgttagcatgacttgggtaatgtaaaaagaaaatcccaacgtccaggccacaacccacaccaattaagtaaaaatcgcttggggtggcttctgtagtttgtaaagctacccaggtgattccagagcacagcaaattggagaaacactgctctggattcttgctactcaaaatgtagtcattgactaccagtattggcatcgcctgggagcacaggcctcaccccaaacctacagaagcaacatcttcattttaacaaggtcctcaggtgatttatgtgcacaataagatttgagaatctctcatctacagcagtggttctcaaagtttggcatgtctcaagattacctaggaacttggtgaaaagcttgggcctgtatgtttcttattagctctctgcctaactgataacacactgagtcaggagtccgcaagcttttccttaaacaaatgggcatggctatattccactatcactttatttataaaaattggttgtggctatgtgggtcatggtttgccattcttaagtgatactagttcattgagattatgactgagcagtttaatctgcacttttttttttcttttttgtttttgtgagatggagttttgctctcgttacccaggctggagtgcaatggtgtgatctcggctcactgcaacctccgcctcctgggttcaagcaattctcccaccccagcctcccgagtagctgggattataggtgcacaccaacatgcccggctaatttttgtatttttagtagagacagggtttctccatgttggtcaggctggtctcaaactcctgacctcaggtgatctgcccgcctcagcctcccaaagtgctgggattataggcgtgagccactgtgcctggcctaatctgttttaaaacttatatacagatgtcacagaccctatcaggaggcttccggataatttttagtctagagaaattggaattttgaataagaaaagcatctggactttgagacacgggttgaaaactgggaataatagtaattttatgaaggaagacattgtaattgcagtctttaatacataggttttgtttaatttttcataatgatcttgagatacatgggacaggtattaaattcccatttaccaggtcagctattgtctcagaggttgtgatttacccaagccagttaccatcaacaggaaacattcttctttggtgtgtcttttcaatatttgcttcggggctaaaacctacagactgcttttggagtgttgggattagatttagttaaaggctcattataggtaactcttgtttttatgcttctgttgatttgctttatggttctcaatttgacatgtactgaagaattagctgtggacctgtgagtagccgctgcactccagcctgggcaacaatgtaagaccctgttcttaaaagaggccaggcatggtggttcatgcctgtaaatcccagcactttgggaggccgaggtgggtggatcacctgaggtcaggagaccagcctgaccaatatgatgaaaccctgtctctactaaaaatacaaaaattagccaggcgtggtggcatgagcctgtaatcccagctactcaggagtctgagacaggagaattgctagaacctggtaggcggaggttgcagtgagccgagattgtgccattgcactccaccctgggcaacagaagcgaaacttcatcacaaaaagaaaaaaaaaaaagacaacactgaaaaagcgccaggtgctcagtggcttacacctgtaatcccagaactttgggaggccaaggtggaagaatggcttgaacccaggagttcaagaccagcctgggcaacacagtgagtccctgtctctacaaaaattaaaaaaattagctgggcgtggcagtgcacctctgtagtcccagctactcgggaggctgagtttggagagtcacttgatcccaggaggtagagactgcatgattgcaccactgcgcttcagtctgggcaacagaacaagaccctgtcttgaacttaaagacacacccccaagccccattgcgtttctgattcttaggtgttttttcagctgaagtatgttgaaggagttgattttgagtactactgcatggagagtgaggtagaccctagcatttcctgctcccccttgctcaacacctctatggggtggtttatttttattttctgtgctcttttatggggccggaagccattcaccacaaacactgtggaaagtctattccctgccattctttgcagtggtgggaagcccagccctgagcacctcctgcccacacatttcctggcccctatcacatggaaaccatctctcttgttttcttctcttagcagcctataccttcggcctcttgtgatcacatcatttcatcttgggcttcaaaacacttttgttgtgatggctagaaaatacttggggaggtcacagaggcgtgctccctggtgttggaggttatagaggccagggagcttgtttgcaaacttagcgggagactctgctgctctcctatcttgttgggttgcagctcagctctgggcgtctgtaataaaagtttgtgtgtgaaatgacttaataactacggttaatttaaaagtttttaacaaatataaaaaatagatttctcctgtgggagaaaacactttctagaacaaggatcttagaggagagagtaggaaaaaagtgggaggaagcttatgaagaaggactaaacaaagtattttatttgcttacattgattttataggtaggtccaagttctgtcaatgggatttttaaaaagtattttcaaaccaccagagaggcagcctggtgttgcggaaaacactttgatctgaaagtgttgattcaaggacttgttctgccacttactgtctgttgaccttttgtcgctaaaatttagcaaataattacacacttaggctctgtgctaggtagtgcatggcattagaaaagataagacacagccctatcctgtccaggagtgagcgagcgtgggccacatgtctggcaaactgttaagcgccctcctgttacttgcgtttccctatcattgcatgaaggaggtgggtggcattcttatcttcctgatgaggaaatggagactcagcaagtgttaggcttgaatcttatttctgtctagctgaaagcgtttgggttacgctttgaatgagataagtcataaactcagcatggggataataatacttcatactgtggttatcccaacaaaacgttaagtgaaaatatctgaatgtaattgctctacaaatgtatcattcctttcagtgctcaccagaagctctgagggttccatgacatactgcttttctccctcagctgcacatccgtttcactgactttcagctaaagcactgtggtgaccaatggcaggcctggctcttcctgggagaagcggagagacctccctaggagccccgtttgagacctgctattcaggcctgttaaatcccagggataaacaactttgtttttaacttttaattgaaattttccctcatgcctgcgtatacatgcacgtcaagaggccagcaagctcccatatgtctaacagcttcaatgattgtcaacatttaaccccaatctagtgtcagggtataaataagagacatctgatggcagagctcattctttctgttattactccttcctttaaatttttgcttaccatgaattaagtgctacagaaatgatcagaacggacaaggcgcctcactttctgagccttaaattccattagggaagagagccaaattattacataaatgaaataattttgttgtgagtggagtgaaggaaagaaacagtaaacaatataatgtgacagtaaatggggctggggagggagctgcttagggtggttaggaaggacctctctgaccaggtgacctttaggctgagatctgacagctaagaaagagtcagcgaagggaccagccatggggagtgtgtctggatattagttatccccattggcatatgcttgagtagtggataagtattgccttgaggccacaaacatcaatttttttttttttagatggagtgttgctctgttgcccaggctggagtgcaatggcgcgatctcggctcactgcaatctccacttcctgggttcaagcaattctcctgcctcagcctccctagtagctgggattacaggcgcccgccaccatgcccggctaattttttgtatttttactagagatggggtttcaccatgtttgccaggctagtcttgaactcctgacctcaagtgatctgcccgccttggcttcccaaagtgctgggattacaggcgtgagccaccgtgcccgacaacatcaaatatttattgagggagtgcctcctaaaggtacagagctctgccttgccattctgatctcatcctgaagggggatcaaatccatgcaggcagagtcaggaagagggaagggccacggaggcaggaaacaagacacttagtcttagggggcctgggaatgccagtcaattcatgctccttcctctgatggctgaatctggaaccacttggtatttctgagtccacagagcttggtggaaagcctgggatccgagtctggtggggatcagggcctagttcaccgtgatcctgtgcaagccgctccatgtgccttctgatttgtaaaaggggagagaatactctgtctaccactggggtttatcattttgatcaaaagagttgatgtttgctttggtgttgtacagatgtaggatattgttaataaggagtccagataaggatgtcgttccacccatttcccttggtaaatcactggaataacttgggtcagcaaggataaggtggacaccttagaggttggtaaaaatagaatcttgcagcctccactggaaagaagtcccttttaaggtttacctactttcctcccatcaaggctggaagcatgaaatggagaccaggtgctccccattatgtaaaccatattccttcatctacctagactctcttaggtcctgccagccttgtcttcttacacttatatgatcttcctctaatattttccttttttgttgttgttgttgctaaatttcatgtgggtggttcggggaaagggtagacttgcactcctccccactaatcagtgggattttaggaaggctttgaaaatgggaaggatcctcccctcagatcctatcacctttggaatgggaacatgcccacatttccagagcgaacagacactggagtcctctcttctcaaaggtggcgaaccgtcctggagtgacgtggcgtgttctggcctgcgaggagatggctgcccgcagaacctgcccgctggagggcgctgcagaggtctggctccgtgctttcagatgtgttcggccaggggctccaggggctccttctgaaagcagagaagcccccagaggttgagaggggagataagacgtgagccttttcagctgtgatgtggtgaggagtcagggaggccgtgagcactgtggggccagaagtgttggcttctgtcagaaactcggcccagcctgaccgctgcctcctggccctgtcatttcccctccatcacgcgcttccttctggaagccggaagcaggaggtgggaagctgcggaggtagtgacaaaatcatggtgtaacaagaagctcctagggccgaagtgactggagaggtggccacatactatgagaaacaccagcgcaccggcagggcctggggagttctgagctctcccgggctgtgtgaagccgcagccagcccacttttttctcagtatggcagtgccatctgacctggcccagcccatcttgttcgggtcatggttcgtcttcctgggcattctgatgcattcccacttcatatttgcactgggatttcagtttactaagcattccacacccattactgctttcaatcccttcaacaacactgagaataggtgggcaggtatttttatctctatgtgaataataacacatggggactcagaaaaattaaaggccccaggagagaaggctagtgaggggcagtgacgcttagggacaaacaactggttctcctgcctcctgcctgaggactcctgcctgaggagaatatagtaacaaaagcctctgtcttgcaattgcagccattaacacatctctttcatacccactactcactggactgttaactccttgaagacagaaactctgtgtgtgtgtgtgtgtgtgtgtgtgtgtgtgtgtgtatttaatgggagcagtactttcttgaggcataattacatgaaaatacactaatgatgcatttgatatatatatagccatcacccaagataaagatatggaacatttccaccacccctgaaggtttcctcgtgccccttttcaatccatccttctaccccagaggcaaacagtgccctaatttctatcacctgtgatgcgttttgcctgttcttggacttcatctgtatggagtcatagtttgcacagagactgaatccccagagcacgacacagcctggcacatggcaggtatacaatgccaaagaaagcctggttcttaaactacctgtgagagagagttcgtcccaccgggaaactgaggcggtgggcggttagtgacctgccaaaggcacgagtgtatgatgtggtggatcccggactccagccagcctaattccgaacccaaggcctcctccgggcccccagccctccctgggcacttcctccggggctccgggtggagcgggtctgacgatcccggacgaacagcgccccctgctgccggcccaggccccaggccctcctctcctttcggggggatgtgacaggatgacacaggccttgcgcccagcgcagtgacgggcacagggcagggacttgtgggataaaagtcacctgcccttttattttcctcggaaaagagcttttcctaaactttgggggctttctatctccagaattaacagacaaagggagaagaggtctttttggtggagcgctgctgcccccatgcgggtggatggcgacactaccgaagagcaggcgatcaagcctggtatttttgggtttcaggttctgcggctccctgagacctgcagattcctggtctccgggtccctgggtcccggacgtgtccatcaaggcgtccattagggccatcacctaatggacaagcatcagggtaaggggggaggtgctattgggggggggtccctcagagaatcagccctagctctgtgtgggggcaaatacggcctccccacctccctccctcccaggagacactggcctgagcataagtctcgagggtctgccctgtactaagcaagcgcttaatcaggtgagatcaaggtctgatcttggctggtttggaggggcagcagaggtgcggtgagggaggcggctcagcggtggggccagcagcacctccccagcctgctgcgggcccggtgcaagtcaccgaggggccggcagcccctcccagcctggcatgttggccttgctgcacctgcggttggggggtggtgtaacggcccagcctgctcccctcggcacgtggcctggggcgatgctatctctaactcagtattttaaactcttctttccagaggatgtggcttctgcgggagagcttcaaagggtgccctacttgcccctcttggtaaccatgacgtcatggaaatgggaggggaccgccccagcccccaaacacctggagggaagtgggagactttttccacttcctgttctacttgtggctactgactcaatgtctgacctgtttattaattgcaaaatatagctctatgtgtgctacccagagaggcctcaggcctgtgtgtctctgtgtgaaaggaggcctgcactccccacccctcgccgcgttgcccaggtggccttgacacagacgcagggcgctggtggtcctgcagccttccggcagccagaatgacagcactgggtctccatgtgcttgctcccccagactcatcccagtcagaagctcgtcttcccacacatggctcacggaggtagatgggttttagagtaggactcatggagaaactgaggcgaacccacataaagtgactgttggctctggacctcagtgtggtcacacagtgaggtcagactcccaggtaccctgcgtgatttaccacagtccctgtcctccaggctttgttggatagatgtgtgcctgcctgggggctgccctgagcaaggggccaccactcaggctttccttgttctgaagttcttgacaagttactttagctcttggcaaaactgtgaagcattgactcacctgaccacttcctctactaatccccactttcctttctcctgtactccccactcctcacactcagctccccccacccagagcctaactgcaggagtcattcacttattcatttaacggcatctgttgtgtgccaggcactgttctagttcctggggacacattgatgacaagggacattcccatcccacagagcacacaggccaggggacttccacactaggatggtacctgataataaggtgctataggcctgtctgtatacgtgatcccaggggagttgaattttatgtttggacctaaaaaataagcaactccttaagactcagatggctgcccccagtgagggtagcagcagaggggttgctctgtcagagctgaagacctcaccaggatgctcctgaagcacgtgcttgcatagcctgccctttctcctgagtggctgtgactccagttgcactcagaggtcaagtcttcaagtgaagtttcagagagtcctctagaatcttagggctggggccacaagagctcatttagtccattcttctgcctttgggactggcctgtgcttaagtcttttgggagagtagggcatgtgtccagagaagtcccttctacaactggccttagtaacatgttccctgctgggatgtcggcctgaggttgggtccaggctggtagagctgcagctgcagctgcagcccaaggccttggctcgcagggtctgtgggtcttcatggccagtctcttcatgactgtgttttccaggtctcctcagctgcctattccctccaggctaagcaatgcccagttccgtatagctgggccctctgcactgaggggctttgctgtggtggcgttaggcccagtgctgacctggccggtgggcacaggagcccttctcctgagcctcctcacaa

SEQ ID NO: 1479 - DNA, 699 bp, Homo sapiens
catccggtgtggtcgacgggtcctccaagagtttggggcgcggaccggagtaccttgcgtgcagttatgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctgaatcattctcatttacttaattgaggagtaggagactaaaagaatgttcactctttgaatttcctggataagagttctggagatggcagcttattggacacatggattttcttcagatttgacacttactgctagctctgctttttatgacaggagaaaagcccagagttcactgtgtgtcagaacaactttctaacaaacatttattaatccagcctctgcctttcattaaatgtaaccttttgctttccaaattaaagaactccatgccactcctcaaaaaaaaaaaaaa

SEQ ID NO: 1480 - DNA, 342 bp, Homo sapiens
atgtcggcgtcggtagtgtctgtcatttcgcggttcttagaagagtacttgagctccactccgcagcgtctgaagttgctggacgcgtacctgctgtatatactgctgaccggggcgctgcagttcggttactgtctcctcgtggggaccttccccttcaactcttttctctcgggcttcatctcttgtgtggggagtttcatcctagcggtttgcctgagaatacagatcaacccacagaacaaagcggatttccaaggcatctccccagagcgagcctttgctgattttctctttgccagcaccatcctgcaccttgttgtcatgaactttgttggctga

SEQ ID NO: 1481 - DNA, 29956 bp, Mus musculus
  misc_feature (1335)..(1858): "n" at positions 1335 thru 1858  can be any base
  misc_feature (7091)..(7110): "n" at positions 7091 thru 7110  can be any base
  misc_feature (20085)..(20586): "n" at positions 20085 thru 20586  can be any base
  misc_feature (24372)..(24840): "n" at positions 24372 thru 24840  can be any base
  misc_feature (29121)..(29589): "n" at positions 29121 thru 29589  can be any base
tctatggcatagacagacacagtgaactgggtcattttggcatagacacagtgagctgggcctcagtcacacttagattgagtaagatttctccatctagaagctcccataatgcaaagtggacccagagttccccaaggcaggaaccactattaaggtgctgagcacaatatatcccttaccaatgacagttgtaaccaaccagaagcagttctgtgtttcagccagcccgtgtttgaaagagtaaagctgtcttttttttttggttttctgagacagggtttctctgtttagccctggctgtcctggaactcactttgtagaccaggctggccttaaactcagaaatccgcctgcctctgcctcccaagtgctgggataaaaggcgtgcgccaccacgccaggcgagtaaagctgtcttgtagctgagggtgtagcttggtggaagagtatgcacttattatgtgtgaggccttgggaatgggctagtgacctcagctgccggggagggtcagggacgaggctcccctgggcaactgagactctgcttcgaacaaacagaaaatggaagggttcgggatgtggagagtggtggcactaccctcctttaaccctgtacccaggcagcagggacagctggatttctgtgagtttgagggcagtatatggttgacttactaatctccaagccagaacacatggctaatttaccagctagcaagcctttcttatgcctgccagcctaacgttttggtatcatgatgaggtttatgtgggccgctcccttctcggaacacatgcaacttggagaatactcaaatcttgactactaaagaaaaagtcaggaaactgttgtgacacctagtagcttgtgcttcacaatgaccaagcacacgtgagtggtctgccacagactggccttcctatattccccatttgtttgtttgtatgtttgtttatttttttgacatctgagacagggtttctctgtgtagccctggctgtcctggaactcacttttgtcaacgaggctggccctgaactctgagatctgcctgcctctgcctccagagcactgggatcagaggtgtgtgccacctctgcctggcttgcctagattctatgtaaagcagtagtcgaaggcattcaggccggaatcccagtacacattccagacaaaagattcataaatctgcaggtttgctgctggcgcagaaaaagagctgatagccatgaagttggcaaccatggccaagtctacgagagtcggaactcagttagatgtgtttgacaattctggggtcaagccgggcgtggtggcgtacgcctttaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatacatgtgtaggggcatgcacacacacaatacatttttatttattgtgatcataatattttcattactattatttgagacaagctgttactatatagccctggctggcctggaactcagtatgtagactggctttgaacagaggtccacactggcttctgaatgctggaatgaaaggcctgggtgacaataagaactaaagttggggctcgggggacacacttgcttcagggtcttgtgacagcctgatttgttgtatgtcatatgccacatgagcaaggctactactatgtctgctggccaggtggcattgtactgaagaacaccaaccaatacctaggaaccaaactccagctctgactccactcttcaagttagaaacactggggtggggtagccctttgataatgggcaaacggtgcctagtggacaagacacggctttgagttggaccaagggcattgcaagtcctactgaaagatggattagaagccacaccactgtcattattgagcaagaggtggaaaaagaggaggttctttattcataccagagtctgtcacccgccattctaagagtcctgaggactgccttttttttcctttttccattacagacaatgagaaatttacagtgttttaatgttgatctctgcatttgttgttttttaatttttaaaattttttataagattagatgtgtctatgtaccatatgcattcaatccccatggaagccagagagggcattggatctcctgggcctggacctagagttacagatggttatgagccaccgtgtggatgctgggaatagaaccctggtcctcagagagagcagccagtgcttttgacaaatgactcatcaccccatcctgagctttgatctctttatgttgaacctgttcctaacctgtttcgaccacatctggctacttgacaacctttgttttaatcctcgaccagtgaggtgggactcatgttttgtgtaaaaagaagcaccttacaatttagagacaggcatggctttgcacaccacccatttgctcacacagggaatctagcaaacacatggttttgcatgatgtaagcaagatactgggttatgtactcagacttgcattctctggtcaggtgaatgtagatctaaatgcattccaagtagagagagaatttcttggtgaaaaggcctttgttgacggtacaatggtcaagtgtgtgtgcttgtgtgtgtgcgtgtgtgagtgtgtgtgtgtgtgtgtgtgcttatatgcgtgtgtgcgcgcgcgtgtgtgtgtgcgtgtgtgtgtgtgtgtgtgtgtacataagaggggagttattttgtgacagggtaacactatgtagctctgactggtttggaactctatctgtagcccaggatgttttagaactcacaaagaccctcccgcctctacccccacgagctggaattaattaaggtgtgtgtcaccacacctggcaacggtggtcatgtttcagatgaggaatcttcacttccagttctgtgtccctgtctagcttcctttgtgatttctcatgacccaactctttggtgtaaacagatgcatgcaggggtgaacagtagaagacaaggcacctatctgtaaaagatggatgctcctgctgtcttcttgtgtttcttgtgttggtttgtttgtttgttgcttgcttgcttgttttattttgttcttttttgagacaaggtctctgtatttgctcctggttgttctgtaacttgctgtgcagatacagctggcctcaaactcaggaagatctgtctctgtgtgctgggattaaggagatgggccatgacagccagctgtgatttgcttttgctcttgccagaacccagcagtgtgttgttgggaagatcaccggacctctctaatctcacagatcttcttattacttatctattggctggtgcatgcattttaaaaaactatgtgtgtgtgcgtgtgtgcatgtgtacatgagtctaggtgtctatcaaaggaggcagaagagggcataaaataccttagtggtagagttgggaggcaacttgttggaatctgggagctgaacttgggtgctctgcaaaagcagtatgagttcctagttgctgagccatctctccagccctctgtgtacgcgtctgttcgctgtgtacacatgtgtaagcagacgcttcggaatgtttatgggtgtggaggccagaggtcaggcgccatgggttttttctttccttttattgaaacaggatctcactgtgtagctctggctgtccaggaactcactgtaggagaccaggcagctggcctcaaattcacagagaaccatctgcctctgtctcctgagtgctggggttaaggacaggcgccaccacgcccagacaaagtgtcattctttttttttttttttaagatttatttatttattatatgtaagtacattgtagatgtcttcagacactccagaagagggagtcagatctcgttaccgatggttgtgagccaccatgtggttgctgggatttgaactccggaccttcggaagagcagtcgggtgctctaacccactgagccatctcaccagcccccaaagtgtcattcttagggaactgtccaccttgagtttcaaggcagggtacttcatctgttgctctgtggtaattttgtctggccggtgagcttccaaatgacaccatctcgccaggccttccacatggaaacacaggactcaggtccccttgctgtgctacaaacattttcctaactgagatgtcaccccagccactgtcttctctttaaaaatctgtgtgcgtgtgggtgtgcatatgtcatagtgtatgtgtggaggccagaggacaaatggtaggcattaggactctctcgataccatgtcccagagatcaaggtcagatcctcgattaggtggcaaggaagattacctcctgggccatctcactggctgacaaccccaccctcttccctttaacatggagtctcactctgcacttcaggctggcttaaaaatcactgctatcttccttcctcaacctcttgagtttaaaggtgtataccaacactcctgattgattgattgattgattgattgattgattgattgatttctttctctccttttttttttcttttaaagatttatctattatatctaagtacactgtagctgtcttcagacacaccaaaagaaggcatccaatctcattacaaatggttgtgagccaccatgtggttactgggaattgaactcaggacctctggaagatcagtcagtgctcttaaccactgagccatctttcgagtcccctggtttcttttctttttgttcttttgtttttttggtttttgagacagggtttctctgtgtagccctggctgtcctggaactcactctgtagaccaggctggccttgagctcagaaatccgccagcctctgcctcccgagtgctgggactaaaggcgtgcgccaccagacccggctctggtttcttttcctttggttttagatagcctctctatccaatgctgcctcagactacttgatgataagattacaatttttttttaaagatttaattttatttatatgagtacactgtcttcagacacactagaagagggcatcagagccaattacaggtggttgtgagccaccatgtggttgctggaaattgaactcaggacctctggaagaacaatcagtgctcttaaccacctcgagattacaaatttgtacccatcatgtcctgcgacacaattatcctacctacctatctacctacctacctatctatctatccatttatgtgtatgtacacctgtgcattgcatgcatacacaaggaaccccagcatgcatatggaagtcagaggacagtgttgtgaagattggttctctccttccaccatttgggcctcagggattgaactcaggccctctggtttggctgcaagcacctttacctgctgaaccattaagcaggccatatacatacacacacacacacacacacacatatatatatatatatatacatatacatacacacatatatatataatttaaagatttatttatttatttatttatttatttatttatttattatatgtaagtacactgtagctgtcttcagacacaccagaagagggcattggatctcactacagatggttgtgagccaccatgtggttgatgggaattgaactcaggacagcagtcagtgcttttaacctctgagccatctttccagccccagagtctctttatatagccctggctgtcctgaaactcactctgtggaccaggctggcctcaactcacagggacctacctgcttctgcctcttgagtgctcaaattaaagttgtgtgccaccatgcccagtctaggccccaatctgacagataccaggtactttatgaaaggctagactcagtccagaatatatttctttcctgaatgctctcttagctcaaaaccaacatcttctccagtctctgaagattccttctgctccgtcttctcgatttccttcaccgctgtataccatccgtagcatattattactattattattattattattattattactgatttttggcagcaagggttcctaaccaaggagccatctctccagcccctgaatcaccctccttaaccccaaacttatctctcggtttttcttttgttcctttgagacacactgcatatctcattggcctgaaactcaccatgtaaaccaagctaacatagacctagtagaaatctacctgcatctgcctcccaggactgagagctcaggctaaaggcataaatcatcacacccagtctctcttgctttttcccacagcttccaaaaatgtcagttctaaaacgtaccttactgctctaattacacagaccatcttctgtgggtacttcggttataggttaaccaacctgtgttttcctagggcccatgtaaatcacaaacaggatgctcactcactccccactcttcttctgggagttcctatcactgccagccgctttctggccataagataactgagctgataagacagcaattggagccctgacaagccggcttatggcctcgctgccatgggtggaagaaagagtgaatgtgtttgggtattcctttctttctttctttctttctttctttctttctttctttctttctttctttctttcttnnnnnnnnnnnnnnnnnnnnctctttctttctttcttttccttccttccttcctttcttcctttcttccttccttcctttctttctttctttctttctttctttctttctttctttctttctttctttctttctttctttctgttttttgagacagggtttctctgtgtagccctggctgtcctggaactcactctgtagaccaggctggcctcaaactcagaaatccccctgcctctgcctcccgagtgctgggatttgtgtactcgtttcttgagtctccccctccccacttcaagtttctgaggcaaggtctctttgtatcccaactaatcttgaagccctgatcctcctgcctccactccagtgctggaactacccacatgcagcacacatcaagcccaagtctattcagtgctggagatttgaagcttagtgtatttggcaaagcactatccactgagctacatccacaacccctctgaagaagtgtcttgatttggcttatttctccatggatgttgtattattcacccatatcggtacacattgtttaaagtccaatacccaagaggaaagcacactgaaagtcccgggacccgtgagatgctctgactagctcagattgtgagcctgaagagggttactctccagtcccattttctcacagtcccatgcaggggtgggtaaagttgcagggtactggtgggggcctttgcaaactctcgtaaactgagctaactaacgtatgtagggtggtgaaaaggagttgacaatctcagtgacaggtgacaagaaggtttggacaaaatcaggcacgctattgttatcttactgttttatgttttcaggggtttcgttcttgatccattgagtttctgagagaggatgtcatggaatccaggctggtctcgaactgatcttgaacttttgatccagcctctacctcccaagtgccaggaccacagacctagctggacgactatgtctagaatacagctaatatctgagcatagggccttcagattcttcagctgggtcttctgaattttgctaaccagatgtctcccctgctattacatccacttggacacagcataaattagcaagtcttgttttgttccactgcaaatgtgtggctcaaggcgggcctccccagggcttgctttgatcttctaaaatcgaaagtcaaagctcagtaggacactgtgcatccagctacctaagatgctgagcagaaagtctaattgaacacaagagtgctggaccagcctgggcaatacatggaaactctatctgaaaaataaacacataaacaaacaaacaaaaccagaggttagacctctgtaggtgggagaatctgtgcttagtctccaggacccagtgatgggtgttgcaggcgtctgagcaggtgacacacagtttcaattcttgtttgtttgtttgtttgtttgtttttcgagacagggtttctctgtgtagacttggctgtcttggaactcactttgtagaccaggctggcctcgaactcagaaatccgcctgcctctgcctcctgagtgttgggattaaaggcctgtgccaccacacccagcttcttcttttttttttttttaagatttatttttatttatttcatgtatgtgactacactgtagctgtcttcagacacaccagaagagggtctcagatcccattacagatggttgtgagtcaccatgtgattgctgggaattgaactcaagacctctggaagagcagtcagtgctctttttgtttgtttgtttgtttgtttgtttgggttttttttttgagacagggtttctctgtgtagccgtgtgtgtggggtagccctgtgtgtgagtgtgtgtgtgtgtgtttgtggtatgttgcaaaatagattaaacaactgagagatggaataggtcttcttgacatcaaaaacatgatcgtgaacccctttattaaatctaacactcagagacaggagcatctctgcaggtttgaggccagcctgctctacagaatgaatttcaggtctcaaggtcagcttggtctacaaagtgagtttcagatctcaaggccagccaagactatgcagtaagaccttagctaaaataaataaataaataaaataaaataaaagttaatcttcgcttggcaaaccgataattgaggaccagtgctcaggaaggaggcacacgggaattccagaggctacagagggagcctcgctctgacctggttagagcaactctactttactggctgtgtctatgaggttctgcttgatttcatttgacaaaaagtttccacagctaaaccaggcaagggagccgaagtagacacagccacccgggccgcgccaacaggtttctctctgctgctgagaagcaaaagcctgtttgaagaaactctctgaaggagactgtggttgagtggtgggggtaggggtgctggggttgggctgaggctgagggttgactctaaggagctggaacctctcagcttcggtggctaggcaggggagttgtaatgaagagggacaggtaccctccttggtggaggagggtggaatgaaactctcggtttcccccagaacttggcaaagtgtgtgtgatgtctcccaggtagtcccccaaaggaggaggctagcagagctggggaggcaggaagtgggtaactagactaacaaagatgcctgcctgtggcggtttgcccatcccaggtgggagggtgggactagccttgggcctgggcctcctgtgaacttggtgcttgagggctcagagggaacccagtcaggagcttgaatcccacgattcagcgcttctgtctgcggccaatgggggcctctgagctgacgatctcgggtactttttgtaacttccagaacagggctctaggatgtctgatgttggggcgagtggcttagggccagctccttcaggcctctctacattccttcagggatcatgggctgtgtctgcagctcaaaccctgaagatgactggatggagaacattgacgtgtgtgaaaactgccactatcccatagtcccgctggacagcaagatctcggtaagaggaagatgggattagtgaagggatgggggccaggagataggattggtggagggatgggggcggaggacataagattggtgaagggatggcatggggttgaaaggttgtgtatccaggagaaaaaacctaaatggaccataactaaaggctctggaaaatagcagcactcctatcttccctagcatacatcacagaagaggcccagctagaggaagggaccttcctaaggtcaaatgtacacatagttggtgaattcagagacaaggttcaaccaggctggagaaacggaaagaagaggagaggagagggagctagggtcagatcctgtcttttttctttgaccccagcctcatttcctaccccacagctgcccatccggaatggctctgaagtgcgggacccactggtcacctatgagggatctctcccaccagcatccccgctgcaaggtgacttcatccagcagcctgtgaaacatgatacggcctggggatgcttggttgttcgtgtccatactgtcttcatcttctctccaccttgtctgcatcctgtgtctctagaattccactgttcctgtcagccccaggctggcttttcttgactcttcttatctttacagacaacctggttatcgccctgcacagttatgagccctcccatgatggagacttgggctttgagaagggtgaacagctccgaatcctggagcagtaagtatacttctaacccaccttgcctgatgtggtgtgtgtgtgtgtttgtgtgtgtgtcctcagccctcctgcacccattacaggctctggcctcagctgaggggttttggaatgtgctagaaataagtctccagagtgtttgatccaggggagtaatgatctggtctaactggggactcaggggtttccagtggctatatacgccatgatgatggtctctgtggtgcaggagcggtgagtggtggaaggctcagtccctgacgactggccaagaaggcttcattcccttcaacttcgtggcgaaagcaaacagcctggagcctgaaccgtgagcaggagacctccgtgggaatggggttcacatccagggatctcagaacagggcgtggtccggggagtaggggatgtttgactgagatggaggaagaattggacaaaggtggcacaggcttttaaacctagcattcgggagggaggggcaggcagatctctgagttgaaggccagtctggtgtacagagggagttccaggacagctagggctgcaccaaaaaaaaaaaaaaaatcgatcaaaagtcgatggtcttgtatctgccttatatagttggttcttcaagaatctgagccgtaaggacgccgagcggcagcttttggcgcccgggaacacgcatggatccttcctgatccgggaaagcgaaagcactgcgggtgagagggcttggtgggcggagccccggtgtgggcgtggctgtgaggtgagggcgggcgcctccgggcgagaagggggcgggggcggggagctgtgggaaacgggggcggtgaccacctgatttatggaaggcaatccgccacattttctttttcctcttcaacttctcttctcttccctcctcccatctccaacctttcttcagggtccttttccctgtcggtcagagacttcgaccagaaccagggagaagtggtgaaacattacaagatccgtaacctagacaacggtggcttctacatctcccctcgtatcacttttcccggattgcacgatctagtccgccattacaccagtgagctccggcggaatgcgttcacctgtgcccatcctagcagcctctctctctctcccgcacccagtccttcttagggaccctccaaacgtctttcattccccttcagtggatgaggggtatagaacctgaccctagaccctgccggctaatgttgaatgacccacgttttccctcccataccagtcggtttcccctgcgaggaaagtggaaagagggtaggggctggagggagcatccaaggtctctagtgaccgcattaaccttctcttttgtctatgcagacgcctctgatgggctgtgcacaaagttgagccgtccttgccagacccagaagccccagaaaccatggtgggaggacgaatgggaagttcccagggaaacactgaagttggtggagcggctgggagctggccagttcggggaagtgtggatgggtgagtgtgaccctcgggactgattggaaagaggagagagaatgtgagcttcctctcacactggcctattcaggatggctgcctagttcgtcaggatcttgacctctgtaacttctccacccgtaccccatcagggtactacaacggacacacgaaggtggcggtgaagagtctgaaacaagggagcatgtcccccgacgccttcctggctgaggctaacctcatgaagcagctgcagcacccgcggctagtccggctttatgcagtggtcacccaggaacccatctacatcatcacggaatacatggagaacggtgggtgccctgctatgtccagccgcttgagggcgctattgtggtcccactaccttttggacccagggaaggaaggcgcttttacctctgatcttctaaagactcttttctgggtccctaagctttggaagaacgttccatctgatagtccctgatcttcagtttctgttcctttcttccaatgcccacctgggtttcagaatgcttgacctaagaaatggtgtatggtgcctgaagagaccagaaaggagtgtgggataccctggagttacagacaattgtgagctactggggatcaaacgcgggtcctctggaagagcagccagtgctctcaaacgctgagctacctttctagcccaaatatgtagtatgtttgttaaggatccaagagtctgactgcctggatagagttgaggctttataattgtatggctttgggctgatcccatcacggctttctgctccaaatagaactattttaatctgtaaaatagcgggtttagggccagcaagatggctcagcaggtaaaggtgcttgctgacaagcctgatgagcaggagttcaatgcctggaatccacaggagagagggaaagagctggctcttaccagagttgtcctctggtctccatacctgtgtaatggctcatgcatgtgccgcctcctatgaataaatacatgtaattaaagcatagctgcactagtggaagaactgcatctctacatagttgctatggggatggaagagcagttcctgtccagccttgcttttatgtggtttcgattgtttggagtgcaaatcttccaggaagggaaacaaaccattcattggctaatgattcctggaaatggcaaataggctttctttttggtagtttctttttttctttcttttttttttttttttttttttttttttttttggtttggtttttttttttttgagacagggtttctctgtgtagccctggctgtcctggaactcactttgtagaccaggctggcctcgaactcagaaatccgcctgcctctgcctcccaagtgctgggattaaaggcgtgcgccaccacgcccggctctttttttctttttgagacagggtttcttcgtgtagccctggctgtcctggaactcactctgtagaccaggctggccctgaagtcagaaatccacccacctctgcctcctcagtgctaggatcagaggtgtttgccagaaacctgattttgataatggacactgagaaaagcagtttgtgacctagggatgttcccaaataccccaggaatgtagacagtgaagatattttcctttctctttctttctttctttctttctttctttctttctttctttctttccgtctttcttctttttttttttgttttttttttgttttttgagacagggtttctctgtatagccctggttgtcctggaactcactttgtagaccaggctggcctcgaactcagaaatcagcccgcctctgcctcccaagtgctgggattaaaggcgtgcgccaccacgtctttctttctttttttggctcggcttttcaagacagggtttctctgtgtcctctgcctccctagcacagggattaaaggcatgtgccaccaccaccaggcattttttttttaacacaaggtttctctgtatagtcttctctgctctagaactcactcagtagaccaggctgtctttgaactcacagagatccctccatctctgcctcccacctccccagggattaaagctgtgcatcaccactccctggcctctttttgttgttattgtttttttgtgggattttttttttggggggggggatagggtttctctgtgtagccctgactctcctggtcccgaactccaagatctgcctgcctctgcctccgaagtgctgggattaaaattgtgtgtcacagttgctctgctaattagctgaaggaattcatgacagctggtaggaacagtgtagaagagtggtccagctgggcaggaaaaggaaaggagaaacttctagaagacaagaaatgaagcaaagagactttgaaggaagagtctagctatctgtgtggagaatccaacaataatctgtgatagagaaagtcaggtctctgggaagaagacacaggcatgaagcatgtcagcttggctgctgtggagatggggctctgtcttaactggaggcaagaagcctctggatcctctgctcatatcccaacctagccctctggaaaaggccatcccatatgctgagcatcccctccttgtgcacagcatcccccttgtgcacagcaccccccttatgcacagcatccccctcttttgcacagcatacccccttgtacacagcatcccccttgtgcacagcaccccccttatgcacagcatccccttatgcacagcatccccctcttgtacacagcatctcccttatgcacagcatcccccttatgcacagcatccccctcttgtacacagcatctcccttatgcacagcattcccctcttgtacacagcatctcccttatgcacagcatccccctcttatgcacagcatccccctcttgtgcacagtatccccccttgtacacagcatcacctccttgtgcacagcatccccctttgtgcacagcatccctccttgtgcacagcatccccctcttgtgcacagcatacccccttgtgcacagcatacccccttgtgcacagcatccctccttgtgcacagcatccctccttgtgcacagcatctcccttatgcacagcatccctccttgtgcacagcatccccctcttgtgcacagcatcccccttgtgcacagcatctcccttatgcacagcatccccccttgtgaacagcatccctccttgtgcacagtatccctccttgtgcacagcatctcccttatgcacagcatccccccttgtgcacagcatccctccttgtgcacagcatccccccttgtgcacagcatccccctcttgtgcacagtatccccccttgtgcacagcatctcccccttgtgcacagcatccccccttgtgcacagcatccctccttgtgcacagcatccccccttgtgcacagcatctccccttgtgcacagcatccctccttgtgcacagcatccccctcttgtgcacagcattccccctgtgcacagcatccccctcttgtgcacagcatcccccctgtgcacagcatccccctcttgtgcacagcatcccccccccttgtgcacagcatccccaccttgcacaagcattctcttcccttgctcacatcatcccccccttctacccccaagcacacactttttctcagtcctcattcttccttgccacggtcaggcactgcttccagatcctaggtggatctaggtggatcctaggtggatctaggtggatcctaggtggacctaggtggatctaggtggatcctaggtggatctggaagggtctacgggcttcgtcctgggcaatttaagtcaacaactcttgcttttgctcacagggagcctagtagattttctcaagactccctcgggcatcaagttgaatgtcaacaaacttttggacatggcagcccaggtaaggagccgggcaaagggctgggtatggctacagatcagtggggtaaggactggtgacctattcctggcctgcagattgcagagggcatggcgttcatcgaagaacagaattacatacatcgggacctgcgcgccgccaacatcctggtgtctgacacgctgagctgcaagattgcagactttggcctggcgcgcctcattgaggacaatgagtacacggcccgggagggtaggtgtgggatagagaggaggttcatggccagcaggagagcaagcacacacagggggactaactttgcttctctctaggggccaaatttcccattaagtggacagcaccagaagccattaactatgggaccttcaccatcaagtcagacgtgtggtccttcgggatcttgcttacagagattgtcacccacggtcgaatcccttacccaggtgagctttccttaagacaagcaactctaagtcttcaaggaaggggagccaagccataccttcctgctcacctctacccaggctcagactctgaaactctgagttgcttctctcccatccacttgggcctgtgactccgaaatcttctgttagatgcttcattccatctctgcctctgagtccccacacttctcaaaaactccagttcttccttgcttggttatggcagaggccacctagtatgtcagaggtggacaggaggtaaaaccttcctctttctttctctctctctctctctctctttgtgtgtgtgtgtgtgtgtgtgtgtgtgtgtgtgtgtgtgtgtgtgtgtgtgtgtgtttgaggcaaggtttctctgtttggccctggctgtccaggaactcaccatgtaaaccaggctggcctcaaaactcagacatccatttgtctctgtctccaaaatgctgggattaaaagtgtgccaccactgcctgacctccagtttcttaataggagatcagaatagtgcttaggccacactaagccattactagtcattactctgggtacgttatgttgccctctgagcctcagtttccccatacatagaacaagagactttgtgaaacacttgcatgggagctgcttagtaagcactggtgctttcctactgagatgtcacagctaaagagagaaaccatgtagatccctccttctaggaaaggcccttatcacgattttattgaatgtttgttttttagccattaggtttttttttttttttttttttttttgggagacaatgtcttacatagcctaagctgacctctaacactctatgaatctgaagatgtcccctgagctcccagtattcctgcttctgcctcactgggaggtgcttgtattacagcaagcatgtgcctatgtacctggggatcaaacccaggtcctgtgcacgcaaggtaagtgcgctgcccctgagccatgcttctaagcctgggggtgggatttttctagaaggaatttgataacctctgtggaaagaaaatgccacagaaaagagtaggaggttatagagttcagaggtcagattggcagaaacttcccacaggcccagggcaacaggcattgaaatttgatcccaggaatgtaaaggcactttgaatctcacagttagaggctagaagagttcccagctctgggcttgttctatctcacagcccagtattcatctcctgtgcctaggcccaaaagctagaaatacctcaacactgccctggctgtgggcttttatcccatcctgagccctgactaccccatctttgccatcaaatacgaacaaccccaggtacaccttataaaagaacacccctagtcaggtacctcttatatacactgattccttcagtcctcgttaaaactcggtgattcactctatgccagaagaggaagccgaggaggtggcccagtcaaggtcctgcggctggcatgtatgctattgagtgtgtgtaggcactataggtgtgggcctgacattcattcagcaggaaatgctagcgtgccttaccttaatgaagactagcatcaggttggattggtagttccatattctgaaccttacctgtgttggtcagcattccattactgaaaacaaaatcaaccaaagactcccaagacactctcaggtgacccaagcttgggtgacttgctgaggaagcctgatgaaccaagttcaatccccggtattcctggaaaggtagaagaagagaacctgcattcattcattcattcattcattcatatttttgattttttggggacagggtttctctgtatagtccttggctctcttggaactcactttgtagaccaggatgtccttgaactcccagagatctgattgcctctgcctcctgagtattgagattaaaggcatggtggcctgactgagatcccatacttaaaaattgttgtctgagggggatggggagactggagagatggcttagtagctacgagcactggctgctcttccagaggacctgggttcagatctcaacacccataaagcagattacagctgtctgtaattccagttccagagaatttagtgccctcttctggcctccttgagcactgcacacatgcgatatgtgtacatggaaaacacacttatagaaataaaattttaagctgaagatggtggcacacacctttaatcccagaaacacatgaatctctgagtttgaggccagcttgatttacagagttccaggacagccaggggtacacagagaaaccctgtcttgaaaaacaaaaaaaagaaagaaagaaagagagaaagaagatagatggatggatggatggatggatggatggatggatggatagatacatagatagatagatagatagatagatagatagatagatagatagatagatagatagataaaataagtaggaaagaaagagaactggagtcagtttagcatcagccttgcttttgagtttccaaagattaaagtcttgatgttttttcctccatcaacgttccaggaatgaccaaccctgaagtcattcagaacctggagagaggctaccgcatggtgagacctgacaactgtccggaagagctgtaccacctcatgatgctgtgctggaaggagcgcccagaggaccggcccacgtttgactaccttcggagtgttctggatgacttcttcacagccacagagggccagtaccagccccagccttgataggcctttcggtcccaagatcctcccaaccactgtgccctggctagggcagatggaattcctgtgccatatctgtgtggcctgtgcacacatggactctgactctgtacatgaaacctgtgcgtgtgtcacacataatgcagtttctgtcttgtacacacatctgtagttatgtgggttctacacatgtgtcttatacctgtggagcacgtgagtctaagccttggatacctcctaagatgtctcttcctataccgttccatttcctgaagccatagagaggagaaggcctgcgattgatgcgtgtctctgtctaccactgcctttcagagggtctccaggaaggccctccttgtgggctgccatccaatcttatgtctctgtgtgttctgtcctggtgcctagcacacaccaggagctcaataaaagtctgttgaattaaggttgtacatttttctactgcatactttatttctttatggcaaatagtgtgggggggggggggtcagatgatggagactggggttgctgttggatcgcccacactagattctcctgccctgagttgccactatcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcatggggagccgttggcttactagacaaagtattatcagctaacctttaagctgattggttctgagtaaggtaaggggtggagtggggggatgggtggtgaacaggggaacttccagatcattgagataactgagaatgagtgttgtaaccaaaactttttagcttattagtagcattcctcagtgccagccacaaaaataaataaataaataaataaataaatctaccaggcagtggtgggacacacctttaattccagcacaggaggcagaggcaggtggatctctaagtttgaggccatcctggtatatagggtaagttttaggacagccgggattacatagagaaaccttgtctcatacaccaagggagaaaaaaaaaacatacagaaaaatggtttgtggagcagggtgtggtggtgcacgcctttaatcccagcacttgggaggcagaggcagacgcagacagatttctgagttcgaggccagcctggtctacaaattaagttccaggatagccagggctatacagagaaaccctgtctcgaaaaaccaaaaaaaaaaaaaagaaaaaaaagaaatggtttgtgtggtcacacaaagacagcacttgagataaggtcaactctctttgtagatttatttttatatttgtaaatgttttgcctgcaagtctgtatgtgagtaccatgtgtgtatctagtgcccttggaagcagatgttggaaatgaagttagggataattgtgtgccaccatggggtgctgggaacagtcttctgtgcgagcagcaagtgctcctaacagctgagacatcagtctaaactaccatgtctactactaaagtgtgtgtgtgtgtgaagatcatatatatgctctaaaaggttagatcacagctgctgccctgtagaacagatgagtcacagcttgtgtcctatctagaactttctctcagatgctcctagcatattgtacgatggtacaacaggatttatttcctagcttatggctttatagccaatctagcactgctactggcccaagctcagagatcccctcctatctaaagccagacatctcttacctttaaagtaagtgcaaggactgttctttgttctgttgacttctgcctgatctcttatcctaatgtcccagagctaggaaggcccagcactcctaaaggacatttcacccgaaaaacaaacaaataaagagagaaaccctgagttggggtgagagtcgggataaatgaaagtctgacctttttacaaaagtgtgtatatatgtgtgtgtgtttgtgtgtgtgcgcgtgctcagacgtgcatgtcatggtggagtcttggtgtaaaactgcatatccccagagtcagaggacaacgttagagagtcagtcctgtctttctaccttgtgggtcttgagcagcaaactcgtatcctcaaatttaagacaagaacctttaccaacgaagcctgtttcactggctcaggccagcattctttttttttttttttttttgagacagggtttctctgtgtagccctggctgtcctggaactcactttgtagaccaggctggcctcgaactcagaaatccacctgcttctgcctcccgagtgcccaggccagcattctttacccctctgatccaacttcacttcacctaaacagtaagtgtgaatgagttacctcccttttatacacggccatcagtttttttctctttctttttctttttctttttctctttctttttcttcttttctttctttctttcttttttttttttttttttttttttttttggtttttcaagacagggtttctctgtatagctttggctgtcctggaactcactttctagaccttgaactggctggccttgaactcagaaatccatctgcctctgcctcccaagtgctgggattaaaggcgtgcaccaccacacccggcttcagggcctcttgaagaacagtcagtgctcctaaccgctgaaccatctccccagccccagtggtagagatttttgtgctaaggttggagaaccttaaccttggataaagccttatgtatgcttagccaacgctccaccagttttgacattagggacacctccagtccaagaaggcttcgtttgtttgctcttgctttgtggcctggctcccctgaactcctgacttgcctatatttgggtcctgagcgccaggattacagacatgcccaacagggttcagtattttcacctgcattttaaaaataagtgaattcacttagctaatttctaaaactgggaagattttatatgtaaaactctagatctgggctgtctcttcaacaatgagaggtttggtttcctgggtttgtctgtcctagtggagcaagtactggccatccagtttagttgggacatgagttttccatccctgccagggtcccttccacccactactatcctaagccaagtgttaatagctatttatcaccaaaattggtgctgctgttctcgggataaagaggaaagtaaagaaagaaatttttaaaaaaatcaaaaattaggggctggtgagatggctcagtggttaagagcaccgactgttcttccgaaggtcctgagttcaaatcccagcaaccacatggtggctcacaaccatctgtaacaagatctgacgccctcttctggagtgtctgaagacagctacagtgtattcacatataataaaataaataaatcttaaaaaaaaaaatcaaaaattaaaaaaaagtctgagtttaaaaagttaaactcagagatggcagtatgtttgatcaaaaaagcaagaggtcatatattcctttaaggaagttaaaagctccaagctttaaaatgagcaaacaaacaatatctgagtcataagaatataaactcattcatttataccatgtgcttggcctatgcgggcatgtgaggttgtaacccttgctctacatcttataatccttcaatacccatgattctgtcccgtagtgggtactgtggacagccatggagcggggaaactttggagtcctcttctgtctacactgcaaagatgggaaaggaggcctagaaatgatgaggagacccacctaaagccagaagagtagcaggggtgtagaaatggaagtctgtgtcctggccctctgtcatcacacagcctccctgtctctaaaggccctgtgcaattcccaagggagtgacgctgagcatacaagggctgggggttgtggtgcaagcctcaatcccagcttttcagaacagggcttcattgtgtagctctggctgtcttggaactcactatgtagactagggtggcttccattcacagagatctacagtccagtgctggtattaaactcgtgtgctactatgtccaactgttgtaggaaacaaacaaacaaacaaaaaaaccccaaaaaccaaaaaactcagcacagagccttttggtggatcaataatggctacttgaagattgacggattcaggttttgtaggagcatgggagatggtggttttctgccatttagacactcccagacatttgtcaacctgtaaggacaattttgggtgtcacagtaagggcgtgtgtggggtgttgctactggtatagaagaaggccaagcagtcaattaacatctaaaaggcccgaagacagcccctacaacaaagagtgtaagtaattcaaggttaagaaattttgctggcatggtggggggagtggttgaaggtcttttttttttttgttgttgttgttgttggtttctccccccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgagttcgagcccagcctggtctacaaagtgagttccaggtacagccagggctatacagagaaaccctatcttgaaaaacaaaaaacaaacaaaaaagcaaaaacaaacgagagaaacaaccccgctccccccccaccccccgttccccccaaacaacaacttaggctttcagtttagaaaaattaagttctgggtaggtgagatggttgctgccaccatgcctgacccaaattttctggatggatcgccccgcccccacccagagccattacatagaaacactcccttcaacactccctccagtaaattaaaaactaaacaccaagttctgttactttgtcacagtgctccggcatattggattttgtcttttaaaaaaaaaaaaatatgtacaattggagacggaatttaatttgtaacactgaataagctttacctgtaaaattgttttgttattttttgagacatgctttcactatggagagcaagttggcctcagattacagagatcttcctgactctgcctcctgagtgctgggatcaaagacatagcaaccacgcccaactgaaaacgagctttgacattaaaaaagaaaagtccgtcagaacttatgagcacataaaggtcttgccccactacagtaggcctctggatattttctttctgttccttgccattcatttctctctccagttctagtccagaccaaacctagtcttttagctgcgtgaccttgcgcaagcatctttccccgggaagcctcggcgtattctcggtaaaacgagaaagttggcctctgatctttgcacacgctcccaactgtgaagcgggctgcagagtttacggagccgactccctctcccgggactcgatggtacggcccccggtctcccccacccctccgcgccggactttggtacaggcccagggggcccgcggtggcttctctaagctgcccttgccccccgccgagttccgggcccgaccccgcgcatgccgattggttagagtgagacccgggctgtgcggctataggtgatcccgggggtgggcggggcttcgaggccggcccctcccccgggtcggacgccgtaaggagccgcgggcgggcgggcggacagactgacgggagggccgggcggcgagcaagatggcgcagactcagggcaccaagaggaaagtctgttactactacgacggtgagctgcgggtgggcggcgcgggccgggcgttggggaaaggctgggggaggaggctgggaggaggctgaagccccggggagcctgagggaaagtcgaggctgaaggaggaggttggagagaggaagtcgaggctgaggccggagatgaggtgggggtcgtggaaggggtagtctgcggtaatcccggtggcggagattctcggggaatccgacctgaagttggagtgggattcctggagggaagcctaagcctggcggcggggatcggaatatgatggagacggtttgcctggatatcttcccctgctgagaatacaaaggtttttcactgtccccattctctctctctctttttctttctttcttttggtgagttctgcaggactggccactcatcccctcccccactccatcccccaagtctatgagtagggcctgcagttgctagttgggaaatggggctccccggggatgcaaggagagaggtgcatgaaacttgttaagacgacttttcattgagccagcgcgagcatcttactctgtcctgggttgtgtttctgttggggctggagggctcatcgaggcacatttcctgtgttgagttcccgtctgaagggggagctagacaatgtcacaggtatctttcggagttagcgctgggacaagggaatgtggggtggaggagaacacagcaggagcctcagcccaacctgagaggagcaggttgtgtgtcagtgcttaggacccaagaactggagttacaagccaggccctggcaagtggagccaacagcagggggaggggacagcacctttatctgagaaagggtctcacagtgtaactcacgctggtcttggattaagccccttcttcttactcttgactccaggcttacaccacttggtccagcatttgtgttttgggaatagcagttgagttgttcaggggacatctagccagccagccagtaggcggttggctgtttagatctgaaatttagaagacagatattttttggtaattgtcggtataaaataattcagatagtaattttagctggattagaaaagggtgttataactccagttgtagagggtgaaaagctatgttgatactttttttttttttttgaaatggcctctgtgtaaccctggctagcctggaactcactttgtagaccaggtttgcttcctactggaagagatttatcctacgcccctcccgagtgctaggattaaaggcatgtgccacaaccctggcctgttttaattctgaagaagtggactaagaaggttcagtggtcctgattgctctttcactatgctgtctttcaactgttagccacattcctgtttcagtctttcccagtgctgtggggtgacggagccaccaagcctggtgtcttcttgtttctgttctgttttgtttttaaggcagggtctgtctctaacagtcctagctgtcctggaagttgctttgtagaccaactaggctggcctctgaactcagagagatccccctgcctctgccttctgagtgctggtattaaaggggtgcaccactgtctagcagcctcattttttgtttcggttctttttgtttgtttggtttggtttggtttggttttggttttttgagacagtttctctgcgtagccctggctgtcctggaacttactctctagaccaggctggcctcaaacttagaaatccgtctgcctctggccaccaagtgctgggaattttttttcttcttgttttttgtagataatacatttcttggagaaaagtctccttatctccacttcctaaaagattgggtagtataataggcataatttttttaaagaattatttattttacgtatgtgagcacactgtagatgtctttagacacaccagatctcattacagatggttgtgagccaccatgtggttgctgggaaacgaacccaggacctctggaagatcagtatgtgctcccaactgctgagccatctctccagccccataattttttttgagattataatagaattacataatttcccctccttttctctctttttttcttcaagacaggatttctctgtatagccctggctgtcctgaaactggtgctgtagaccactagattgttcttggactcacagagatcctcctttctcttgcctctcaggtgctgggattaaaggccggccctaatacttccttgcagaggttttccttgctttgttaactggagaaagcagggccctgagagatggctcagtagttggtagtgtgtacagcccttgcagaggacaaagctcagttcctagcatccaccttgggaggctcacagatgcctgtgactccagctacagggacccagcgccctcttctggcttccacaccgccctgcactcacgggtacatccataccacacaccagtttagagcatttcctactgagatgctgcgctcaattcccagggccccccacagccacttgtaactccagttggaaggaatccggtgatctcttcgcgcttcaagtgctagatgggaatgtggtgcttggacatacatgcaggcaaaacttcacacacacaaaagactgtcctagaactggtctattagacgaggcagctgtgaactcaaggagatctgccacctagttttcctgctgggactaaagcctgcactaatggggaagtgctgggagggattggggcggaagctagattggagagaagaggatactttagcttgcaattttttgattgattggttttttgagacagggtttctctgtgtagccctggctgtcctggaactcactctgtagaccaggctggcctccagctcagaaattcacctgcttctgcctcccaagtgctggggctaaaggtgtgggccaccactgcccagctagtttgcaattttatttttgagacagggtctctctctgtgtattctgcttggcctggaactaaatgagacccatccgcctctgcctccagagcgcttacactaaaggtgtgtaccactacacccttctaagagaggaagtattgtttttttgtttttttgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcagtctcttttccggttgggactcacttcactcttactgtcaggtttgctgtagtaggcaagccactttaccttttgtaagtcacttttccctcccctcgcctcccttcctctctctctttctcgctctctcgcttcttctctccctcccccctcctttccttccttttctttctttcctctgtgacagggtttctctgtgtagtcctggaatttgtcctgtagaccaggctggtctctaacccacagaggtcctcctatctctgcgtcgcaagcactggcatcaagagctgtgtgccaccattgcctggctttccagaaaacagagagaacggtttctactgagagcagcagtgagaaagaaca

SEQ ID NO: 1482 - DNA, 2100 bp, Mus musculus
gaattccggattcaagctcctgactgcggccaatgggggcctctgagctgacgatctcgggtacgtttttgtaacttccagaacagggctctaggatgtctgatgttggggcgagtggcttaggggcagctccttcaggcctctctacattccttcagggatcatgggctgtgtctgcagctcaaaccctgaagatgactggatggagaacattgacgtgtgtgaaaactgccactatcccatagtcccactggacagcaagatctcgctgcccatccggaatggctctgaagtgcgggacccactggtcacctatgagggatctctcccaccagcatccccgctgcaagacaacctggttatcgccctgcacagttatgagccctcccatgatggagacttgggctttgagaagggtgaacagctccgaatcctggagcagagcggtgagtggtggaaggctcagtccctgacgactggccaagaaggcttcattcccttcaacttcgtggcgaaagcaaacagcctggagcctgaaccttggttcttcaagaatctgagccgtaaggacgccgagcggcagcttttggcgcccgggaacacgcatggatccttcctgatccgggaaagcgaaagcactgcggggtccttttccctgtcggtcagagacttcgaccagaaccagggagaagtggtgaaacattacaagatccgtaacctagacaacggtggcttctacatctcccctcgtatcacttttcccggattgcacgatctagtccgccattacaccaacgcctctgatgggctgtgcacaaagttgagccgtccttgccagacccagaagccccagaaaccatggtgggaggacgaatgggaagttcccagggaaacactgaagttggtggagcggctgggagctggccagttcggggaagtgtggatggggtactacaacggacacacgaaggtggcggtgaagagtctgaaacaagggagcatgtcccccgacgccttcctggctgaggctaacctcatgaagcagctgcagcacccgcggctagtccggctttatgcagtggtcacccaggaacccatctacatcatcacggaatacatggagaacgggagcctagtagattttctcaagactccctcgggcatcaagttgaatgtcaacaaacttttggacatggcagcccagattgcagagggcatggcgttcatcgaagaacagaattacatccatcgggacctgcgcgccgccaacatcctggtgtctgacacgctgagctgcaagattgcagactttggcctggcgcgcctcattgaggacaatgagtacacggcccgggagggggccaaatttcccattaagtggacagcaccagaagccattaactatgggaccttcaccatcaagtcagacgtgtggtccttcgggatcttgcttacagagattgtcacccacggtcgaatcccttacccaggaatgaccaaccctgaagtcattcagaacctggagagaggctaccgcatggtgagacctgacaactgtccggaagagctgtaccacctcatgatgctgtgctggaaggagcgcccagaggaccggcccacgtttgactaccttcggagtgttctggatgacttcttcacagccacagagggccagtaccagccccagccttgataggcctttcggtcccaagatcctcccaaccactgtccctggctagggcagatggaattcctgtgccatatctgtgtggcctgtgcacacatggactctgactctgtacatgaaacctgtgcgtgtgtcacacataatgcagtttctgtctgtacacacatctgtagttatgtgggttctacacatgtgtcttatacctgtggagcacgtgagtctaagccttggatacctcctaagatgtctcttcctataccgttccatttcctgaagccatagagaggagacggtctgcgattgatgcgtgtctctgtctaccactgcctttcagagggtctccaggaaggccctccttgtgggctgccatccaatctcatgtctctgtgtgttctgtcctgtgcccggaattc

SEQ ID NO: 1483 - DNA, 1530 bp, Mus musculus
atgggctgtgtctgcagctcaaaccctgaagatgactggatggagaacattgacgtgtgtgaaaactgccactatcccatagtcccactggacagcaagatctcgctgcccatccggaatggctctgaagtgcgggacccactggtcacctatgagggatctctcccaccagcatccccgctgcaagacaacctggttatcgccctgcacagttatgagccctcccatgatggagacttgggctttgagaagggtgaacagctccgaatcctggagcagagcggtgagtggtggaaggctcagtccctgacgactggccaagaaggcttcattcccttcaacttcgtggcgaaagcaaacagcctggagcctgaaccttggttcttcaagaatctgagccgtaaggacgccgagcggcagcttttggcgcccgggaacacgcatggatccttcctgatccgggaaagcgaaagcactgcggggtccttttccctgtcggtcagagacttcgaccagaaccagggagaagtggtgaaacattacaagatccgtaacctagacaacggtggcttctacatctcccctcgtatcacttttcccggattgcacgatctagtccgccattacaccaacgcctctgatgggctgtgcacaaagttgagccgtccttgccagacccagaagccccagaaaccatggtgggaggacgaatgggaagttcccagggaaacactgaagttggtggagcggctgggagctggccagttcggggaagtgtggatggggtactacaacggacacacgaaggtggcggtgaagagtctgaaacaagggagcatgtcccccgacgccttcctggctgaggctaacctcatgaagcagctgcagcacccgcggctagtccggctttatgcagtggtcacccaggaacccatctacatcatcacggaatacatggagaacgggagcctagtagattttctcaagactccctcgggcatcaagttgaatgtcaacaaacttttggacatggcagcccagattgcagagggcatggcgttcatcgaagaacagaattacatccatcgggacctgcgcgccgccaacatcctggtgtctgacacgctgagctgcaagattgcagactttggcctggcgcgcctcattgaggacaatgagtacacggcccgggagggggccaaatttcccattaagtggacagcaccagaagccattaactatgggaccttcaccatcaagtcagacgtgtggtccttcgggatcttgcttacagagattgtcacccacggtcgaatcccttacccaggaatgaccaaccctgaagtcattcagaacctggagagaggctaccgcatggtgagacctgacaactgtccggaagagctgtaccacctcatgatgctgtgctggaaggagcgcccagaggaccggcccacgtttgactaccttcggagtgttctggatgacttcttcacagccacagagggccagtaccagccccagccttga

SEQ ID NO: 1484 - DNA, 31842 bp, Homo sapiens
  misc_feature (1)..(2500): "n" at positions 1 thru 2500  can be any base
  misc_feature (28552)..(30747): "n" at positions 28552 thru 30747  can be any base
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccttcttcttctttcccatctctcccttcctcctatacattccctcttcttaacctcaaacttctacaatctttctcttgcctttttctaaaggctccaagaatgtcaagcctggcagggaccttactggtctaagtccacattccatctgatgttggtattctctttacaacacaaccaacttgtggtttcctaaggctcatacgactatcacaaacaacaggatgctcactacctcacaaaacagctcagcttatctgagaccagttccaggttgctgttagtcctttactgggggctcttgttgctaattactctcaggctataatagtcaaaaagtcatttgcagtcacagatgggtgcactctggtctagcaggatttcccaaatgtccacctccccccaggactcctaacagtaggggaaagagtgaatacgtacccttttcctggaaagtttcttgatttgatttaaaattccatgcacattttgcattttcctccataataggtcatgtttgtttaacttacatgaataaggtcaggaaacactcatgctctggaaaaatgcacaccatgacatgacttccggtacccatgggaggctgagtatctcagtttaagaaacaggagtcgagctgggcacggtggctcacgtctgtagtcccagcactttgggaggtcgaggagggcagatcacctgaagtcaggagttcaagaccagccagaccaacatggtgaaaccctgtctctactaaaaatacaaaattaggccgggcatggtggctcatgcctgtaatcccagcactttgagaggccgaggcgggcagatcacctgaggtcgagagattgagaccagcctgaccaacatggagaaatccagtctcttaaaaaatacagaattagccgggtgtggtggcacacgcctgtaatcccagttacttgggaggctgaggcaggagaatcacttgaacctgggaggtggatattgcagtgagccgagatcacaccattgcactccagcctgggcaacaagagcgaaactctgtctcaaaaaataataataataaggccgggcacagtggctcacgcctgtaatcccagcactttgggaggccgaggcaggaggatcacaaggtgaggagattgagaccatcctggcaaacacgatgaaaccccatctctactaaaaatataaaaaatcagccaggtgtggcggcacgcgcctgtagtcccagctactagggaggctgaggcaggagaatcgcttgaacccaggaggcggaggttgcagtgagctgagatcgcgccactgcactccagcctgggagacagagtgagactctgtctcaaaaaaaataaaaaagaaaaaagtaatgagagaaatgcaaatgcagaaagagaaatgcaaatgcctggcagtatgttgggcttcttttcaaaacttaaaaaaatttattattattattcatttatttatttactttagacaaggggtcttgttctgtcacccaggctggagtgcagtggtgcaatcgtagctcactgtggccttgaactcctgggctcaagtgatcctcctgcctcagcctcccaagcacctgggattataggcatgcaccaccatgcccagctagtttttataataataataataataagaggcttgcttgaggtgatggatagctcatttatcccttttgtgattattacacattgtatgcctctatcaaaatatatcatgtaccccataaacatatatacttaccagatacccataaaagtaaataaataaataagtaaataaataaatatacaaaattagccgggcgtggtggcacatgcctgtaatcccagctacttgggagactgaggtaggagaatcgcttgaacctgggaggcagaggttgcggtgggccgagatcgtgccattgcactccagcttgggcaacaagagcaaaactccgtctcaaaaaaaaaaaaaaaagaaaagaaaagaaacaggagtctagggctgggcacagtggctcattgcctgtaatcccagcactttgggaggctgaggtcaggagttcgagaccagcctggccaacgtggcaaaactctgtctctactaaaaatacaaaacacaaaatacaaaaattagccaggcgtggtggtgcacgcctgtagtcccacctgcttagggaggctgagggaggagagacagagcttgcagtgagcccagatcacaccactgcactccagcctgggcaacagagcaagtctaaaaaaaaaaaaaaaaggaaagagagaaaagaaacaggagtctaggctgggcatggtggttcacgcctgtaatcccagcactttgggaggctgaggtgggtggatcacttgaggtcaggagttcaagaccaccctggccaacatggtgaaacccccatctctactaaaattacaaaaattagctgggcgtggtgacacatgcctgtagtcctagctagtcagggggctgaggcaggagaatcacttgaacctgggaggtggaggttccagtgagccaagttcacaccactgaactccagcctaggtgacagagtgagattctgtctgtttttttttcttttgagatggtatcttgctctgtcacctaggctagagtgcaatggcgtggtctcagctcactgcaacctccacctccatggttcaagcaattctcctgcctcagcctcccaagaagctgggattacaggcgcgcaccaccacgcccagctaatttttgtatttttagtagagacagggtttcaccatgttggccaggcttgtctcgaactcctgaccatgtgatttgccctcctcagcctcccaaagtgctgggattacaggcatgagccaccgcgcccagccgagactctattaaaaaaagaaaaaagaaagaaacaggagtctaaagcaaaggagattaattacccagtcccattcttccaccttccaaagcaggagttggtaggacagaattgtgcactggtgaaagtgtttctaagcactaaactaagctaacattcatgtgagcttatgagaaatggatgaagagccccatttgacagaagaggaaaagtgaggcttaggaggaatgatttcagcaaagtcacacagtaagtgtcaaaattgctatttgaacttaggtctctaactatggggacagtcttctgagttttgctaatgagaaacttccactgctccctgcttccacttagacccagcatgaattctctctctctgtctctcttttgttttttctttttagacagagtctctgtcacccaagttggagtgaacagtgcggtggcagtggcaggatctaggctcactgcaacctccacctcttgagttcaagcaattctccagccaccatgcccagctaactttttttttttttttttttttgtatttttagtagagacagggtttcaccattgttggccaggctggttgtcttgaacttctgaccccaggtgatccacccaccttggcctcccaaagtgctgggattacaagcatgagccaccgtgcccagcctgctcttttgagatggagtctcgctctgtcatccaggctggagtgcagtggcttgatctcggctcactgcaacctctgcctcccgggttcaagtgattctcctgcctcagcctcctgagtagctgggattacaggcgtgtgccaccatgcctggctaatttttgtatttttagtagacacggggtttcaccatgttggtcaggctggtcttgaacacctgacctcgtgatccacccgcctcagcctcccaaagtgctgggattacaggaatgagccatcgtgcccggacttttttttttttttttttttttttttgagacggacggaatctcactctgttgccaggctggagtgcaatggcgcaattccggctcactgcaacctctacctcctgggtttaagcgattctcctgcctcagcctcctgagtagctgagattacaggcacctgccaccaagcccgattaatttttggatttttagtagaggcagggttgcaccatgttggccaggatggtctcgatcccttaatcttgtgacccacccgccttggcctcccaaagtgctgggattacaggtgtgagccaccgcgcctggcctttttttttttttttttgagacaggctctcgctctgttatccaggctggagtgcagtggcacaatcgtagctcattgcagccttgagctcctgggctcaagtgatctttttgcctcagcctcccaagtagctggaactacaggcatgccccatcacacctggctaattttttgattttttttctagagatgaggtctcactatgttgcccaggctagtctggaacttctgagtttgaatggtcttactgcctcagtctcccaaagtgccgcgattacagatgtgagccaccacgcccggccagcaactccagctttgctctactccaaataggttgtgtgactttaagcatacctctgtgggcctcagtttgctcatctaaaatcagaggtttagccaggtatggcagctcatgcctgtaatcccagcactttgggaggccaagaaggaaggatcacttgaagccaagaatttgagaccagtccgggcaacatagcaatacccccatctctagaacaaataaaaaatcacctgggctcagtggtgccagctacccaggaggctgaagttagaggatcacttgagcccaggagtttgaggttccagtgagttaggattgggtcattgcactgcagtctgggcaagagagtgacactttatctcaaaaataaatcaacaaataataaaattggagattaggcttgctggtttctaagacctttgcagatgggagactctatgcattaacactgcatgttccagttgacatttattaactaattttgggtgctggtggctttcagacaaataaactacagcttctgctcttgatgaacccccactctcatcaaaggtatgggagaggcagtgggaccctggggctgacatgtaaatcagtaatcatggaactctgtgtctaagttgattattgaggtctgaatagaatgttgcaggagactggggtgagagggaagcaaagagcattgggaagtcttcagactaggtgatatttaggccaggtgcctgtaatccgagcactttgggaggctgaggcaggagaattgcttgaggccaggagttcgagaccagcctggccaacatggtgaaaccctgtctctactaaaaatacaaaagttagccaagcgtgatggtgcatgcctgtaatcccaactactcaggaggccgaggcaggagaattgcttgaacctgggaggtagaggttgcaggaaaaaaaaaaaggtaatatttcagctgagccttgaaggttgagttagaattcagcagttggacaaaagagagcatgccgactgggttcggtggtgcatgcctataatcctagcatttggggaggccaaggcaggaggattgcttgagcccaggagttcgagatcagactgggcaacatagtgagacctcatctctacaaaaaaataatcagctgggcatgatggtgtgcacctttagtctcagctactggggaggttgaggtgggaagattgcttgagcccaggaggtctaaggggattgcgccactgcacttcagcctgggagaggaagggagaccctgtctcaagagagagagagaaagagagagagagagagaaagagagagagagagagaaagagagagagagagagaaagagagagagagagagagagagagagcgagagagcgcacgcatttcaaagcagggagaaccacaagtacaaaggcattaagtaagaaaatagcatggggtgtttgggaaaggcaagaatagttcagaacacaggctgtgtgtgtgggggtgtgtgggggtgcctgtgtgtgggtgtttgtgtgtgtgtgagtgtgggtgtgtgggggtatctatggaggggatgcctgtgtgtgtgtgtaaggtgagtgtgtggatgtgtgcatgggtgtgggtgagtgtgtggaggtgcctgtgtgtgtgtatgaatgtgtgttggggaggggagaatgtgtgtgtgtggggtgagtgcgtgtgtgtgggggtgaatgcgtgtgtgtgtgtatgtgggtgtgactgtgtgggtgtgtggacgagtgtgtgtgttcctgggtgtgggagcctgtgtgtgtagggggagtatgtatagggtgtgtgcatgaatgtgtgtgtgggtacgtgtgtgagagtgggtgcctgtgtgtggggggtgagtgtgtgtggtgggggggcacttgtggagggtgagtgtatgtgtttactgagtgtgagtgtgggtgcctgtgtgtgggagggtgagtctgtgtgtgagtgtgtgggggagtacctgtgaggggtgagtgtgtgtgtttatgtgaaagtgtgtgtgtgtggatgcctctgtggaggtgggatagggggtgcctctgtgtgtgtgtgtgagagtgtgtgtgtgtagggtgtgtatatgtatagggtgtgtgtgagtgtgtgtgtgtgagagagtgtgtgtgtggcagaatagactgcggaggtggatttcatcttgatatgaaaggtctggaatgcatggtacattaaactttgaggacagcgctttccaagcactctgaggagcagccctagagaaggaggagctgcagggactccgggggcttcaaagtgagggccccactctgcttcaggcaaaacaggcacacatttatcactttatctatggagttctgcttgatttcatcagacaaaaaatttccactgctaaaacaggcaaataaacaaaaaaaaagttatggccaacagagtcactggagggttttctgctggggagaagcaagcccgtgtttgaaggaaccctgtgagatgactgtgggctgtgtgaggggaacagcgggggcttgatggtggacttcgggagcagaagcctctttctcagcctcctcagctagacaggggaattataataggaggtgtggcgtgcacacctctccagtaggggagggtctgataagtcaggtctctcccaggcttgggaaagtgtgtgtcatctctaggaggtggtcctcccaacacagggtactggcagagggagagggagggggcagaggcaggaagtgggtaactagactaacaaaggtgcctgtggcggtttgcccatcccaggtgggagggtggggctagggctcaggggccgtgtgtgaatttacttgtagcctgagggctcagagggagcaccggtttggagctgggaccccctattttagcttttctgtggctggtgaatggggatcccaggatctcacaatctcaggtacttttggaactttccagggcaaggccccattatatctgatgttgggggagcagatcttgggggagccccttcagccccctcttccattccctcagggaccatgggctgtggctgcagctcacacccggaagatgactggatggaaaacatcgatgtgtgtgagaactgccattatcccatagtcccactggatggcaagggcacggtaagaggcgagacaggggccttggtgagggagttgggtagagaatgcaacccaggagaaagaaatgaccagcactacaggcccttgaaagaatagagtggccctctcccctgaaatacagaaaggaaaagaggcccagagaggggaagggaatctcctaagatcacacagaaagtagttggtaaactcagggataacatctaaccaggctggagaggctgagagcagagcaggggggaagggggccagggtctgacccaatcttctgctttctgaccccaccctcatcccccactccacagctgctcatccgaaatggctctgaggtgcgggacccactggttacctacgaaggctccaatccgccggcttccccactgcaaggtgaccccaggcagcagggcctgaaagacaaggcctgcggatccctggctgttggcttccacctctcccccacctactttctccccggtcttgccttccttgtcccccaccctgtaactccaggcttcctgccgatcccagctcggttctccctgatgccccttgtctttacagacaacctggttatcgctctgcacagctatgagccctctcacgacggagatctgggctttgagaagggggaacagctccgcatcctggagcagtgagtccctctccaccttgctctggcggagtccgtgagggagcggcgatctccgcgacccgcagccctcctgcggcccttgaccagctcggggtggccgcccttgggacaaaattcgaggctcagtattgctgagccagggttgggggaggctggcttaaggggtggaggggtctttgagggagggtctcaggtcgacggctgagcgagccacactgacccacctccgtggcgcaggagcggcgagtggtggaaggcgcagtccctgaccacgggccaggaaggcttcatccccttcaattttgtggccaaagcgaacagcctggagcccgaaccgtaagtggggacccgtcgtgggggtgggtaggagcagatctagggatcctggagcagggagtaggcctggggtggcggtgaaggcttgagggccacggaggaagatccgacgacagccgacggccttcgttcgcttccgccctgcacagctggttcttcaagaacctgagccgcaaggacgcggagcggcagctcctggcgcccgggaacactcacggctccttcctcatccgggagagcgagagcaccgcgggtgagcgggcggcggtctcgaccgggcgcgggggtgccccggggtgtgcccgagggggggcgcagggtgagcccgaggtggagacacggggtgagtcggagggggacgcgggatgagcccgaggtgggggcgcgggatgacccggagttgggggtgctgggtgagcccaaggtgggggcgcggtggcgggccagactcactgcgttctttcgtcgctttgtccatccattcattcattcaggatcgttttcactgtcggtccgggacttcgaccagaaccagggagaggtggtgaaacattacaagatccgtaatctggacaacggtggcttctacatctcccctcgaatcacttttcccggcctgcatgaactggtccgccattacaccagtgagcccgacgggacccctcccccgtgccctatcagcctatctcccctcagtccccctcaggtgtcccccatccatctttcaatgccctactccattccccgcagtgggtgaggtgtggaacctgaccctacggccccaagtgtttgggtgacagccccacacccccttgctagtccacttcacctagatgggggcttggagaagtgggggaggtggtgtcaatacgaggcctgccctattgacagccttcacccctccctcgtcctcgcagatgcttcagatgggctgtgcacacggttgagccgcccctgccagacccagaagccccagaagccgtggtgggaggacgagtgggaggttcccagggagacgctgaagctggtggagcggctgggggctggacagttcggggaggtgtggatgggtgagtgtggcctccaggactgcctgggaagaggggaacgggaggggccgctgaggtgatgagagtcccaggacagctgcctggcgactttcccactccttcccttccccgacccagggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatggtgggtgctacccgagtcggctaccaggggatactgctctccctgctgtccctgccagagggtggaaatacaccttttcttctggcccaaagctcaagcaaggagggtttcttgagctttcctgccccctggagactcacctccagccgggcgcggtggctcaggcctgtaatcccagcactttgggagccgaggcgggcagatcacgaggtcaggagttcgagaccagcctgaccaatatggtgaaactctgtctctactaaaaatacaaaaagtagccaggtgtggtggcacatgcctgtaatcccagctactcagaagactgaggcaggagaatccctttaatccgggaggtggaggctacagttgcagtgagctgagatcatgccactgaactccagcctgggtgacagagcaagactctatcaaaaaaaaaaaaaaaaaaaaaaagactcacctccaggcatgagaaaaaggtgtatcctctgatctgatcctgtctgggggcaagcctaaggtggcaagaatgttctggaagagcattcaccccaaccttccctgacctgccattctgtttgccttcttcaaagccctaccttgatctcaggatgcttgatctcagaaagcaagtgggtccctagccctgtttctctcccttctgcccctgagccctaggagggcagatctgcccccaaagccctctttttcagttctgagtgagacccccacccctgcacccctcttggtctgttactggacagagtgagagccccaggaagaggaatatgagtttctagcttcagctttgttcacaccgatttgccgtgtgacaggccaagtgcctgcactgtctctggtgctcagtttccccaagtataacagcagaaatctaaatgggctcaccagaaataatacagagtattcatcaaggcctctagagtctgactgcctgggtcagaagcctggcttcatgattttatggctttgtgataattatatcacctctttctgccatggtttcctactataataacgcgttagtaacttcctcacagggtcttgtgaggatgaaataattaatgcatacagagcagttagaactatgcctacttccaggtgctgtggctcaagcctataactccagcactttgggaggccaaggtgggtggatcacttgagcccagaagttcaagaccagtctgtgcaacatagcgagacttcattcctacaaaaaaatgtttaaaaattagctgggcatagtggtgtatgcctgtagtcccagctacttgggaggctgaggtgggaggatcacttgagcccaggaggttgaggctgcactgagctgtgattgcaccactgcactccaacctgggtaacagagcgagaccttgtctcaaaacaaaaaacccacaaaactatggctaccatatagtaactgatcaataagtttgttgctgttatctggctctgattctttgggaatgtaagatctatccttttttcaggaagagaaacaagctgttcattggctaatgggaaatggcaaatagattatgtcatgtgtatcttttttttttttgagtctcactctgtcctccaggctggagtgcagtggcatgatctcggctcacttcagcctccccctcctgggttcaaatgattctcatgcctcagtctcccaagtagctgggactacaagcatgtgccaccatgcctggctaatttttgtatttttagtagagacaggttttcgccttgttggctaggctggtctcgatctcctgtcctcaggtgatcctcccgccttggcctcccaaagtgctgggattacagatgtgagccaccatgcccagcctatcatgtgtatcgactttgattggtagttgcttgtagtgctggagaaggattctgaggttcattggaagtgagtgccaggaatgattagtaacatctgccatggatacaatggaagaatggcagtatatctatgtctatgtatttgctgtgtgtaggtgaggtctttgtctttggtaactagttcagcactcaaagtggggacactcaggttgctgtcatccttttacagggttttaatctcttgggaagggccattggtcactcactgcatcctagcaactcccatccatgtccagctgccctccactattagagaggtggtccctcagacccccagaccccctctttcttattccatccaatatattcagcacatagttattgtttcttactctcggctgggcaccaggaacatggatggatgaaacaaggttcctgttgtcagggaaacctgattttagttacagctactggggaaaccagagtttgtgccatgggaaagttccagcatgcccatgggagtgtagatgatgatccagtttattatgcctggtaggatctagagaggcttcctagtggggcagtctagcagggccacgaaagaaaagtagaattttttttagcaggcagagatgaaacaaagaggctttggggtgagagcctagtggtctgagtgcaggatctcaaaattgctaaactgtttgaagtcaaaggcagagtgggggaaagagaagaagctaccagtgtggaccatgccaagcttaggatactagttgaggattctaggttctaccttattggtgatgaaaaacctacagatccctcccagcatgctctaccctagcccctctgcaaaaaaacctttacatatcctgggcatccttaccctgaacacacactcctccattctcactcttcaatcttccttttcacatgtcagacacacttctagactcccagttggaggagaaaggtctgggggcctccccctggggcaacttgggccagcaactcttgcttctgcccacagggagtctagtggattttctcaagaccccttcaggcatcaagttgaccatcaacaaactcctggacatggcagcccaagtaaggagactggggaggggggctgggcaagggaacagaccagtgacgtgaagacatctggctcaggaccgctgatctgtgtttggcctgcagattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggtacgtgtgagatttaagggtggtctgggccctgcagggtctggccaagcagacccaggtgacctcactctgcctcctccttaggggccaagtttcccattaagtggacagcgccagaagccattaactacgggacattcaccatcaagtcagatgtgtggtcttttgggatcctgctgacggaaattgtcacccacggccgcatcccttacccaggttagagccaagggcaggaactgaaagggtgatgggaagggcaagtccatgtcttcccattcaattctttccagtctcagaatctgaaactttgtagctgcatctcctctatcttctcaggggtatgagtccaacgtccccaggcagatgccacatctcccagggctggcttccatctccgtatctctctttaataaccccagctcttttctttttctctttttttctttttcttttttttttttttttttttttttttttttgagacggagtcttgctctgtctcccaggctggggtgcagtggcgccatcttggatcactgcaacctctgcctcctgggttcaagtgattctcctgcctcagcctcccaaatagctaggattacaggtacgtgccaccatgcgcagctaattttttgtatttttagtagagacagggtttcaccatgttagccaggatggcctcaatctcctgacctcgtgattggcctgcctcggcctcccagtgttgggattacaggcgtgagccaccacacccggccccagctcttttctttagttctggcccaggcagcctggtatggtagaagaagatctagctcaggaacaagaggcctaccttttatcagcagatctgccactgttgctaactttctgtttggctttgttcagatcattactgtaactagtgaagctagtcacttcacttctctaagcctcagtttcctgatactaaaaataagagactaggccaggtacagtggcttatgcctataatctcagaactttgggagaccaaggtgggaggactgcttgagcccaggagttcgagaccagcctgggaaactggtcgaaaccccatctctacaaaaacaaaagttagccaggtttggtggcatgtgcctctagtcccagctactcagaaggctgaggtgggaggatcacctgagccagggaggcagaggttgcagtgagccaagaccatgccataacactccagcctagggcaatagaccaagaccctgtctcaaaacaagaaaaagagagactccatctctacaaaaaaaaaaaaacaaacaaacaaaaaaaacatttaaaaattagctgggcatggtggcacacacccgtagtttcagctatttgggaggctgaggtgggaggatcatttgagcccaggaggttgagggtgcagtgagccatgattgttctattgcactccagcctgagcaacagagagagaatttgtctcaaaaaaaaaaaaaaagaaaaagaaaaagaaaaaagaaaaaatgagagaccatttgtgaaagagcctgactcatagtaggttgtcagtatacactgactcctcccaccatctcctggacaaagccctttacccctgaattcagccaagacagggatggaatttttgaaaggaacttgctaagaaactctggggaaaggaaatggagcataaagacaggagtaggggggtcatgcggcacagtggctagatttgtagaagcttcccatatccccagagcaaggtgaacagacctttgctccaaggaaggtaaagacaccttggaaggccggatgcagtggctcacacctgtaataccagcactttgggaggccgaggcgggtggatcacaaggtcaggtgttcgagaccagcctgaccaacatggtgaaaccccgtctctactaaaaaaaatatatataaaaattatctgggcatggtggcacgcgcctgtaaccctagatactcaggaggctgaggcaggagaattgcttgaacccaggaggcagaggttgcagtgagctgagatcatgccaccgcactccagcctgggtgacaaagtgagactctgtttcaaaacaaaaacaaaaacaaccaccttggaaacaggtgaaaagctgaggggcttccctgccctgggcttgccccaaaccagcgtccaggggtagtgctggagctggaaatacagaaatattctccagttatcctgccaggggtcctcactgctccttcccggttcccacagaggcaaacccatagggaatgtatctattagaagaaaataggcagtgaaagcatgatgataaatggcaactgacatatagcattagggtcagggagacaatggggagaaatggggaccttggtaaacttgcagctgctccagcagatggctgcaattaaggcgtgggggacccaaaaaaacagatcttttgtttttttaagagaagcccaaacttggagttttaggaaaatctgttcatttccatttattggcgattgattcaaattgtttaaaagcactctaggggctgggcacggtgactcacacctgtaatcccagcactttgggaagctgaggtgggtggatcacaaggtgaggagtttgagaccagcctggccaacatggtgaaaccctgcctctactaaaaatacaaaaatattagccaggcgtggtgttgggcactggtagtcccagccactcaagaggctggggcaagagaatcacttgaaccctggaggcggaagttgcagtgagccatgatcacgctgttgcactccagcctgggtgacagagtgagagtccatctcaaaaataaatataaataaattaaataaataaattaattaaatgaataaataaataaaaccactctagggccaatccaaagtggatctgtgggctatactcaggctggatttagcctgtgggcttgcacccttaactctggccatgggtgtttagttccgtggcctatgtcctcctatgccccagttttaaaatgtgagagtcccagccaggcgtggtgggtcacgcctgcaacccagcactttgggaggctgagatgagcggatcacgtggtcaggaggtggagaccagcctgaccaacatagtgaaaccccatctctactaaaaatacaaaaattaaccgggtgtggtggcatgcacctgtagtcccagctactcgggaagctgagacaggggaatcatttgaacctgggaggcggaggttgcagtgagccgagactgtaccattgcactccagcctgggcaacagagcgagactctgtctcaaaaaaaaaaaaaaaaaaaaaaaattgtgagagtcccataggcagaggctcccttgtacaagtcctggggaaaaagggtctctgttgaccaggctttagtcccaagctttccaggagcaaaactttgattttgtaaataccctataaggttttggtctttgggaactgcttgtcacaatctttgttcagaagactgaaggagaaaccagacactacatgagcaatttagaaatagggaaggagggagctatgttactgctgtgatcatgtagttctccagagcagctcttcttggggtctacatgccaaaagcctgccagaggggccaggaccagcataaagggagggaaccagcccaaagactatttcatctgggtcatggaggggcctggggaaccttctcaagtccaagcaaggtctgctttgctaggcccagggtccatttggcttcgtgatgcaggatgtcatgtgcctggtcttaaaactggagagacctcaccactgtcttggttgtgggtgcccatcctgccctgggccctgaccatctcatcattcctaccaaataataataatcccaggtgccctttattatttatttatttatgtatttatttcagacagagtctctgtcacccaggctggagtgcagtggcatgatctcagctcactgcaacctctacctcctgggtttaagcgattctcctgcctcagtctctcgggtagctggaattacaggtgtgtgccaccacgcccagctaatttttgtatttttttagtacagacaggtttttactatgttgaccaggctggtttcaaactcctgaccccaggtgatccacccggcttggcctcccaaagtgttgggattacaggcgtgagccaccgcagatggcctcaggtgccctttatgaagcatctccgatccagactttctgtgcctggatagatttgatgctttctgtgatatatatatatatatatatctgtgagatatatatatctgtgagatatatatatatctgtgagagatatatatatgtgagatatatatataataatatatatattatttttatttttaatttttttgagacaagagtctggcttgagttgctcaggctggagtgcagtggcacagtctcagctcactacaacctctgcacctccacctcccaggttcaagcaattactgtgactcagcctcccaaatagctgggactacaggcgcataccaccaagcctggctaatttttgtatttttagtaaagatggggttttgccatgttggtcaggctggtcttgaactcctggcctcaagtgatctgcctgctttggcctcccaccatgctgggattacaggcatgagccaccatgcctggcctgtgcactatatttgatgctttctgtgcacaatctcatttaatcctcataacaattctatgaggtaggaacagttatttactctattttccaaataaggaaactgggctcgcccaaggttccacaactaacatgtgtgtattattgagcatttaatttacaccagggaagcaggttgtggtggtgtgcacctgttgtccagctatttaggaggctgaggtgaaaggatcacttgaacggaggagttcaaatttgcaatgtgctatgattgtgcctgtgaacagctgctgcactccagcctgggcaacatagtgagatcccttatctaaaacattttttttaagtaaataatcaggtgggcacggtggctcacgcctgtaatccagcactttgggaggctgaggcgggcggatcacctgaggtcaggagttcaagaccagcctgaccaacatggagaaacccgtctctactaaaaatacaaaattagcttggcgtggtggtgcatgcctgtaatcccagctactcgagaagctgaggcaggagaattgtttgaacctgggaggtggaggttgcggtgagccgagatcgcaccattgcactccagcctgggcaacaagagtgaaattgcatctcaaaaaaaaagaaaaggaaataatctataccaggcactccaagtggtgtgactgatattcaacaagtacctctagtgtgaccttaccattgatgaagaccaagattcttttggattggtgctcacactgtgccagttaaatattccgaacattacccttgcctgtgggcttccagtgcctgaccttgatgtcctttcacccatcaacccgtagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtacatgtgtagcctgtgcatgtatgtcttggacactgtacaaggtacccctttctggctctcccatttcctgagaccacagagagaggggagaagcctgggattgacagaagcttctgcccacctacttttctttcctcagatcatccagaagttcctcaagggccaggactttatctaatacctctgtgtgctcctccttggtgcctggcctggcacacatcaggagttcaataaatgtctgttgatgactgttgtacatctctttgctgtccactctttgtgggtgggcagtgggggttaagaaaatggtaattaggtcaccctgagttggggtgaaagatgggatgagtggatgtctggaggctctgcagaccccttcaaatgggacagtgctcctcacccctccccaaaggattcagggtgactcctacctggaatcccttagggaatgggtgcgtcaaaggaccttcctccccattataaaagggcaacagcattttttactgattcaagggctatatttgacctcagattttgtttttttaaggctagtcaaatgaagcggcgggaatggaggaggaacaaataaatctgtaactatcctcagatttttttttttttttgagactgggtctcactttttcatccaggctggagtgcagtcgcatgatcacggctcactgtagcctcaacctctccagctcaaatgctcctcctgtctcagcctcccgagtacctgggactactttcttgaggccaggaattcaagaacagagtaagatcctggtctccaaaaaaagttttaaaaaaatcaaacacacttagccgagcatagtagctcatgcttgtagtcccagcagatcaggaggctgaggcatgaggattgcttgagatatgattgtgccactgtggcactccagagtaggcgacgaagggagatcctgtctcaaaaaaaaaaaaaaaaaaaaagggaaggcttcattgagaaggtaggtggcttttgagcaaagattccaaggtgaaggagtgagccttgtatggaggaggggaggagcagtcagccagagggaacagggtgaggcaggcgtttaccgggcatgctctgagagagggggatagatcctacaggcctggggccttgtggcctctgcagaagccattttgaggaaactttgcaggaatctctgcaaagctgatatgatctgaattacattttattttatttatttatttttgaaataaataatgaaattatttatttattttttcttgctctgtcgcccaggctggagtgcagtggcgcgatctcggctcactgcaagctctgcctcccgggttcatgccattctcctgcctcagtctcccgagtagctgggactacaggcgtccaccaccaagcctgggtaatttttttgtatttttagtagagatggggtttcaccgtgttagccaggatggtctggatctcctgaccttgtgatccgcctgcctcggcctcccaaagtgctgggattacaggtgtgagccaccacacccggcctcttttttttatttttaattgagatggggtctcactctgtcacccaggctggagaacaaaggtgaaatctcggctccctgcagcctctgcctcctgggctcaaacaatcctcccacctcagcctcctcagtagctgggaccacaggcatacaccaacactcccggctaattttttgtattttcggtggagacggggtttcaccatgttgcccaggctgatctcaaactcctaagctcaagtgatccatgttcctcagcctcccaaagtgctgggattataggcgtgagccatagcgtccagccctgacttacattttaaaaggatggctcttgctgctgtcttgaaaatagactgagttagtcagtttataaaactggggagattttgcataaaactccagatttctgccttctcttgaaaaataggggctaggtgcgttggctcactcctataatcccagcattttggaaggccaaggtgggcagattgcttgagcccaggagtttaagaccagactggacaacatggcaaaaccctgtctctaccaaaaaaaaaaaaaaattagcagggtgtggtggtgcacacctgcagtcccagctactcaggaggcaagcttgtattcctagctacttaggaggatagtttgagcccaggaagtcaaggctgcagtgagcatgatcctgccattgcactccagccagagcaaaaaagagagcgaaaccccatctcaaaaaaaagggaagatttagctatgttggacttacctgtcctcatggagctgaataatggccacccctccaggtagggcctgaactctacctttgccagagtcccctccactccctgttggtcttagacaatgaaactgagtgttagtagctatttaccaccaagctcatgcttgttgttcttataataaagataaatggtttaataaatggtatgataaagaaaattatattatggtattataccatttaataaatggtataataaagaaaatggttttttgcacccacatttccattaaaaagtgagaaaattaaagatacctgaggatggcagagtgtttgatgaaagatagggaaatgttggccaggcaccgtgggtcacacctgtaatcccagcagtttaggaggccggggcaggcggatcacaaggtcaggagttcaagatcagcctggccaacatagtgaaaccccgtctttactaaaaatacaaaaaattagccgggagtggtggcaggtgcctacaatcccagctactcggaaggctgaatggcgcgatctcagctcattgcaacctctgcctcccaggttcaagccattcttctgccttagcctccctagtagctgggattacaggcgcctgccaccatgcctagctaatttttatatttttagtagacgtggggtttcgccatgttggccaggctggtctcaaactcctgaccttgggtgatctgcccgcctcggtctcccaaactgctgggattacaggagtgagccacagtgcccggcctctaatttttatttttaatttttttaatttttatttttttaatttttattttatttattttttgtaatttttaaaatatacaaaaaaagggccgggtgtggtggctcacgcctgtaatcccagcactttttgggaggctgaggtgggtggatcacgaggtcaggagatcgagaccatcctggctaacatggtgaaaccctgtctctactaaaaatataaaaaaattagccgggcctggtggcaggtgcctgtagtcccagctactcgggaggctgagacaggagaatggcgtgaactcgagaggtggagcttgcagtgagccaagatcgcaccactacactccagcctgggcgacagagtgagacttcatctcaaaaaaaaaaaaaattatatatatatatatacatatatatatgcaaacaaagagcatctgagtcataataatgtaaatctatcacctgactgacctgctgccacacctcatgatctcatctgatccccacactccttctctttgggatactgtgtacagccatagcgtgggtgaactttgtattcctatcctccccatttttgttattttattttatttcttatttatttgagacagagtctcactctgtcatccagactgtaatgcagtggcctgatctcggctcactgcaacctccacctcccggtttcaagcgaatctcctgcctcagcctcctaagtagctgggacctacaggcacacaccaccacgcccagctaatttttgcatttttaatagagacggggtttcaccgtgctgggcaggctggtctcgaactcctgacctcaggtgatttgcccacctcagccttccaaattgttaggattacaggcatgagtcactgtgcccggcctcctccccattttataacaagggaaatggaggcccagaatggttaagtaaacccacccagggctagctgagaattagcaacagagaactgggagtagaatttgttccctggccctttgctgtttctattataagccacccagtcttagattttctgttaccttataattaatgactcaaatgcagtttctgagtgagaaacacaagtcccaaacactctttaaagaggcataaagatgtatcttgttgttttcttttgtttgagacaaggcctggctctattgcccaggctggagtgtggtgacatgatcttggctcactgcaacatctgtctcctgggctcaagccatcatcccacctcagcctcctgagtagctggaactacaggagcgcgcccccacacctgggtaatttttctattttttgtagagatggggttttgccatgttgcccaggctggtctcgaactcctgagctcaagtgatccacccatcttggcctcccaaagtgctgggattacaggcgtgagccactgtgcccagcctcttgttgactgtaggaccacaagttggcggctaacttagagcaatgtttggcacacaggaagcactcattaaatattgacattattgtagttattttaatagcccagcattgcacttttaggtctttcagctttcagtgatgatcagttgataattgatgatctggtggagtggttcttaatggtagagttgggggcaattttacactcccttacaccccactaatcttccccccaacccaatggtaaagctattgcacagtacttggcaatgtctagagacaattttggttgtcacagcctggggggaaggtgctactggcatctagtgggtagaggctaaggatgctgcttaattttttttttttttgagacaagagtttcactctagttgcccaggcacagaacagcttcacagaagctgttaatgcacagaatagcttcctacaaaaaagcattacctggcccaaaatgtcattagctaccaggctgagaaacctgccctcctaggccgggcgctgtggctcacgcccgtaatctcagcatattgggaggccgaggtgggcggatcctgaggtcaggagttcgagaccacctggaccaacacggagaaacccagtctctaccaaaaatacaaaattagccgggcatggtggcacatgcttgtaatcccagctactcgggaggctgaggcaggagaaccgcttgaacacagaggcagagattgtggtgagccgagatcacaccattgcactccagcctgggcaactagagcgaaactcttgtctcaaaaaaaaaaaaaaaaaaaaaaacagggaaagaaaagaaaggaaacctgccctcctatcataggataatcccatttcctcctgtctaaagagacgcctacttagtcatcctgggtgactgcatcagggaggtagattttggagtctgaaaggctgggttctgtcactttgttacagtgcctctggtgcaaagaaagcattttaaaaaccctgtacaattaaaaaattgaatttaattactttgtgtaactttgaataattcacagaagtctgaacttctttatcctgtcctgtaaaatggaggtaaaaagcccttggccgagagctgttttgaggaaaaactgaaataacattggtaaagtgtcgcacagtacttggcacacagcagcccctcgacaaacattagctttctttccctttcttgtcggtttcttcctctccaaacccgcgtgttgcttttctttttaattatttttctgtagccctcctttgcggccacaaactcgctttctaacccaggttcagcccttttattggctgagtgaccttgtgcaagtcacttttcccctgtaggcctcggtttattctccgtaaaatcagaaagttggcctccgatctccaagcacgcttttcacgacgaagtgggactgttaagtttacagagctgctttcctcccccgggactgatggtacggtccccgggcggctccccacccatctgtcgcagaccttggtacaggcccagggggccctcggcggcctctccgggctgcccttgccccctgccgagttccgggcccgtgtctgcgcaagctgattggctggagcggtgcccgggctgcgcggctataggtgagcccaggaggggacgggcggggcgttataacaaaaacttcttctgaaataccttttcccctcatatatgttgtgatatctacattcgtatattgatatccatttttattctccctattgcgattgctatgttatatttgtatacttattggtagcgatatagtgctcacacccaactttgatgatctatattttattcttaatccttaatttacttaataacttgtttgacaatttatatttatccttctgatgtgtgtgtcctctatcagtcttcgtgtttcttgttcgcttccgcgtacatttggaaatcagcaccttcgtaagtctagaaacactctcctactactattccctagttctttctagtatatatacaccgcgtaatgcccatcacaaatttccaccaaatattcacacttatcataacttgatcatatgtttataacgttacaattttgactagtttgtttattaattatatatagatcatatcttattagggcgtaggtataacatctatatagataccgctctgtacttatatcaattctatctcttttatttcattgtcatctcgcgtctgctgtgctcactattgcatcttttcagttccccatacctcaatcacttacttacaaatcgtcgtataagtagtacattaactaacaattaactcgtcgatacatctgacgctattgttatttatacctggatatagtcgcataactgctctctcctctgaatctactcttccttactctctaacatcacttttcactccgctccttacaatcatcttaatgacgtttcattctctgaatagtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgacctccagtgctccatctgcctcagcctcccaaagtgctgggattataggcatgagccacacttcctggcctctgatgtgggcaatttgatggtgagtgtttggaggtttggagaatgccatgtcagttgataacttttttttttttttttttttgagatggagtctcgctctgtcgcccaggctggagtgcagtggcgcaatctcggctcactgctgcaagctccacctcccgggtccatgccattctcctgcctcagcctctccagtagctgggactacaggcgcccgccaccacactgggctgattttttgtatttttagtagagacagggtttcaccgtgttagccaggatggtctggatctcctgacctcatgatccgcccgcctcggcctcccaaagtgctgggattacaggtgtgagccaccgcacccggccccaactttttttttttttttttaaacttctagagatggggtctcaatatgttgcctgggcttgtcttgaactcctgtgcctggcctcaagcaatcctgccaccttggcctcccaaagtgctgggattacaggcctaagccactgttttttttgttgttgttgtttgtttgtttagaaataactattgataactgttaagatgtttaggggacatccaagtagaggcatccagtaggcagtttagaagatagaaattttttggtagtcatcagtatcttagtctgctataacagaacactgtttataaagaacagaaattgctgaatgtggtggctcacgcctataatcccagtactttggtaggctggggcggatggttctcttgagcccaggagtttgagaccagcctgggcaacttagggagactctgtctctacaaaaagtaaaaaaattagctgggcatgatggcatgtgcctgtagagaggctgaagtgggaggatcacttgatcctgggaggtcgactctgcagtgagccatgatcgcaccagtgcactccagcctgggggacagagtgagaccttgtgtcaaaaaaaaaaaaagaacataaatgtatttctcatagttctggaggctgagaagtccaaggctagaa

SEQ ID NO: 1485 - DNA, 2032 bp, Homo sapiens
cgcctggaccatgtgaatggggccagagggctcccgggctgggcagggaccatgggctgtggctgcagctcacacccggaagatgactggatggaaaacatcgatgtgtgtgagaactgccattatcccatagtccgactggatgggaagggcaggctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaaccactccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgccgggtccttttcactgtcggtccgggacttcgaccaaaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctgcacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttgagaggaggccttgagaggccctggggttctccccctttctctccagcctgacttggggagatggagttcttgtgccatagtcacatggcctatgcacatatggactctgcacatgaatcccacccacatgtgacacatatgcaccttgtgtctgtacacgtgtcctgtagttgcgtggactctgcacatgtcttgtgcatgtgtagcctgtgcatgtatgtcttggacactgtacaaggtacccctttctggctctcccatttcctgagaccaccagagagaggggagaagcctgggattgacagaagcttctgcccacctacttttctttcctcagatcatccagaagttcctgaagggccaggactttatctaatacctctgtgtgctcctccttggtgcctggcctggcacacatcaggagttcaataaatgtctgttgatgactgccg

SEQ ID NO: 1486 - DNA, 1530 bp, Homo sapiens
atgggctgtggctgcagctcacacccggaagatgactggatggaaaacatcgatgtgtgtgagaactgccattatcccatagtccgactggatgggaagggcaggctgctcatccgaaatggctctgaggtgcgggacccactggttacctacgaaggctccaatccgccggcttccccactgcaagacaacctggttatcgctctgcacagctatgagccctctcacgacggagatctgggctttgagaagggggaaccactccgcatcctggagcagagcggcgagtggtggaaggcgcagtccctgaccacgggccaggaaggcttcatccccttcaattttgtggccaaagcgaacagcctggagcccgaaccctggttcttcaagaacctgagccgcaaggacgcggagcggcagctcctggcgcccgggaacactcacggctccttcctcatccgggagagcgagagcaccgccgggtccttttcactgtcggtccgggacttcgaccaaaaccagggagaggtggtgaaacattacaagatccgtaatctggacaacggtggcttctacatctcccctcgaatcacttttcccggcctgcatgaactggtccgccattacaccaatgcttcagatgggctgtgcacacggttgagccgcccctgccagacccagaagccccagaagccgtggtgggaggacgagtgggaggttcccagggagacgctgaagctggtggagcggctgggggctgcacagttcggggaggtgtggatggggtactacaacgggcacacgaaggtggcggtgaagagcctgaagcagggcagcatgtccccggacgccttcctggccgaggccaacctcatgaagcagctgcaacaccagcggctggttcggctctacgctgtggtcacccaggagcccatctacatcatcactgaatacatggagaatgggagtctagtggattttctcaagaccccttcaggcatcaagttgaccatcaacaaactcctggacatggcagcccaaattgcagaaggcatggcattcattgaagagcggaattatattcatcgtgaccttcgggctgccaacattctggtgtctgacaccctgagctgcaagattgcagactttggcctagcacgcctcattgaggacaacgagtacacagccagggagggggccaagtttcccattaagtggacagcgccagaagccattaactacgggacattcaccatcaagtcagatgtgtggtcttttgggatcctgctgacggaaattgtcacccacggccgcatcccttacccagggatgaccaacccggaggtgattcagaacctggagcgaggctaccgcatggtgcgccctgacaactgtccagaggagctgtaccaactcatgaggctgtgctggaaggagcgcccagaggaccggcccacctttgactacctgcgcagtgtgctggaggacttcttcacggccacagagggccagtaccagcctcagccttga

SEQ ID NO: 1487 - DNA, 59394 bp, Mus musculus
  misc_feature (4271)..(6912): "n" at positions 4271 thru 6912  can be any base
  misc_feature (26986)..(27005): "n" at positions 26986 thru 27005  can be any base
gggactacatgttggaaccttatcttaaacacacacagatacacacacacacacacacacacacacacacacacacacacacacacaaagcagggcctggagaggtgccttagtgtgtaaagaaagtgcttgcatcaggtcctgaagtcagaccccccacccagtgcccatgtaaaagccaggcatgacacacacctgtcaccccagcactagggacacagaatcaggagcatcccggggaaccaatggccagccgctctaggggaaatcatgagctgcgggttcagtgataaagcttgtctcaaaaagtaaggtagagaaatgattgaggaagacaccccaacatcaacctctggcctcccggctccctcacaggcaagcacaaccaggaacacacacacacacacatacatacaccatacaaacacaaaccacacagccacaccacacccacacatatgcacacaaacacaaatgcataccaaataagaataaataaaaatacaaaattttgcttttcatttctcttcttttcgtctttctctccagagcgaggggaggagagacagagacaggattcagacagagcacagcacccctctccagtttcaaatgacggctcaggcacaggcaaagcatgcaagtgagaggctcttcaggtctctaggacaggaagcacagcgacctgacctacctcagagagtaggcagaactaaattaaagatctgagacccatgagcgctctcgctctctctctctcattacacacacacacacacaatttagacctaaaaaaaaaaaagaacaaccccacaattttataagaaaaaaatatttagcaaaaatatttagcagaagctggccacaccgtcttttaattccagccctcagaagattgactgaggcgggaggacagccatgagttcaaggctggcctagactacatagtaaagttccaggccacccaaattcacaggtgatcattcaacaagggcaagccacacgccccccccccccccccacaactcagcactggtactgaccactaaactcaactgcctcccggtcgaagaggaaggtggctatttcttaaccaatggagaatctgaatgaacacacacttcctgctgtgtggcttaaggatattctagcaatatggattatcttgaccccaaaccagtcatataagttacaatataatgaaagtccaagatgccccttattcaaaatagtgaaaaatttcataaccgtgacaacagagaggaggcagccctccactgctactccgtccctgctgaagttcaactgtatggttatgaccggcaagatgtccatgtcaaggtctactccctagacacaagtgctacactgtcaagggacccattgtgttaaattagggcagtgtcaaaaccagaggaccagaggatcggcaagtatgagcattcgctcaaccttgaagtcaagggcagcaatgaccttaagttttctcccatagaatctactgcaagactttaattcccaagccctgccaagccttgccaccccaggactggggaggttaagaagggaggccactgaggaggtttgaggccagcctgggccacacagatgacttgcaggccacctagatgtacacagtaacaccctgtctcaaaattagaagattttaattcccaaattttaattccaaacgtcctcaagatttgtcatggtcaaagacaggagaatgtccccgggtacctttatcgccattttcaggaaatggtgactgggtcacagctgagatcttgaccaaggtgcgcctcttacttctgcagacagctcttcctcctcagtgaggagaaagctgcttacagaactcaggcctgaagcccgtggtgtgatgacaacaaaccttcctatcaaatgcgatttaacctcgtgactctgtactttcaacggtgctcggtgctcgggattcgaaccactgtgtacagcagaacccgtgccaaggctggatggaaccggaaccgggacccttccacgtcctagccccgggcgatacacctgcttcaactcctttttctgcatttttttttcatttttttaaaagatttatttattgattatatgtaagtacactgtagctgtctttagacaccccagaagagggagtcagatctcgttacggatggttgtgagccaccatgtggttgctgggatttgaactctggaccttcggaagagcagtcgggtgctcttacccactgagccatctcgccagcccttttttttcatttctattttgagacagagtcaaacttgcccagactggccttgaacctgtcattctcctgcctcagcctccacgacagctgtgggccaccgtgtccagtcaaaactggttactgcttctttgaaatgtccagagtgggccttgaggataggcagaagagcttctcgcttagattctagagaaggcctctgagctgtgtgtgtgatgcaaagagttatatcagcaggtatactgggatgcctgaatcatcctctctgggggcatgtgtcatatctctttaaatcctaagtcgttactgtgccatctaattaagaacaatgactcttacaaaaccgtcttctgtctggactaccctcccctgccccacacacacctgaggatgaaacccagggcctctcacacaatggacaagtgttggggccactgcgatacacacagtctcatcctttcttatttattttctgacagatcatcaccaagttgcccaggctagcctccaaatcttcctgcttcaacttcctgagtgtcttgggttacccgtgtacaccgccacacccgccatggaatcctttttttaaatgccacttctgacttcccatgctgcccatacaactaaatatatatatatatatggcaagctgcaaaccaacacttagaaccgttccaacagcgcttcgatgtggggctggcccaatgtttaccaatcaaaagaaccaagggttcgcaacaattactgagtcagtggttaagtcattcaaaagcaaggctctgacacactggctaagacgaatgaatgaagccaaaccgtaacaattatggcggatttcgggagtaattataaatccttatctcatttgctacaggctagagagcaactcagggcacccgtgcctaatgaaatgactgcagtgccattaatggcaggtgtctcattcctggtgggcggctctgcctttcagcaggctacccctcccccaagttagaagccagcctgagctacacagtgaattctaggctaagcagggctatacagtgagaccctgtctcaagcaaaaagaacaaaaaccaagaaacccaaacaaatgaaataagaattcatattaatgcaaagattcttcaccacggctctaactaacattggagtctgataacactcagtggtgggtgagtggctgccttgaacactgtaaggcacagcgaggtcgctggcctctccccaatgccatgccaacagcacccacctctaaagtcaacccaacccaaaacgtcttgtctccttgcattcccaaatattcactatcatcttcatctgagaaccactgatttacagaggtgggaagaaaagaaaaaaaaaaaaaaaaaaaaaaaaaaagcacttcagaacaggaaggtcctaaggagtctgagcagcagagattctcaaaccaaccaccctggggagctcgttaaaaccccgattcctaggcccagccgcagccccatcaatttagacaagtactgggttttccgtcgtcactgcctccatcctcatccaatgggtaaggaaaagtggggtccccccaacgtaactgctttgcccaaggtcacaagagagttagaaccaggccaccgaagccaaccaagctcttccccagcaccagggcgggtggagtaaggtgtgtttcttccgtcttcaaggccataaagcttaaaggtgaattctggggccagcgagcctgagataaacgatctggacgtggttttcattagcccgatggccttgcgccttgcgcaaggcaagtaggctctggggtctcagtttccttctctgtcaaatggaacaataagcgctcattcctaacgatatcagaaagaggagaatggaccaaaagcccccggcaccgagcccggtctacggtaagcgctctatggatcccggggctcaggaggagaacggatcccgactccgcgccgcgcacctcacctggtcccgcagctccttctccagctgctcgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacccccgattttgcctctgcgtgaccttggaccgatgagttctcttgctcaaaccttgatttcctccgggttttttttcccccccacccactgctggaaactatggccaatgcagtgcgcagtggtcaatggacattccccggggatcggctcctttcgtaggataactcagttcaaaacccttgtagttccttcagccacagtctggcttcagattcacactgtcactcgcagcgacttcgaaccgccaaaactgttctaaactgcagataggatttggatttgaagattggatctggctttgtaattggaacccaactgacaggtctcgatcctgattttgtgtgtgtgtgtgtgtgtgtgtgtgtgtgtgtgtgtgtgcttgctttggtccttggacttttcgggtttgaagtcaaatatcagatgactttcctggtgtagcagtgttcaatagacagtcttaattaagccattgaacgtcagcggcttgcaacagatttttctcttcgtcttgtcatttggaagcagagactggttttaagtggtacggtggtaaccagtactggttatttcatggccctgggtcctacaggttaacaaatggaagataaggagaggcagaggcacttttaaaagagatgctttgtttgcaagccgcgtttatacaaactattatttggctaacgatgttgtgtgttccgcttccttcttttcttgcttgtgttccgttgattcatgtctaacttaaaacttcctcttgggatgcttgcttcttacttctccagggattggtccgtggtagaggcgggctgcctccccttgccaccccgatactgtcttgtccattttgtggtgttttggggccttttctattgtttcatattagaggtcttgaatgccaacatctagaaaggcttgagtcacttcctgttttgaatagaatgaagctaccttgaaggctgaggaacagctaggaataggtgctgccttttgtgcacagctcaggggaaaggttacctgtaggagtaggctcctttgaaatcctcatgctaaggccttctcagaagatgctcagacagacatttgactctcctggacgtttgcagaagatgggtgggggcacagatacttttgaagtccacttgtgttgttcctggagcctgattaaaaagtcctgcctttccgggcgtggtggcactcgcctttaatccaagcactcgggaggcagaggcaggcggatttctgagttcgaggccagcctggtctacaaagtgagttccaggacagccagggctatacagagaaaccctgtctcgaaaaaacaaaaaacaaacaaacaacaacaaaacaacaacaacaacaacaacaaagtcctgccttctagatgaactggaggggcttcacgcagcttcactcgtaaaagcttaagttttatgtgtcgtctgtattctttccatgggcttctgttccatggtgtttaagtgattaatggagaccattgtgtggtgcgcgttaaaatgttgtcatcctgtcatccttttcttgactagtttgccccaagagtactgtggacctctggtaataaaaagcaaagtcacgctttcagtctcaatattaataacttgctgcagaagcagagatgtcacacatctgcaagcaaagcctcctgtttcctacccttgctccttagaatggctgttagcacctatggtaaagctggctgaaaccctttctgttttgttttagaggagacgcttcactgtctgcctttgtgtgttggggatcaaagccaggccctgacaattgctaggagagccacaccctcagccctgatttcttgtttgtttctaatgaatctagttcattttaaatgcatcattcttgtgccaagatgacactctaattttgttctttacatcgtcccttctgtgagatagatacatcactattccagtttggtcctcagtgagaacactccaagacgcagcttgcctcagatgattgcacaagaggtggcacggcagggttgggattcaaaccatggactgtttgtctccataaccagccctcttaaccactgtacaccttgattgaaatcccgtaacttttcattaaatggtttgaaagggttggaataaacataaaagtggtaaagatgctctacatgcatttcagagatttttgtggacattgaagaattttaaactgaacccttaggccaggcagccggggtagcatctaatgccaccccacatgagtctgatgaaatggggtttctagggctcagtttactcacacagatccgtcctacccgcccagtgtgagttactcctgtctgcagttttgtgggattttaaaggaaaaaggtattgtactcaattaaaaataccatcatttttgttttccgtctgttcgtttgaagtaccttccttcagatccagcaggtggtcaaaaactgcagtgctagcatagagcattgtctctctgagcagaatgagccacccttgcttgcccggggcatgggggcctggacgcttctgcagttctcttctggcttctgttagcacctgggtctggactgcctgctctgggcagcaataagttcaccatttaccttagctactgttacgcactgtgtgtgtgtcaggatcacacagctctgttattctcaaaaagggactcgacgcggtcatccagatggaggtcagcatagagtgcttgcctagcccagacaaggcccctggctcagtctccagcactggaagcaaacagcggagcaaccacccctgctccctcaatctgctgctctaaccaacatcccctgagagcacgagtctgtggcgtgcacccacatccaggctgcagactggcctgcacaggaaggtgactgctgtgtgcagctgccaacctagttagcagagcggtcagtccgggtggggggatcatcagcctcctaggctgaggagcagataaaacaacaaaaatgtgctctgtttttcttaaaaaccaaacatcactcatcttttgccatcctgtacacagcagccaattggtgtccttgccactgaggggttgttctttttccagatccttcctgggcgtcagtaaataggggaactttcatatgtgacgaatgttgcagtgtccatcggagcctggggcgccatatctcccaagtgaggcatcttaaacacacagcatggcctccaaccctgctccaggtaaaccataggaagagttctcataattggaaaattatattttagtgattgttgcttaacaactaaaatactgcctactatacatcttaaatcttataaaagtttactctctatgtatagtataaagtgctgccctgtgttgaagtcattgtctgtcctttctttgtttacctaacataattgtgttccccacattcagttatacatagacagatatatcaatagattgtgtcgataaaagcttaaattctctagtgcgttttcattggtggctttctagagagattatcaccagaaattgttgtgttgtgctgtgttgtgttgtgttttgttttgaaacagagtctcgctatatagccctagctggccttgaactcacagacaatccacctgcctctgctaagtactaggattaaaggtaattgcaaccgtgcccaacttcagaaatcattttatttttttagatgtatttcatatatatgtctgtgtgtgtgtgtgtgtgtgtgtttgtgtgtgtgtgtatgcctgtgtgtgtgcatgtgtgtgtgtgtctgtgtgtgtttgtgtgtatgtttgtgtgtgtgtatgcctgtgtatgtgtctgtgtgtgtctgtgtgtgtttgtgtgtgtgtgtatgcctgtgtgtgtctgtgtgtgtttgtgtgtgtgctcacagaggccagaagagggcactggatttcctgacactggaattacagagcgttgtgaaccacaccggtgctgggactcaaatccgggtcttctaccagagcagcaagtgtttggtttaacactgagccatctctgcagcactcagacattttttaaagtctttctttcctataaattgtaatagatgatccagaaaattttcattaacaggcaaatttctgagtacctgcctatatttttagaacttttttttttcctgctttgatagcagcatagactgggattccgcagaaattgcttcaacatttgaagtttttaaaaagctcttgctgttaggcagagacttgagtgagcgtgttttgatcgcatgcctaacacttgtcaggggtctttgtcttatttgggatctgatgtcatgttcccggtacttctgtttgcgatacacagtcttcatgtctcctggaactcagggattaatcctgtgttttgcgatatttgtcttaatacacatcttactaaagctgtaacagctgcacagcagtacttaaactcccacaaacgaagggaccagagcaagtggttcgggttactgatgagaagccctgagagctgcactagcagccgggtagctctaggagtcctgattggaaaggaagttgagagagatttattaaaagttctacttaggggctgaagagatggctcagcctttaaatgctagctaacaaccataaatccccgagttctgttagaagtgttcaaaggccccttctcgtgaaagggttagctagcgccctccaccacattgtgagttctgttagaagtgtccaaaggccccttctcgtgaaagggtagctagcaccctccaccacattgtgagttctgttagaagtgtccaaaggccccttctcgtgaaagggtagctagcaccctccaccacactgtgagttctgttagaagtgtccaaaggccccttctcgtaaaagggttggctagcgccttccaccacactgtgtttgtttacagctttagaatttacagatggtccagagatgaatgattgaaaatgttagcagggcgtggtggcacacgcctttaatcccagcactcgggatgcagaggcggcggatttctgagttcgaggccaacctggtctgcagtgagttccaggacagccagggctacacagagaaaccctgtctcaaaacaaacaaacaaacaaaaaaaaaaccaaaaaacaaaaaaaaagaaaatgctagggttgactttaaggcagcagactctgaaatgtgtgtgtgtgtgtgggggggtcaggaccacagtggggtgtgagagagcttagcacgcagacgtgtgcttatagcattactttaatcatgtacaaagaaagtaacataattattaacaagatattttaaataggtgaatttaatgaaaagcattgagtgagtggtgtacacaatggtaaacggcgtgtgttcaggcaggtgtgtgccaaggagccgggattgggctatcctacacacaaagctggctcccatgtggagctccaaggtctcactgccagtcaggaacagtgacggcccggtccccagtctcactgtgcagtcagacgcagtggcgggaggtccccagatatggagtgtttttagtgcagcactgttttttcatttttgttactggttgtttttgactatttgtgggataaaatgtcctctcctactccttgttttcagatggttgagaccttgtacaacaatggtgctaactctatatgggaacactctctgctggaccctgcctctatcatgagtgggaggcggaaagctaacccacaggacaaagttcagtgagtggagtggttataacttctatttcttctcagcaagtggccctgtggaaaggagtgtggctattttgatcagcctccaaaggggctgtgggctatgcctgggcatttgctgtgaggaaggcagggggagggaggcagggggaccataactttggatgctcacccaattgaagttagtgatttctccagttggagtccagggcttggagcttgactccgggtgatgaggtagatgaaaccgagcgctctgtctgctggccgcagcgttctggcagtgccgggcctgtgacacagggttagatgctgcttcctcagggtgcccagttgagaaaggtaaagggaagagaggcgctgggaagttcaggcgttctcttatcagctcaggcctttgactctgctgcagtggagtccagctttgcccttcttactgtccagtgggggggggggggtgtcacttcctcttcttacagcacaaagaatgagaaatgtgtcagagctgttaagtgaactgtgttcttatttgtttccaaaccagccccaataaagcagaattcatcagagccaagtatcagatgttagcgttcgtccaccgattgccctgccgcgaggacgacagcgtgacggccaaagatctcagtaaggtgggcgcgctctgccttctgtggggccgtgagatgggccgcttcccttaaagccatgtcaggaggaagaagcagccttttgcaagtgcctttgactaactgacctttctcccttacacagcattcactcctctcagacacactggacaaaaggaaaacatgcttctaagaaactgtatttttttccccttttattttcattttcatttaattgattaattaatttgtactttttcggtacagttttcacatagattttgataagttctttacttgagaataatagccatttcaaagaaggttttctagagaacctagcatctgaaatagagcagaggaaggaggctgactgcttcagatgtccaggttcaaggctggagggcaaagtgcacctagagctgtagcacagccgtgtctgttacaccgagagcggtgccttcttgtgggccttggctgtttctacgagatgccgtaaaaatgcacatcacagttttttgagcggtgctttgaactagatgctcactcaagacagcgtgtgcacaattcagaatactaattctgcacagatgtaagtgattttcctagtgagtaaatagtttcctttttttaccaaataaaaaacatggccaggtgtggtggcacacatctttttttagtccccggtattcaggaggcagagacaggcagacagctgtgaattcaaggccagcttggtctatatagtgagttccaggtcagcctgggctacagtgagtccttgtgtaaagggtgtgtgtgtaaaaataagaagaagaataaaaagaagaagagagcgatgacttgggctggagaggtggatcagtgattgagcacacactgttcctgcagatggctcatgagatgactcacggcacatctaacgccagctccggggacctgacacccccttctggcctctgttggcacctgcactcagtgtacattgatgtacgcatacatacaattaaaaataaaattaaaaaaaaaaaacaaagactggttccgtaggactcatctgccctgtgagccagtcaggacagttgtagagtagccctgaaggagagagccatttgttctttgggagtttaaaagcgtttctgtgatgatacggatttagtgtgcacaggcccacttcccactgagcgcagcctggcagaatcgctgtgtggacaaacagcacagacttgagcaggtggccagcgtgtgccgcgggtggctggagccgctgggatccgcgctgtggcagcagctgaagactgatagatgctgtggcagcagctgagttttgaattatttcctgtctccttcagtacacaccataaccctcctggtagagggcaccgtagcacccaggttcctctgctcagagattttctcagaacacacagctggagggaggtagaccttgaaatccaaccacacacacacacacacacacacacacacacacacaccacctcctggtcaagtgcttcttgctgggtttatggttgtacctcttactggcaagtcctgcgtctgggcagattggccttggcagtccaagctccttgttgttaaactgacagacccacctgcagcctgaagccattgtaaacagcaaagaccccaccaacccacccacccacccatcccagccatcttcctgagccaaacaagacccgttactggtgtaaagtgtgttagagtgcgcggccagcagctcgggcacatctctcctgacacttctgacaagtactctgtttctgtttgtttttcagcaactccattcaagtgtgagaacagggaatcttgagacctgtctgagactgttgtctttaggagcccaagccaacttctttcatcctgtacgaaaatgtcaattattcagatattaaacggaagctgagttatgtttggatagtccaggtctgctcagtttgttctttttgtctacttcttattaataattcttaggaaaaaggaagcactccactccacgtcgcctccaaagcaggacagatcttacaggctgaattgctggccgtgtatggagctgacccaggcacacaagattctagtgggaagactcctgttgactatgcaaggtgagaggctgaggttctcactgcactgcgtgctgaacgtttctttttttccttgctaagcgactactctgggtatggcttgtgtttagcccctttaaagacttccattctattattttgttgatgaagatgtttcaaatgtgtgtcagctgagacagacaagatgaaaggactgccgagtcctagctggtgtggttaacacccggtcatcatagcacagtggttttcaggttatagcatacagatcagggatcaggaactgggagggggtggctagagagtgggctcagtggttcagattgccatctgctctgcagagaactggggttcagggttcagtttccagaaccacggtgcctcatctgtacctccaatttcaggagatccagcactctcttctgacctccaagggcaccaggcacacacacggtacacttatgagcagacaacattgtatacgtaaaagtcaatacatcttaatttttaaaattaaataattaaagaaggctagggaaatggcacactgagtggtgtgcttccctataagcatgaagaacagaactgggttggaaacggcacagggccgcagccctggcctgcctgctgtctgtgggcaaggttaagacaggcagatcttggacaagcctgttactgtgttctcctaagtatctggagctgcatgaggggacttcatggggcctaatcaatgttaaaacctgcagatttaactgatgaaagatggatagctttccttgttttccctgttattttattaactatgaaggatcacattctgtcataaagaatgcaatgggaaatgacaaaagtctgtcctagagtcctagaacttacttctctggaagagatgattaataaattcttgaaaagtttgaggcaagattatatatgatttgttgtcaaaatggacagccatgttttgttttgttttcctttggaagactgcgtgactctgtaactcaggccggccttgaattcagaacagtcttcctgctgtgctgcctgccctccccgtgctctgatcacacgtgtgaactaccatgcatggctgacagtgggtcttaaaaagcacatgtgcttcagtcgagaaaagccccgctgccttaagaaccttcgtgtggtcctcagagtccacaggaggagccaggtgtgggctcccacatctgtaagcccagctggatgagaggcagagaggggagtcataaagtgtgaagcagctctcatggcctgtgcagaccctgctgccatcaggatggacagcaaaagcccactccagaagtcgtctcccgagccacacacatgccatgatacacactcacagtcacacacataatcccttttaaagggcatctgttaggggcagtggggacttgctgtgcaaacatgaagatcagagtttagatcctcaaaacacacaaatgccgtagaggagtgggggtctactctgttccaatcataggaggcagagacagaggatggccatagctagctgacgagcaagactgctgtaccatcagattctagttcagtcaagaccctgcctcagtgatgggtagagagagattgctgacgtaagccttgagtctccatagacgtgtacacacacacacacacacacacacacacacacacacacacgtgcagaaaatgaacatgtgtcaggtggtttccttgtggtggccccagtgaatccattacttgagatggtctttgaggagctggttgaatatggacctgtgaaggaggagctaaagtatcctccagagagggaaggtggagtgttcatccccgtggcgatgggccaggagacgagcagcgcttcatcagcactgaggtcccaccatgctgcttcatttcaccccctgagagagagagctctgccaggtgcacggacgcaggctgagacgctgtctggtggacatgtgtgtgtgtcattggtcaggaagaattgtgtggagagagaacctggctaaagctagattgatgtttggagataagcagaatgcctccacttccttgagcactttgcatggaatagcctgtctgagtcacaatgtctcagcgtcagagtttacttctacactgaaggacccaggcagcttggctgagagttaagaaaggcagccctgtttcctgttgatgcagaggcaggagtagccgctggggagtagccgcggggacaagctctgcagtgggtcagtctgcctgaagcccttcagtgattttggatttctggactgatatgaggccagctgaccgcgtgcatcaggatcatgtgaaggaagggcttctccagggtgttgacgcctggggccgtcctgtcctgactgacccagaattcccaagggtctgtattctgggaacactccagctagctgttgagaacctcttccatcacctcgttaagtgaagtcagtttttgcccctctcctaagtttttaagtgcataaaatgcactctcctatgccataaggaaagaaactatcttgggtgggagccccagcttccagagggactgaaagtgatggtgatagtccgccatgcacagtattccagacagccgtgtttgataagctgctcaggtatctcagaacgctttgttcgctctgacctggctggtggatggtgagctgtgtcaatggtgctttgttctcttggtaggcaaggagggcaccatgagttggcagaacgcctcatagaaatacagtacgagctgacggatagactggccttctacctctgcggccggaaaccaggtgagtgagaggagagcagccttgctcgcctcttatctggagtgacaagttaggaccgcattgctacttggaaagacagaaagagaagatgattatcagtagggtttgtatttgggcagacagtgtaatggcagagttttttttttctttttaatatatattatttattgttatttctatgattgcacgtagctgtcttcagacacacaccagaagagtgcatcagatcccattacagatggttgtgagccaccatgtggttgctgggatttgaactcaggacctctggaagaacagttggtgctcctaaccactgagccatctctccagcccaacagcagagtttttatgtttgcatttgttttgcatttgctatcatctcatgatgtatctcagctttgcctgcaactttctgtgtaccttcaggtggttttaattttttttacaattttttttgagatactgtaattacatcatttcccccccacccttttcccctccaaaccctcctgcatactacacaccatgcagtagaagcgcagagctagagccttcatcactagaagagtgctgagaacaggctcggccttgttcactctctcttcgcctcacgaagtgagattaatctttatccctctcataagtctggaaatctgtaagtatcccacactaataatggaaagagggccattcaggtgtgacaccacctacaaagcgggactctacagtatttcggaacatttggttttataagctgctcagctgtctcagagcggcttgtcagagtgaggtggccctttacctggcctggtttgtggatctggaacaggagtcagtaaactgtagtctgagcacaatccagccctcgaccagtttcattaaataacatgttgctgaaaggtgaccacgcctgctgctatgtgtgtgtggctgtggctgctgccacagaacagaagtggagctgagtgcaatgcacagaatagcagataaacacaaagcctaaagcattgtctctacagccctatgcagagacattgccaaccccatttaaaaaacacgtctgtggaggagcacatactgtgggatgtgtgtgcacgcacacacgtgtatatgtgtatgatcacacacagggcagagttcaacgtgcaggagttctctcttaccgtgtggtttctggggaatcacacttaggttgtcagaagtggccgtgagtacttgtaatcctgagccacctcgttcctgtgtgcagattcctttctctgattgtgcagtagcattaggagtcatttgggggcaaggtggagcaagcatatgctagcccatctctccttctgaatggaactaaaaactatggacaaaatgcttagctttgaaaagcaattcttagctaagaataacaagacccaaagtcccatcaagcttgtagcatcttccttctttggatgcagtgacggcctgtgatatggagctgcaggtacaaagaggccttctctttctgatttcagaaatgagacctaaagcagacagacaagaagaaggttcctctgggttgttattttattttccctctctttctaaagggaatatgtgtgggtagccacagcaatggcacagatgtataaatgtctggcaccagcatgaaagaatatggattgtgtttctcttgctgcctgcttagtaggcaaatcccagcctgccctgttgcctgctaaaaacagaaataacacttgacatagatgttgaagaagcccagagtcttgcaatacaatgtttagaatatcccagattccgtccatagtgactcaggagagaaaaagctgggaaaaccaagggctgcatagagaaagcaggcactaggtgaacaggcgctaggcctggggccagatggtggtcagcaggtaaagagaatgggccacccagtgacctgagtgatcctgtgacgcacaggatagagagccagcttccatgagttgtcctgttggaattgtcagaagcattttaaccagctaataagagcgtggactgaagagcaatgaacattctttcaaaagaaaaaaaaagcacataagacagaataacctagtaaggatgttagaaatgaaaattacagtggggcagtggtgatatacagctttaattatggaggcagaggcagaccctgagttcgaggccaacctggtctatgacagccagagctacatagagaccatatgtcgaaaaaccaaaatataaaataaattacagtacttaaaatattaactctagattaataggtttaatagaaggctagaaatattcaaaacataaattgaaaataggcggctaggaagtgatgtagctcatggtagagtggttagctggcatgtggaaggcccagtccccagcacaagagaaagagccagtggcagcctgcctccgggcctgtggggaagcactagaagaatgaggcaggcacgctgcagggataaaggacttgctctgcaagcctaagacctgtgcttgttccagcatccatataagaaaccaggtgagccgggcatggtggcgcatgcctttaatcccagcacttgggaggcagaggcaggcggatttctgagttcgaggccagcctggtctacaaagtgagttccaggacagccagggctacacagagaaaccctgtctcgaaaaacaaaaaacaaacaaacaaaaaaaaccaggtgggacacatgcctgtaagttccaccactgggaaagcagagacactgggatcactggggcttgctggccagtgagtctcaccagtcaaccagtcccaggtaagaggccctgtctcagaaagcagtgttggtatatatatctgggttaaacagcaattaatgataaaaagaggctatgaatttgaaagagcaaggagggatgtctgagggcttgccagggagaaagaaatgaaaaatgatgtaattataatctcaaaattaatttttttaaagcagtggaagtgagtttcctacctttagatctcagcacttggaagcagaggcagaagggcagagggtagagggactggagagctggctcagcagtgaagggcactggatgcctgtgtagaagatctagggttggttttcctctcccacacggtggctcacaaccatctgtaactcaagttctaggagattcgaagccctcttctgccttccgcagccaccaactacaattggtgcttgcatgtatgtgcaggcaaaacatagatgtgcacataatagaatgcatactttatgaaaataagagtaacggtagaaaggggactcgttctgatgcggaatctgaagcacctggtgcttctcagaagtcactgagaggaaaaggaaattaaatggaatttaatttaaattaaaagaatgataagaaaaaaaagaaaagagttgctggcccagggctccatatccagcaaagcctttttagcatgaagacaaattaaacacattgctaaatgaggaaaatgataagacttcattgctctagcagcagaagtagagaaggttcctcaggtcagcgtgggcctgaggacagcgcagaaggatggaagagcagcccagcaagaagtgcatggaagcagagcagcccgggctgcaggcgtgtggccgctgacagcagaggctctcgtgtgggtgcacagaagactcagtgtgcagggcagtgcagaggaaggggaaagagtgggcagagcaggacagtgacctttctaagtagtcaaggtatgcgtagttcctgtaacccatagccattgaaagacagagacaacaatgtgagatcaaaaaacctagagataaaaacgaaacaaaacgcattgtgaagcagtacttaaataatcgaaagctctttattgaaaatattcaaaaacagaacaaaaagggaaaaagcctgacacttaaacagaaaatagtaaaatgtcataaatgccaaacacataaatccaaaactgtgtttgcagtaactgttaatgtctaaagagacatttaaagcagtggtgtcgttacagagcaaaagctgcgctgtacagtatgcgcaagtctataccacgacgaggtcagcaccaaacgatgtccatgcagacatcgaggctagcatggctgtgatggcatcaggatgtggctgtggctgcaccaccctgaatgaagcagatgtgacctgcctgggtcagagcagacctcagcaaagacagagagggtggagagacagtgacaaagtgcctgcataggcactggcagcactccaggtcacataccccggtgtccacagacccaaaggcgagcctccaaggaggcggcaggcagagacacctgccaccctgagttccagcctcaggtcccacctggtggaaggggaggactgactcttgatgtcttccaccctgcacgtgcatgccttgacgcacatgcgtccacatgcatccgcatgcacaaagtacatgaaccctgcctggggagctgaaaggaaggtgagaatgcagtacttaaacgcagactccacacacggctctgtaagttcaccttcagcaaggtgagccatgttctgaatgataaaccttagcaactccaaagaatttaaacttcctcaaagtttattctctgactaataaaactaagctagaaatttatgaaaatcaaaattttcaatcacctagaagcttagcaacacatttttaagtcatccatgggtctcaaaagaaaatctcaagggaaattagtgtcatacatattatgtatctggggctggatagttgttttgaaaggatagcatgtggtagcccaagctagcctcagacttaccacagtccttcctcagtcttccaagtgctggaattacatgtgtgtattaccatgcctggatcaaaggtattttcaactaaatgaaaatgaaaatacagtatcaaaagctgcagtattaactaggcctggtggtacataccatcaatcccatcacttgggatgcctgtgaattcagagccagtctagtgcacatagtgtgtgccaggccaaccagggctacatagtgagaccgtctcagaaacagaaaggggatgggggaaactttatggagtttatttaacacagtcttttgcaggaagtttatagcattaaatacttggatatgaaaaaagtataactctcaaatcaatcttcagtagaaacaatgcgaagataataatacaaccatgtttaaagatgtatttatttcatgtatgagtgctctttctgtacgtacacccacatgccagaaaagggcatcagatcccattacagatggttgtgagccaccatttggttgctagaaattgaactcaggacctctggaagagcaactagtgctcttaaccactgagtcatctttccagccccatatatgagtttatatgtatattcctttgcatacttaaacacacttcctccccagccctgtaaaattgtatttttcaagaatttcaatttgtacctcaacacatcccattaatgaaaatgtcaggttcaagaaataggaagaagggctagagagatggctcagcagttaagagcactgactgctcttccagaggacctgggttcaattctcagcaaccacatggcagattacagctgtgtgtaactccagttccaggagacagacaccctcacacagacatgcatgcagacagaacaccaatgctcatgaaataaaaatgaataaattaaaaaaaataggaagaggggctggagagatggcttagcaccagcatccacatggcagccagtttctgaggagtatgcctgcttttctgccctctgtgggggcatcaggcacataagagtgcacagatgtgtacaagcaaaagacaacaaaataaatctcttcaggagagagaataagaacagagagagtgctgtggttttgtgtaagtgggttagtggggtaccaaacccagcaagagggaagaggaaaggtgggtatgggggggttccccatacacagaaaagtcctcagcgaacagtaaatccagcaatatgtaaaatggagaaatgcgccataaccagtggaacacaactaactgaagtcagtcactgtgactggggcgaaggcgcgggcgtcagagacctgctgctctcacagaggacccaggttcagttcccagcacccacaagttggctcacagccatctgtaattccagtttcaggggatgtggcaccatcttgggcaccaggtacatatgtggtccgcatacatacaggcaaacactcatatacataaactttttaaaaatttttaaaagaaaatcagttaatgtagttcagggcattagtgaactaaaaggcagcatactcagataataatttcaagaagataattacaaacgctaaagctataaactaaggaggggctgtgatcttggaataagttcttagatacgtgttgttagattaattctgtttctgtttctgtgagcagctcactcgcctataccctgctgacttcagactcatgctgccctctttgccccacccgcaagtcctggattagaggtgtgcagcatcaccccagcttcagaaccccaagctcctgctctaaagaactgaccaggttggaaagagaagtagggaggaagtatttgcctttaatctcagcacttgggaggcagagccaggaggaccaggacagccagagctacacagagaaacctgtctaaacaggatggtgtgtggggtctgaggagctggcttggtagtccagagcatttgctgctctcggagaggacctggattctgttcccagcacccacatgctggctcaggactgcttacaactccagttcctagagagccgttgcccttaggcctctgtgggcacaaagcacacatgtggtgtgcagacatacatgcagggaaaaccggcatatacataaacaaattttaagaagaagaaatgaaacaggatctcatgcaacctaggctggtctctaaagttgctgtgattgtagatgaccttgaccttagatcatccacctaagggctagggttattggtatgcaataccatgcctgtgcgtgtgtttacactcgaagtagcatagcatactcaagtcaattctctccattttcttgagcttgaatcttgtctctgcactgtactccagcctagctgacccatgacaggcagtctcctgtctccacttcccatctccccgagggagtgctgggatgcaggtgtttgccaccgcagctgactttagcagccggagggtttgcctattgagccgtctccaggctctggtacatttcctctgccctagagttcaagaccatctcaaaaaaaaaaaaaagcaaaacctgaacctgaagatggtaataaatagcaacaaaacagacaaacaggcaagtaacaataacacccgggcacacatccttccttcagaaacacacattaaaagcacacacactgtaatgctgcccagaaccaggagtatagcttgggagaggcatggaacaactgagtctcacactgttgtacacagaacactgggggcggtgggcagggctgcttttagtgtttgtgtcaggagacaaggtcttcctttgtagctcagtccctctacccgagcttccccagtgcagtgaactctgcgctctgcttgctgttcagaatatagaacagcagaggtgctgaagaaatggcagcttcctaccaagtaagatgcatgcgcgcgctcacaaacacacacacacacaccacacacacacacacacacacacacacacacacacacacacacggaccctgcgctcctactctcaggcattgcctcggagggtaaaccgattacacacagaaacccgaaaaggtgcttggagtggttttgtcattgggatggacatccgtattctgaaagctagggaaggacacagaactcagcagatggccaggccgggtccctccagagccgcacacagagcaggcctgctcagccctggctgccttcctctcccaggctcagggcagctctgccatctgccaccaggagctgacagtgacagagcttggactgagctcctcagcagtttttactgagcgatgcctggaacagggcgggtttcagggaactcgcagccaatctcgagacttttctgttgtcccacgtggcacatgtttatggaaaatggctaatgggaaaacttaaactggaaaaaaatggtgatttcaaggttgatgtgagcatatctggtttctgtttcagatcataaaagcggacagcactttctaattcctcagagggcagacaggtaaggaccagtttggtttatgtgcccactatcgccttggtctacagtattcaagtgcattgtatgttgtgtttaacagagctcatacatttttctcttttatggctactcactttggaaataagacggctgtaagtaaattaccgtgtgaaacttaacttggaaagagcccagagctcagttgcactgatgcagagtcgtagccagggatacctccactgtttgtccagttgtcctgctgttttgtgtttataggttatagtcacaggtgtttctgtgtcaggagacagtctgctttgcctttgacaggccctggtgcatttcacattaatctgtgggctatcagcatgtcacggctgctcagcatgggttacaggctggatgaatttgtacattttgagaaatgaatgttctttttccttctctactcaaaatgtttaaaaacataaaagccacccttagttcatgagctgagctaaaaagtccttagccgtgtccccagcctgtannnnnnnnnnnnnnnnnnnnttgtagctgtgagcttgtctttctgccttttctgtttcctctccgttttgtcttgacttttgttttcctttgtgccatggggggaatgcagtggctcacgcgttggacacaggctttcctactgagccacaccccgaggcctagagaggaactgaagaacggtagcttccaccaccctgcggtggggcagtttgctcttacctgactattgggtctctaagagtcctgaccaaagtgtctaagtcttcaatgactgcggctacagaatcgttccataagcagggctatctcctccctcgggtgtcttagtcttctagtgaggtcacggcagcttctgtgcacttgcttaatggttttgtgctttttcttagcagcctggatttgtctgagttggcaaaagctgcgaagaagaaacttcaatctgtgagtatctcttccctaggaaccccagtatggaacccttgttggtccctgttgtcagtcagagttacctattgcatcatagtagctaaattagacacatgctgtctggtctgaatgcagtaaccaagaccaaaagcactttagtatatccaggcggctgactacttcaaacaacccgtgatcttttctgttaaaaatgcagcccttgcctgtgatggtagagaaccaaagttgtgggtgtgtcttggggtcctggggtgtgtggggcaccccttcttggcatttgttacgttactcacatgggataccgaggactaatagtagctgctggtagggcagtgagtctagacatccgtccactgcagtgctgtgactcctgcccatcaatcatatgccgttcctagagcttggtaaatttatgctgcggagagcttgtggcctggacccattgtgtgtgctcagggtttacccagccctgcaggtcacaagatcactttactctttgtcttcccggcaagaggccctttgtctgtctttcccatgatgcctcaccaggtgcttcctgctcaccttgtgagatttcactccttacctgttctcagtggtccctgcatcagaaccaagagccttgacttctctctgtgacctttaaagacccttaggcaccagcttacttcccctctggttaggtgtacgtgcattgttggagcagctctgtgaatcagctctcttgagggcaaaagccactgccttggagccctgcttcaggacgtgtgcctgcatgtttgccttgtctggttctggctcctcttagacttagaacttggtgcttccatgtgtgagcaaagcccggtttcctgccctgtggtttccctccttccctttcacagagatttttagagcctcatacgatatcactatcacataaagtggacttatccttcctagtacttaattatactgtgaaataaatgttttatgcaatttgtttggtgtctctgtgttctgtatctatagttgtgtgtttgagtgtattatgcctttcttaaggaagccacctagtagataaataagatgtcacgctttcgaggcagcgcaagagtgtgtgctttccttgtccttactgtagtttgtaagcaaacttgtacctggcatcagactcctccttgctctgtctgttggctgggctggataccacatgaagcctgaggttatggggtgggcattaaatacataccttgggtatagtttcctatgcccttaagaccttgggctgtctgtgtgtcaggcttgcccagctcacggcagcccccaaagcacagccttccaagaggagcgctgggaaggggacactgtcgggcatccctgttgggcatcccggccctcctccgggtaggtgttgctcttagcagcgcagggcagcactcaaacccccactccacccttttccatccttctctttcttcctccttcccttcctgagtctgtctcatactctctccttcctccctagtgaaaaactgagagaaatataacagaaaaaaaaaaaaaaacaatgtattcttgggttatgaaaatgtctgttcctcgatgtccttgtctgtaaagtaagacagtagtgaactctgtcctgtcctcgctgctggctttggatggtgtccttagcactgtgtctaagatgccactggccctgagcagttctgccatgtggccacgagtgacaacaaaacagctttcaatccaaacccctgcagggtcctcagtgagcgccttctgtggggtttattttgaatgatcagttaatccgagggcactagggaacttaaagaaagatgggaccatcctcagtcacctcgctctctgccagcgcatgctcagcgcttggcatatcccctcagcctttatttcctacgcataccatttttttctttctcgaaactgtagtagcagaatttcatactctgcttttttacacggggcacgaggcagtcagtaaagacacaggatgcaaagcaataaagaggccatagtcctcgagttgcaggatgacagaggagccagaccccaaggctggggcttcagcctgcctccgtggggagacctggatagtcctccagttcctggctgctgtatgaaagtttggtctgtggggctgtgctatgaactgcaccccaagcggcactggggtggggtggcggccacgctgtgctttgcttgataggaagcctctctgcgacgcgtgttgttacacagtggcacccttccccaccccagcagtgcagccatccaatccatagccttgcacaacctgggcagacatcctgacgctgagccccgtcgccatccccttcctgttgtagagcagacataagttctccggacagcagacttctggggtgctggctgacacagggagcaggggggacttgtgtatgagagggtttgtaacaagttactcttgccttctttgtgacagtagcctgtgtgtcaaagagcagggcctgagaaatgctgttctagagctggctttgagtaggaacacccccacccccaccccacccgcccggagatgaagggtgaggccggcacaggcatgctcccatgttaactgctgtccctgtgtccctgatgtgtttattttcagctgagtaatcatttgtttgaagaacttgccatggatgtgtacgacgaagttgacaggcgagagactgacgcaggtgacgtagcatgcggcctacctactcccggtgggcggcggccagctgctggcctgggtttcttcttgtccagatgcccctgtcctcatagcccatgtgcagagacgtgctttcgcgcgcgttggcttccaagtgggcttccccgggtctcccgcccggtgcatgagccgtgccaccgcgggggtgctgagattctctctcggctcctttcttccggctagtctggcttgccacgcagaaccacagtaccttggtaaccgagacgaccgtcgtccctttccttccggtcaaccctgagtactcctccacacgaaaccaggcaagtggctctgtatgaagagttactaatagtattatttggggagtgactgatggcgtgatatttggtgtccttgtggacatacacggaaacagacggtgtgagaattggtaagagaagtacaaacgacacacaaacgtgaggagaaaggataaaagatcgtaaaggagactccaagttgtcggggagcatgggggtcccatgccactgcctagcttgtgggtggcttgttggcttctggtggggtcctgttgctcaggaagctggaacagggggacctcaagctggcagctagcctgggctacataccagggccatgacagagatggtggagagaacgaaatggggtaatttgttttccagttgatccaaagcctcagatgtacaaaggagtcctcagttaaggctatttccaataaaatcaaagcagacacatacatgtggtttccacccttgtgctgtctataaccacagaacactgaagggagcctcagcctctgacaggagggagagaaggaggagaggggttggtgctgaataatggctgactgtaagagcagacccactttatccctaaagtcagagatgtccctccagattcacttctcacgcactgcaaattaaatcactggtactagaagttttctattctggtagctctgaagatcaaagtcagggcctgatccttgcttgtcaattgtcccagcagtgagctatacagccagaaccattttataattcattacagtaatctctgctgtagaaatggagatgttaagtcctctgccacaggaaatattagtgttgactagagagtgatggtggctgagattccatgattgagctgggagacccttgcgtcagctgcagtcctgggcactcgttgtcgcccttcgcgcttacattcttacactgggtaatatttcccattctcttctctcccttagggcagacagaaattagctcggtttaacgcccacgagtttgctacgctggtcatcgacatcctcagtgatgccaagaggagacaacagggcagtcctctgtccaggtcaaaaggcaagtgtccagcccagccccagccgagagcacctgggccttctgggatgcactgtggagtcccgagctggaggtgatggggcagtcataagaacagccatcctgagagtctcctcactaatagactatgacagagaagtacctgttggaaccctgaagaataaggcgtacctcaaagttactacgtataattcacatttattttatatgtattttttcataatcacttattttccccaaaaattggcatgttgaaattaacccaaaagcctaactcttaaatttattaaggacataaagtgaggcgatggagactcttgatggcagctgtcacttaactcagaacccctgcctctgaataagtactgtttactgctataattttaaatgtctgtagcgagaagccttgggatgtccgctgagcatctatttcagaatggctcttacaggccctatctccagacgtagggcccgcttcctcctagccagcccttaagtttgttcttgttttttttatagatacaggaactatgcctttttattttgaggtacttgaacaagatgtttgtaccataaaaattaaggttcctgtcaatatcacactcccctaaggcaggaattattaagtaacagtaatttatgtttcttcttgattgttgaggaatttggtcctatcaatccagccagcagtaaagatgctctgagaagtggcattaaattggtgaggttgcagtctggagaggttttgtataaacttgaaacctcaaaatatgcccactctaaaagagaaataatgagagattccatattgtgtataatgtcaaaaacattagaaacaactaaataataaattctagagaaacagtcacatgattaatgtacagacatctcctggaaatacttcatggtgtggagtaaaacaatacagtctttaaaggtttgctatagtctctgttttgtaaggtgtgtgtattaatataagtaactgtacagggaaaggtgccttccccagatgaatatgcacatgtggttgctcctcgacagcagatttgatgcttgtctggatgtctggctgaggctgaggctggtaccctcctgcaggtttcagtttcataccctgtcactggcctcgcgtagactgctcagtgccatgtttgcctgtgttctcatactttttgttggtgatttcactgctctaacaaaggctctgagcacaatgggaagatgttgaacagtgtgcctgcatgcaagagggctaaggagaggttcgtgggaagctgtgtgtgcacagtgagcatcttcctggtgtgaatggagtggcctcagactgtggtcatgaatccacggtatgtgtcacacagggtgtccttaaacagaagcgtgtgtggactggctcatgataaggctgtgactggcggctctcaggaactgtagtcctttgtctcagtgagtgacaagcttttagcctgtattcactgaggacaagcctgtatgtgtgcatatatgcttagaacagtaactagaagaagcaggccagcgtgtctcagcctgggtgatcgccactgtccctcacgagtggttacagcctctgtattcagtctttgtaccgtatctctgtattggcatgctggtgggttttgttttgtttgttttggtttttgttttttttttttaagacagggtttctctgtatatctctggctgtcctggaactcactctgtagatcaggctggccttgaactcagaaatccacctgcctctgcctcccaagtgctgggattaaaggcgtgcgccgccaccacccggccatgctggtgaatcttaaagattcattgtaaaagttaaaataggaccgctatatcttaagaaatcagaattcactgtccagatgaagctgtctgtaaaacatctttggaaattggagcttaacttgagttgcctcaaataaaccaaaaatgtttggggatttctgaacacttattctaaatgtgcaagagtgtgtaagtcactgctccccgtctgtggaatggacactactgataatgtagacacgtgtgtgtctacttggtccagtgtccccttgtctgtctcacagcctggatgtatatgagtgaccactgctgttcttgtctttgcacctgacttctaggctgggtgttttctctctttttttttttttttttttttggattttttgagacagggtttctctgtgtagctctggccgtcctggaactcactgtgtagaccaggctggccttgaactcagaaatccacctgcctctgcctcctgagtgctgggattaaaggcgtgcgccaccactgcctggctcaccttatgttcttatggctgaagcagtgccctgtgcatgcaaacctgtgacttcccccctcagtctggcagccaccccaaggggtgtggctgagctctgtggtgagtgggaagcattggaactgctctgtgtgactgtcccttaagcctctgcgggcgttgctctttctgtcattttcttcaccctttaatggctaaaccagaaagtcaccttagtagttttttagaaggaaaaatatattttaactctgaagtagtttttctccttctgtgaacagacaatgtggagctcatattgagaacagtcagtacccagcacagcactgagagccaagacaacgaccagccagactatgacagtgtggcctccgatgaagacacagacgtggagacgagggcaagcaaggcaaaccggcagaaggtgagaggacacacctcccacaggacagacgtgctcctcctaaaatgtgttcttgccctggggctgtagctgaatggtggagtgctcgccagtatatacagggccctgagtttatttcccagtgccaccagaagacacatacacatggcagaaaaagtaaaactggcagaagggttaggccttggaaggtgctgtgagagggctcaagttaggctcactgctaactcaagccaagcaaagattaaataaatgctcttaaaataaggccctgtcactgagcaagtgaaggatcagcgttgactctaggctgaggtcaggactggaggcttctctgtgtcccagtgtgcttagctcctcccctcatgacctcactgatggggaagcaggggacaggagactatgcactgcacaggtggtgcgcatcgcaagagcagacaagctggaggttaggagtttggaagagagagcatcaagggaggagctcttgacagtacagggctctgaaacaaggcctcatagatgtgctgtcctgcacccgcgtagaaggcagaacaagaaagcctgggctggaacagcctagaagagccccacactgtgcagagactctggacagcacagtgaggacctcagctctaaagggcattgcagcacggcctcagggctcaggccagtggggcccagggagagagacagggcactgttgagtgaacaggggacagggccaaggggtctgcaggctgaaccctcaggacagactcagataggcactccacagacactgagtaacaaataaacaagaagctaggctgccgaggtctgcaggtttgaagcagggagataagcttagatttgtccagcatttgctgtttgatattggcagaagggacgcccctacctggactgccccgtgccagtccactcagttacaggcagggtcattaccagtccctcagggacggaccatccattgattggctgggctcctgctgccctttcagcctctcgctgagcactgctgctggactctcaggagccctggcctcctcaggcacgccttccagctcccccagctcctccccaggcagcccagccagctgctgcgtcccacccgctccattgtctgtgtccccagcactcagtccctctgtcctgccttggaacaccttagccatcccctttcctgtgctgctggagtgtgagcgccatggatgtagcagcctgtcctctctgtcacagcgcactggagactgactgatgctcactaggtcatgtggagcgagtgaatccatagagtaagctctttaagttagcaaggacagtgtgtgcagggcagcgcagagccttggcagccagtgtccacagaggtttgcagcgctctgcctgctcctgcaggaagctctgcagagtgtcatgagtcctggagtgcccctgcctttcatatggtccacctttgcagtccagcgggcgtggtggagatggacattctttagctgttagtctttaacatcatcatcgcggattgtgaacattttcccggtttatttttagagcctagattcagatttgtcagatggaccagtcactgtgcaggaatttatggaggtcaaaagcgccctagtggcttctgaggccaagagacagcagctaatgaaggtgaataacaacttgagtgacgagctgagaattatgcagaaaaaggtaacatgttaataaatgccaggatggttgactcgttgatcccggtcaccatgcttatggtcagagggaagaaaacatttactataacagacatagacatactgtcctcttgaaagcaggctgtgtgtgtatgtttgaaatgcagcgctctgatgagaaacgtgttcagtgtagcacagagactatagcccagtggtgggtggtgcatctgcctagcatgagcaaggcctgggccagggcctgtgcttggctgggattctaattcagtgtatgtatggacacaaagccttgggtttgcacctaaaaatgcattcagagtaaactcccctaggagagacctagcagcccactattggtgtgagatagcataactttgccctgtcctgggctttctgggaatctggaagctactgcttgggtgtgattttccacacctattgctgattcttaaaattaatctcaccatgcagacagagcaggcagaagcacgtgcttctcagcgtaagccctggcacgtaccatgtgccgtgctttctctgctggcactggctctgactgctaccctggcaaccctcgccagcatctcagcctgctgtcaccacctcgagcagggcttgacacacagaagactgccacatgtctgcctgtactaacaaggagaggcaacccgtgtacgctgcactatcctagtcattcccccagggcagccgttctcaacctttaggggacgtcaagcaatcctttcacaggggtcgcctaagtccattggaaaatgcagaattacagataggaagtagtaacgaaataattttatggttaggggtcagcacagcatgaggaactgtgttaaggggacacagcgtcaggaaggttgagaacccctgcttcagggactgggaactgcctgtaggagaggtcagtggggaaggcagtgcttgggatgatgatggagagcgacagatgggaaagccagctgtgccctagactctgggcaccgtaagcatcgctgactgtcgtgagaaaaagctcgctatgcaccccacgcagaaaaaaataggctggctttggggtttatactattgttgaggaacgcgatctcagactcagagtattgtaaggcctggtcacaaggtacatcttctcaaggaaagccaaagggctctcccactggctagggagcactcccactggctagggagcactcccactggctagggagcactcccacgggctagggagcactcccacgggctagggagcaaggttgtgagagctctgcagtcagtcagtggctcttgtgctgtagtgcagaggctgagagactgagctctcgtggcctagcgccccgacctgccttgcagccccttctaggctagtgcacagctgcgaccaagagcctgagaggcctctgccgcagcagaggcctgacatctcctcggccttttctgagcagggtcacacagatgtggtagttaatgcagtcaccatcttaccagcttcttgggtgatttgtttttctgaaacttgcctttgattgttggtctgcggggcttcacctttttacccatagttctcctttagtgttcataaaggttacatgtgctggggagatggcccaggtcaaacattgaaagacaagaagaggactgaagtccagacccccagagcccatgtgaaagaccagttgggcacagtggtccacctacagtgccgtgcagcaagagcagtgacagggagtccccagagcaagcttccagccagaccagctaacctgtgtgctcaggctcacagggagagtgattgtgggagataccagtgctccactcgagcctcccatcacatgtgtgtatgcacgtgtatgcttaagattaataaagaaaactcagtgttggctgaagagatggctcagcaggtaaaggaacttgacagctgcagaagctgacagcttgagttcaagtcccagagcccacagaaagccggagaagaagcctcagagttgtcctctgacaccacacgcagacaccaggcacatgcagacacagtcagacttcatttttattgtaattgctagagacagctcgaatctcttgaaagcaagtgtctagagtttctctagagcaagaattggggagagacttagtgggtaagagacgagtacccagcctgatggcctgagttcaagtccctagactccctgacctccacatgtgtaccgtggtgtgcactcaccctgacacacatgcacatacactcagacaagccaagtgttgacgagcagagccattgtccattattatcatacagatgcctgtgatttttaaactagtgaattatctgtaactttttatttcctgccatactttttccagagtacagcctggatcttttttttttttttttttttttttaaagatttatttattggttatatgtaagtacactgtagctgtctgtcttcagacactccagaagagggaggcagatctcattacggatggttgtgagccaccatgtggttgctgggatttgaactcgggacctttggaagagcagccgggtgctcttacccactgagccatctcaccagccccagcctggatcttataaacattattaaaatctgtcttaggacatttttataaatgcagagtaatgaatttggacacagccctgtaatcccagctactttggaggctgagatacaagaatcacaagttccttcttgggctaagaactagttcaaggcccgcctgagtaacttggactctgtctcagctcctgggcatgatgtaccagggggaggctctggtagaccatgtgcctctgtgcttgaggccctgggttaaattccgtgtgtaggggagaggctgaggcgactgaaaccagggtctgtgctcatctcagaaggcagctggccagagtccagactgggtgtttcagaggtagcatcagtgttcagggcgtttatactttcacagcctgctcagaatagcacagagagcttttagctcaggcagacatatgagccctgcatctagggatatagtttcttgtattattccctctctctggaccccacccagtttccattcatatcccgacagcccacacacttgtctgtcctggaatgcaagaatttctagaggctctccctctttgcaaaggaggttacatatataggcggggaagccatgcttgtgtagaggtaggcactacagatagagcatggggcttgttcacaaagcaagggtgtactgtttttattttaaagtttgtaatagagttggcaaagtagtgtgatttatatctgatctttcacatttaacatttgtttggaaacgatgcaaattaatgaagagggtcagccactagtgatgtatttcccacagattggtgctttctaaataaaacttgaaagttaactcccaatactgcatgaccttgctattggacagtgaggaccccctggtgcagacatggttgcttacggacttaaaccttggcactggatgacagcatggtcaaagtgtacgttctctcagagaaggcagttggactcataccatccccagcttatgctacacaaatgcggggctgaggcagcacagacacggtcacttgtatttaagatgccagcctcataattccttgctgatctctgatctcatgaagcagctcacgtgtgaaaattgcaaagaatactcagggtctctgtgtgtcagtgtctaaccaaagtgagctggcaccaggtagcccagcccactcaaggccagcatcactaactgcatgggtcaaaggagagcgaggtcaggtcacagccctgcagcaaaacactgatcaccaagggaagccagtggacctcgggagtgcccttctcgtgaggacactaacctagttcaagaggttgccggtttcttgtgatacgttaaattagcaaacttaccatggtttggtcccttatattttttttaaagatgtgcttgaattgtttagaatatcaaaaatgctacataataaagacatttttatcctaatttttcttgttggcgttttggaaagcaatgggtgctggaatttcccctgggctgacctcaccttttcttgctttgcactttgggctgcttccatggcatctcctgtcacttccccatttgcagatggctcagggccgtgtgaagagtcagagtcaatgttctgaatctcttcctcgagacagctttagaatgacccagagtactgctggtctgcacatgttttctggccccaccatgacaactctctaggcgggtagacttgaatttctcatgagcctgtaggttattccggaaggaggaggagttgtcatggcttcgccttgcagccccgctagctttatgtcctcacaaggtcgtgttacgttggtgtacttgactttgctttgtctgcctggtgtgcaaaaacacagacccactgccaaatgtttctttcagcttcaaactctccagagtgagaactcaagcctcaggagacaggccacagccagtgcctgtcaggtgcagactggctctgaccacaaggacactgcaagccactcgtccctaaagcgacggccatctgcccggggcagtagacccatgtccatgtacgagactggatcaggccagaagccatacctcccaatgggagaagccagccaccctgaggagagccggacgagacttcaacccttccccacgcatgtgagtagcactgctgtgtgtcccatttctgctgtgcagtctgactgtgtgttccctcctggtcaagccgggcttgaggactgaaggggcttggctaaagttgggcgttctggctctcgctcagcccctccccttcagttcctctgtttctatgatgtcattcccaggcagcctctgttggcatgtgttgtgtagagcttccttcctgagctctacaaacagaagccagttgtaaaggtcactggcagaagtgtctgtcttcatcataggcggaggctggggctggagacatggcccagtggtaaccacactggctgctgtcacagaggccacccaggcggcacatagcccactcccaaccagcttaactcttgctttaggggatttgacatttcctctggcctcccagggctctgcatgcacacggcacacagacaagcaggcagaacactcatacgtaaaatgatctttttaaaaacaacagagtaggcagaggcatgccctccttatgagctggaactcccctgtgactggatacatagagttgagagagtctgggcttcggcagcctggttactgacctcacctaggctagtagcatgacttggacatttcataaagatgcagtgtaagcagccattataccagcacactcaggaagctgaagcaggaggattgcctggaccacataagatcttatctccaaaaaaaggaaaaagaaggaaatatgtaaataattgaaaatgtccatctgcccacagtgtctgctctgtggtaggctctcgccgaccacagtggtgcacgtgttgggaagccaagttttcaaacattaaactagtctgtcatttggactgatctattgtaaagataccggtttccacagagtgctccaggcataaactgccttacgtagttcttccttcagagtgtggtattcatcctttggaatgtcaaaattatttcttcaaagtacatagagttcttcaataagcttcttagggtaatgtgaagcagatgataagatctaatacatttggagactttagcagtgtaagactgcagtaccgtatgtatccaggaatccattgtctcagcttctctttatgtgggtttaatgcttgaagaccggtcactgacctgactgatgttctcagtgaaaggagcctcgttttcatagagctgagaacaaaacttaggcaacctcaccttggtagcttacacagtgcacttgatcctagagggagtgggtgtgaggctgtggctgtaccgcccagtctgacctgaggaccagggtgatgtgcacacctgttcagagtcgtccatagcgctgtgtggttttgtccctcccaaccgagagcaagcagcactgtaggtgctaacagtgagtgccaagtgtagctacgatggcggtaggatctcttccttaagcacaagtggcctcttcagtgcagagtggtttccagcaggccacttgcctaattagggatcattgccacagctgtcaccgagctgagggacatgtgtgagctgtgcagtgggaggtggggacgtgtttgttttatgttttcccaagcgtgtttctctctccacttccagattgggaggagtgcacttgtgacctcctcttcgtctctgccctccttcccctccacactttcctggtccagggacgaaagcgcccgaagggttaagtacactctgactggtctgccctggaggagggccagcaccccttggctttgtgcccccgccccttcctaactgccctctgtcctgcatgaagcagctttgctcctgggttctcatagcagcaggcacatgcagccgtgcacatccggcctggagagagctggccttcctctgggcctccacgctgtgcgccttccacgctgcctctctcacctgtctaaccacctcccagatcacctagagcacatcttccgagcactgtcgtgttaagctaactgaacttgagctggctactggtcacagagagcagggcagtccacccagggtttttgagatacagttatgaaattaaaagtatatttgggttagcgcaaaagtatcttagcttttttcttctaactgctgacttactttttattagcaccattaccgctgacaagccccacctcagttggtactgtcatgcagaggagaggtggctacaggcttaaagctgtccacttggaatggtaggccggacccttctgctggtgtgtgactcacgccagtggactccctcacacccacctttaagaaaggcagctaaagggtgcaaaagatttaagtgacatcgtccctgttcccaaacagacattgtgtaagaagaaaactcttttcatgtgcacagagagcatgctgctttcctcttgtgggagactggggcaagccctagtgttagaggcctgcccttcggctcctagctcggtctgtctgtagcaagggtgaaaaaaagtagggaactgcaagcaagacaccaccttccccagcaagcccccgtgtggggaagaggaccctgtgcactgccaggaccctgtgcactgccggggccactggctcaccaggtcactctgagtttccttacagcccttgtgaagtcagaggacttcttgaagcttggcacttctggtgttctgagcagccctggaagggcactgtagtctttgttccaaatggtagttacggaagagcaaagaaataaggaaatcccgcagtttgataataatgatgttgagagtcaggtaggccggtcttatcatacaattttgtagtttttttgatttgtagtgtggtagctttgaaagggaccagtcactgaagtgattctgtcacagtgagcagtgacgtcatccagggtcctctgagctcctcctgggggctttgtcctggcttaggtttctggggtttgtctgtgcagagaagtaagagcagctacaaggtaacactcgtgttaacagctttaacactcctggctctgcatgctcactgtaacttccataaacttaaatgccggctcattgaagtgctgtgcactttgacggaggaggacttagtccgtcagtacttgtgcgctgtacttgaggagcgtttcctgaacgctgttagtggaggtgtgtcactcttctgagatcctcaaacagaccctggcacttctgatcactctgggtaatgtattcaatctccaactgtcaccgtgacatcaggggaggcagcagcatcccttagagagatacaggattccaggaggcaaaagattgcaaatttaagataaacctggcctacattagcaacactgtctcaaaacccaaaatgtaagctatggagggtgttagcactgtcttctagatttctctccccactggagcagtttcaatgaatgaactgtccagcataattaaaattcagtttgtgtgtgtgtgtgtgtgtgtgtgcgcgcgcgcgtgtatatgtctgaaatcagggtttttttgttttttttgtttttttaagtaaagattagtcagacattcctttacaggtaggaaaggtcttaggggggcagatttctgagctcaggaccaccagaccctgctctctgcccctgcacaaatactgtgtcccctctctctagtgtcagttacccgctgacttagccacagagcaggaagttacaaacttcttcgcttgataacctcataaagccgggcgtggtggcgcacgcctttaatcccctgctgggtgaagtgcagtgtgtggaaagggtcatggtggaacttaggaagccagccccagtgctcagtatcgtccatagagtgggaaagaggatgtccaggggacaatgtgagggccttgggaggagggggagcaaagcggagcaggtctcaagacgccactcctcagccggctgaaccccaggctcgtgcagactgccccaccgacttcctctagcagccatttttctggataaggctgcacatctcatgtgacttagcaaagcctctacagtcgcagcctttgccacctttccctgcatcagttaaactacctacccgtgtactttaataaccatggcttgaatgctggctacacggctggaaatagctaatcagtaatcagtttagattgctcatcggcttatgctgccatccaggtgagggattgtcacaccgtaagatgaacaacgagagaggtttcttcacacgctccagaccaggctcctccagaggatgccatccgcgccacaccccctcacactgacagaccccacctctagtgctgctgccagtcccgataaagctcattgtaacctccacagttagacctaatctctgtattttcagagatcaatattttggaaaacgagtaaagtggtttggaactaaggctcttccagggttaatccgtgtggttcacaggcagcagcatgggggctcacaggcagcaaggcttccttgagagctcatgaaaaccctcccttgggtcaggttttagcaggagcagtgcaggcttcccaaacatgtagtaatggagggacccgcagagggctcctgtcctctcctttcgcagactgtgcctgaaggtgggcagctagcttatcctggtcctgctctcttctgctgtgaaaccaggcaattagagcctgctaagtccagctctgaagtgtgtgttcagataagtgtgtttgttactgactgcacggcacgggtgtgcatgtgtgtgcgcgtgtggctgtcagactgtgggaggcaccggggtctgtttaggacttgttagtgaattaagaagacatggcgcagaagtcgaaaaggcacttttggacctactactcactcctctttactagatttccagtaaagggctggttcctgtaccaaatgcgctctgggtatgaaggtgacagagcctggcgggcggagggatgctcaacactaatgggccccttctccttttaggcctccagactggagaagcagaacagcaccccggagagtgattatgacaacactgcctgtgaccctgagccagacgacacggggtacgtgtgtgaggcagagggagcagggacacggcaggcctcagcacccgcggccctgtgtctgtggtcataaactatgtcttctgttgctcacactgcgaccttcgggctgtttgcccttgtgctgacatgcaggatccgctgtgccacacgaacgtgagccactgtccacctaagtctcccaagacactgcgcctgcagggatggctgtgtgtagctgtgcccctctgtcagccatcccctccacctccttcaccctgtccacagcagccctaacctcccacccaggagaaaggggaaagctcctaggatggctgtaggtgccgggtaataagcagagcccatgagcctcccactgaacaggagaaagcagaccacaggcacagcctgcttgagtgccagcggtgtgagtcacagacgcaggaaccgccagtgcatgcttgtcatgccgtctacatgcagctcttacctgttcgcaggtcaacccggaagggacggcagcggagcatgctctggcaaggtgatggcttattgccagatacagcagaaccccactcggtccccagccccaccctccccagcacagaagacgtcatccggaagaccgagcagatcaccaaaaacatccaggagctcctgcgagcagcccaggagaacaagcatgacaggtacgggccgccgctgcgctctgggagggggttcccaaacctaagcatcatattagtgtggtcctgtactgctttcatcatgttacaaagaaatctgggggctggagagatggctcagtggttaagagcactgactgctcttccagaggtcctgagttcaattcccagcaatgacatggtgactcacaaccatctgtaatgggatttgacgccctattctggagtgtctgaagacagctacagggtacttatgtataataaataaataaataaatatttataagtaaataaataaagtaatctgaaagtaaatatatctagaaacaaaactgactgcagtgtaccaggggcaggagagaaaccgcctcacagctggcaagcaggccggtcttctagccactgctgcgccaagattccctgggccaaagcttgcagagctgtcctgagtggagctacccgagagctgtctgctcccttgtgcacatagagttgagcatgttaacatggtataaggtgactgtaccttcctgtacagagcagagtgcccacagcctctaccgtgcacagcacagcctgagctcagtaaagaagtcttaaacaagagccacgcctcgagggctcccatctgacggggctctgtgcttgactccttacacagttagaaacactgctgggctacaagccgcacttcactgatcgctctctgatgctgtcagaactataaatgggtaccctgtggccatttctgcctccaaagattacaatatggcatttgcttcgatttggggagactttttatttagaaattctgtcagcaccttttatgatttgctcgcctttgctttgaaggccaggagaaagcggtgatctcagaaccatcggcttatgctcctgaagctggagccagccggcctagagaactcactctctattaacgtcatgggttctgtacctcccctgggacgcgtgctgagctggggcagcctcacccctctgcctcggtatcacacgtgtctgtgtcgtgtcactcacggttgctgaggtgcaggcttgccagggcccacctgcacctccatctgggttctagctagccgagtccaggaagttcccctcactgcccgtcatcgctcctgcagcctcacttgccagggtcatgtgtctgtcatctcaccaacacacacacacacacacacacacacacacacacgccagagtaatataaaattacaaatagagatggcttttaatggattttatcagaagttaattttataatctaaaaaaacagggaaagaatgaaagaatgttacttgagactttgggtctgtgacagttaggaacagctttgccaggccaaacctgccacagccttggctgtgtttccttgcagaaagtgcccccagaagtgctttgctctccctgtgcccatgtccttcccaggcattgggcagtcctgcacacggagccatggctaggtggcagtgttgccttaggaactggccctcggacctgttggtttgtgtcctctagcacacagtcagtcctcaggcttcaaacctgcacgataggctacagtgagtcagccacctgctgctctgtcagtgcagacggtcagagtccttgcagagccctctcagcacacggcagccaccatgcctgtggaaagagacagaggtgagacaaggtcgcctccttgctgctgagatcagattgtctgtgggaacagaattggggggaggggggctcagtggccagcggcaggacggtggcatataggtgccaactgggatttaaggaagtgtcctcagccctttagttgtcatctttatagaccgtaacatggacccttgctcctcattctagacatctggatggcaggcaccaggcgtaaaagagccatggctctctcacctctgtcgccccagtcacagactgcagatttcaggcctagaactgtttgtttcggggtgaatgtgtgttcgtgacaggatggggagcctgccgtccagcgtgcacatagggcaggcacagcctccatcccttcattaaccaagtagaggtggggcctgtccagcctctgaggactctacctctcaagtgtttgagctgcattttaacagcttctccgatatcttacagctatattccctgctcagagaggatacacgttgctgtaaccgagatggcagccctgttccccaaagtaagtctcttcctgtttatcttcaaatgagctgctagatgctgcttccaggtgctctgggccctgtgtcatctagggaggagcccagagcccgtgcacaccgggctagcgcagcaccgcagagcttcagcccctaaccttcttctcacgttcctgttccacattgttttcaagtatgccgtctcaaggggctttgagatgttttcactgtgcaggaacatgggtttaataagacatcaatatttaagtcaggcactgcaaggcaacgcaatggagtttaggatatagcacctaagcttctcttcgtaggccacgagttgcaaagctgataatgtttaaaatgccaactagctgggtggtaatggggcatgccttgggaagccgaggcaagaggctaacctgatctacagagcgagttccaagatagccggggctacacagagaaaccctgtctcgaaaaaaaaaaacaataaaatacccagctgaaagcaatcagactttctggggcagctcaggttgctcttgggaactggctcactccatgttgctgcctccacaccctgcagcccccagcagacggctctgctttcatttcagaaacccaagtctgacacggtgaggacttccctccgcctactcacgtccagtgcctaccggctccagtcggagtgcagaaaggctctcccaggagactccagcttacccacagatgtgcagctggtcacacagcaggtcatccagtgtgcctatgacatcgccaaggccgccaaacagctggtcacaatcaccaccaaagagaacagcagctgagctcgggtgctgtctgcctgcccatagactatacacgaactcttcagatttttacaaaacatttaatgatgatttcagactttttaaaagaaagctcagtattattttttgcatgttttctaacagatttttgactgtaatttaacccttgccttatttgtgcctatttgcaacttagttctgtcctgtcagattgtcaccaagtgcttaggtcatgaccccatgtgttcaaaagtcattgttccaagtgtgttacaactttcctgtcctttacaatctctacccatgcctaaagctataattgatatttttagtaaaacattttcttaagagataagaaagttggatttaaaaacaaaaacaaaaaccccagcagcagcagcagcatccgtcccttccaagcatcgtgcagtcaatcaggaagcttcccttccatcctgtggggtctctccatgtgcacgaggagcagagcttcccacttcctagagagagcgcatctcttgggagtgacaaggagcggatccatttctaactcttgtatcatgttaagtgttgtcttatttaatatttttatcttgattttctatctataaagattttaccatcatgctgatgtctccataatgtccaaaaaagtagttagaaatccaccctttacatcagcttccagtcggccacattcagagcaggagcaccgcccactgtcaggggcctgcttccccgccaagccagacagtttacttagaaccctgagtcagtttcacaggccgtgctgctgacatcctccacacggctcctctggaaggatgtcttcccaggtaagacgcagggcctccgtgtccccatcccctcacgggtagttcatgattagaactcctgtggcgctgcacgaagagttccccgtgtgccctagctggtggcagctcccccacagctccccaagggcagaggttgacacccaggccaccgcagcactggcgctcgctgtgctgaaggcactttgtcgatcgcttctgcctgggtggagctctggccctgacctgagggagcaggcagtggctatgttgccagccaggtgcacagacagccaagggcggctagggaccccacccagcctgtgaggacagcagcttgtcccactcatacccctcatgcagctgtagaaaagtagcctgtggctgccagtgctttggtttttcaaggaaccagaagtttgagttatttcatgacatttttcttttcttttctttttttttttttttggtttttcgagacaaggtttctctgtgtagccctggctgtcgtggaactcactttgtagaccaggctgtcctggaactcagaaatccacctgcctctgcctcctgagtgctgggattaaaggcgtacgccaccaccgccaggcttcatgacatttttctaatcagaaatgtggacagtcaatccagacatgcccactgaacaggctgcccatctcagcctccgctggggtctgtaacctgcacatgagtgaacctgtcagccagccctggaaggcagcatcagtctcccatagaacgaccaaagtgaggtgacctcagtatgctgagcctgcctcatagtccctcttacaacatggccaatgcatcctggagacagcatcacctcaacgtgaggctcacagctcggaggaaaggctcagcgctccaggggcctgcccactcatcgatacacacaagcctaagtgctggaggatgtccagcagggccttttagaaaggggccggccagtgtgagctcaggcatcctctctgacaagcttttctgcgtgctccaaggatgactgctcttcctggcaggctccctggagctggttccagcctgagctggttcccaccatccccagagagagcaggcctctgttggaagcttccgggaagagaactgttagaggtggagtggtgcagtcccgttaagtcacgaagaagaatgctgtccttgagaaatcaaagaacacggggccagtacagcatttccagacgctctcaagaacaccagtcagtcccatgtcctcctcaggctgaaggccctgtgtggaggcctgaggagacagcaggaggggccccacacagtccctcctgagacctggctggggttagagcatactgttcctgtgggcaaatgcgttttgtctcaaagctcgccctggccgtttttgggttttttgcacgtgggtctcatcgcctcgcaggagtgagctctgcatccaatctggctgctctctcccctctctgggattctgccttcccacctgtgtaccccactttctaagatggagaggatgaagacacaattaatggagcaggccctgcctcaagctccgttcccggaaggcactgtggcctcagcaccacggtctttacttgccaaagacgaagtccagtgttgcgtgcactcgggactcttaacggcacagcgcaggggctctgccctgacctcagtgacttccatcatggaatgcagcctgaaagccgcgtgttttcatcctccacagcttcggtgggctcgcagtgcagtttcctttccttctttgtcctagctggctatcacccacgctcttacaaagcaaagtgcagcatagagaaaagagcattgcatacctggtgttaagccccctcgctcctcctcctctggtggcttctcagcatcctgaagttactgtccctgcctgtaaaatccttctggaatctgtgccccactggttatgcaataaatcgtctctttaagtgtgtggtcatgtgccccctctagttggtggatatttccagactaggtgggctggggggttgagatttggtcttttgttatctattgtaaagctaagtgcgggctcccaaaacctggttgtcccagagacaagagagtccccactgaagacattaggtgaccctgtccccatgttaactctgattggaaaatagagattccaataacggggcagaagagacataggtgaagtttgggtttcgagggcttggggttggaggaggaccatgaggaaaagaaggcagcaggagggggaatgagagcagccatgggttaggaggaaaaaaaaatggctccgtgggctggccaattggagttaagagcagcccagatagccgggcagtggtggcgcatgcctttgaccccagcacttgagaggcaggggcaggtagatttctgagttggaggccagcctggtctatagagtgagttccaggacagccagggctacacagagaaaccctgtctcgaaaacaaacaaacaaaaataacagcccagatgaaatatagtaataacttggggttgtcagtaggaaatagatcctaacagcatagatgggtagacaacggcctgactttcatactgtttaaggttatggtgaatatgagggttgtttgtgtctttcatccaggaacctaaacaacaaagtcagggtagaaacctcagaccaagattaaatactttctgcaacagtgggggcaagctcccatgtggctgatctgtaaggagacatggtttaaggagacatggtcttggctcagtctccttcctatgttctctgtagcctgttttgttttgtatttgaggcagggtctcatgtagcttaggcgcaccttgagctgtcatccccctgcctctgcttcctgaacactgggattacaagcatgtgccaccatgcccagctcttcacccatgtatccatctaacccggtaagcttaccccagtcatttttaggtcggcccaggctggccccgcacatgcgccctccttcccaacaggcagtcgggtgataaaactaggcccacagtggggccaaccttagccccaccagcatgttttgagaagtgacttggtacttcagatgaaaggaggaggagacaaaagaaccattcctgggcctctccaagtgaagtctgagcaagatgaagtgttacatataccctgtgtggcccagcttgccaggagagagggcctacaaccctcaggttggagccaacagctcacacccagagtgctcctgagccaggttcccaagaccgcctgcagagctgctgagcctatcccacacacaccctgatctgactgcatgatgtgggcgctagagctgttgccaccaccgccgctgccgccactgcagatcaataccatgccagaaggcattgtgctgctgcaggcagactctgtgaggtccatgcaccacacagcacttccccagctctcggttagccatcgtaattccagctgcagttggctgtgtcaggcgttgctctgttctttcggtgggtgacttcttgggagtaccggggagataccttagccagtaaaggtgcttgcctcgcggcctgacaacctgagtttgactcccaggtcccacttggtagagaaaatcaacttctgtgaattaccctctaaccccacgagtgcactgtggcatgtgtacatccacggacacacacaaaataaccctctacagtcttctcggtaactcacagaggaaggtgcatctccatttgacaggagaagaagccagcacacaaggaggcaaactcgcccagcctggggaaggtgaggaatgttgacagttgatatacctgaggcagagaagccactgcgggggcaccactaaggctgctcaaacaaatggctctcagctgtcagcctggggcctccctaacagggtctgggctgcaagctctcaggccggtgcacccagactgcctggtgtcagccaaggctaacagaaaggactgctgagcctacccactgggtcagcactgtgcaagcatgccctccatctgtagggtgagcacagtccatctcacacagagggacccaagggtcctgcctgctacccagcaagccaagggtgtgaggttgttcaggaacgacctctgccctctgaccttcaaccagactgcaggtcctcacattcactcgctttctgtatacaggcatcagtcatgaagcagggctccaagaggtaggtatgatcccagcagcacccctacatccaaccccctgtgcacacctggcccttgctccccattctgaatactctacagccccctcttttctttcttcttcttttttttttttttttagaaaaaaaatgttttaagaattatttattttggggctggagagttagctcagcggttgagagcactgactattcttccaaaggtcctgagttctattcccagcacctacatggtggctcacaactgtctataataagatctgatgccctcacaactgattcttcagccccaattaaccagaaccacataatcttttttgttgttgctttgttttttgagacagggtttctctgtgtagccctggctgtcctggaactcactctgtagaccaggctggcctcaaactcagaaatctacctgcctctgcctcccaagtgctgggattaaaggcgtgtgccactacgcccagctccgaaccacataatcttaaaacagcaaacagccctgatagagtctttaatgttccctctaatatgtcacaagccaggcctcatctgcactgctctcaacattcttatcttccaggctcctgcagaacatcccagagccctcaacactcaatggctcttctagcccaaagttccaaagtccttccacagtccttcctcaaaacacatggttcccaaaacacatggtctggtaaggtctgtcacagcgacaccccactcctggtatcaatttgttttagttagggtttctattgctataatgaagcaccatgaccaaaatacgtgtcttggggaaagggcttatctggctcacacttcctgatcctagtccatcattggaggaaatcaggacaggaacctggaggcaggacctgatgcagaggccatgggaggggtgctgcttattggcttgctcctcatggcttgctcagcctgctttcttatagaatccaggaccagcagcccagggatggctctgcgcacaacgggcggggccctcccttattggtcactgcaggtttgagtgtgtaaaggggatgacgacaggctgaggaaaagatggggttggggagtaagtccacatctccttcatcaatatgggtgaggcgggagaaacttgaactctgggttggtgtcaggacagatggcatcgacttagctaagaacacagagagcagacagaattctgggttgtgatgggagtctggactcacctgatgactgcctggcaccggacagaggctccacggtgagggcatgagagttgcagaaagcctgcggccccgtgaagtaccaatgtggaggttactgaaaaccaaagcctgcctcatgtcaccctgaaaggcctgggaagtgtcaggatctgaaccttcagggctgcactcctgacatgatggaagaagccagcgacgctgcaggtaagccagaggtgctcgcttgctctgtgggcctgtgtgtacagtgataattctggaattctggtttctttaaaacacacaggaatatcctaagaatgtgctttcattttacccacaggggtagggggtggggccgcttctgtttccccagcccactgatttgcctcctgctctagcagaggtatggtttcgccagctgcagatagtttccacgattgtgtgatgagtttttcagagggttgataaatgctaggggccctgagaagtatggtcagtggttggtgtcatttagggaggttgttatggtttgttagttgtgcccaaagaagaaatgtaagaaattagattcagggatcttctcttctttctttccttcctacttagtggtgggggagaaatgggggcaggagggataaattgggaaaaagaacccacaaagtagcaaagaccagctgtgtgtgtgtgtgtgtgtgtgtgtgtgtgtgtatacacgtgcgtgcatactcgtgtacttatttacaagtgtctttgtactccttctactgtgagtctcaagtactaaactcatcaggctttgcaacaaatgcatccaacccttaagccatcttgcgaaactaatttctattcacagcccagaaaggttcagaaataactctgagctggcagctagaagcaggtggtgtggccagttaggtctaagtgctcagtgcggtcttgggagtcatggctcgggtggcatgaacggtggcgaggactcttacgcacaccctgcctacggtgcctagggaaacggagcgctgggcgtttggggaaaggaacacaggggagctgcggagtgcaaggtagggcattgtagcaactgctcacagagcgcacaactgtgtcctggtgaccataaaggtccccatcctcaaatcaagatgagatgtcagactccacatggctgaccccaagccaggtcatggagagcgtcgcagtcctgaaagcaactgctttagttcatgaacagaaagctcctaaaacccgtaagacccaggtggcgggaaagctttctgtccataaaggaacagagctatgttgacttcctgtggcaccacggtctgtctcaggctgtgctgtccgtgtgtccgtggcgcagtgcagtatctgattcctgccagagacttcctaaggcccggctcccctagggagactgaagagagcagcctagaggacaggctgtctgcacagagcttccattagtccatgcccttagctgcatcccatctctatacagaatgatcgttagaggaacggactcaagagatcttggaccactttaagtcaaacagggtcctgtgctacatgatgacatgccagtaacacccagcgcccaccagcctaacacactagaaagcagcagtgacagcctgaggtgatactgagatagagctttacttcagttagtgagcatttgacgagggcgagtgctcacaaatgtgtagtggaaacagagctgggggccacatccaaggacctcagcaggaaatgaaacaggctgagaaccggttccgtgatggaagggaagtgatacagccctcagagcccaggcaaactctcggttcccataaccaggaacaacaccgtatattcagctagagtgggcagaatctggaatataggggtgaaagccaactcgaggaaggctacggaaagatacaagccataacaacccgactgtcgccatgaggacccatggccacttgtattgggatctaacagtggggacaagctcatctgtgattccgagtctcatgccatttctccagggtcacatgtctctctgggcacttaattcccatggggctgcacactgggcttccacagacacaggaggtccctagtcaagcctctgcctttgtcggctagccaaccaagtgaccttgaggactctttcggggtggcacatgttgggctcaagtgctctgtaggattcttttcttcttggtggtgtggagctgggcagaggaccacacaagtggaaggttaagtactccacgctgagaacccccaacccctaggggtagccctcacaacacttccaaacaagggcgcctttgtcaccggctctccagactgccagctcttccacagtacacacatgggccttggggctacacagctcataactggcaataactgcaccaagacctatgagccctcaatagaataacttctgaacagcaatttgaaaacctaaacagctccctcctctctgtggctggtcctccctgagctgacagctacaggtgagatgagaggaacctacgtattcctgtcatggtactcctgtctgtcagggaacatgacttcttcttagactaactctaacatgtacttataaagcattcctgatctctggcggcactgaagccaaggcctgtcggggtgagaagggctctcaggggacgctgcacacccatggcatcctgacatctatggcccatgatgtgcctgacaggtatggctcaactagctagcagcaccctgagcaatggccagcaccaacaccgtacaactgtctggagcggtagtgagtcggtttgcttctctgtgctcaacgtcagtcccaagcaattctgaggtgtccgtgaagctgaggagagaaagcacataacattccctcaggtcagcagtctggaacactgggaaccgactcccttttctttaggagcacacaagtgggttttcatgtaccgctgagaaagccttgactctgggccataaataaggctctttatgacctgccctgagacacttgcgtgtgctctgtgaagcgcatcctgacacactgatgcatgctcgggtgactttggaaatgctgttccctgtgcttagagccctctgtctatagggctttgaggctctacagcaaatggaagacccactctagccttacgcctcccaggccccgggttctctgacagggaaacaatgaatgctctctgcagcacacacccctcagaatgccaggggccaggcggccctagttccagagagcctagtcagcaggtccctcacaacagacatgacagcctttgctcctacatgctccatggtgccctgctcagggctcacacataaggatgctcagaaagagacaaagaacagaggaaaagggggagacaggtgtagatctcttggtcacctggcttcactggcagctgggacctgatccggctgtcacctctcaccagttatggccagggctcttctagattgcactctgccccccaaccagcagtcagcctctgggtctttgcaaaggctgaagccaaggggatcagagaagaacccttggactatctgaagtcaagtcaaggaatgacagcctttgaacagaggctataaccagtcgggacagacagacacagggaggagacaagaagagctgaggatggcaccatgggggctcgacacctggcaggtacccaccttgggctgatagcccttctctgccatggtcttcgcctcctgctgcagcaaagcattggagtgctcttccgcctgcctggcctcctcctcttc

SEQ ID NO: 1488 - DNA, 2127 bp, Mus musculus
atgtcgaagcggctccggagcagcgacgtgtgcgccgactgcaacgggcctgatccttcctgggcgtcagtaaataggggaactttcatatgtgacgaatgttgcagtgtccatcggagcctggggcgccatatctcccaagtgaggcatcttaaacacacagcatggcctccaaccctgctccagatggttgagaccttgtacaacaatggtgctaactctatatgggaacactctctgctggaccctgcctctatcatgagtgggaggcggaaagctaacccacaggacaaagttcaccccaataaagcagaattcatcagagccaagtatcagatgttagcgttcgtccaccgattgccctgccgcgaggacgacagcgtgacggccaaagatctcagtaagcaactccattcaagtgtgagaacagggaatcttgaaacctgtctgagactgttgtctttaggagcccaagccaacttctttcatcctgaaaaaggaagcactccactccacgtcgcctccaaagcaggacagatcttacaggctgaattgctggccgagtatggagctgacccaggcacacaagattctagtgggaagactcctgttgactatgcaaggcaaggagggcaccatgagttggcagaacgcctcatagaaatacagtacgagctgacggatagactggccttctacctctgcggccggaaaccagatcataaaagcggacagcactttctaattcctcagagggcagacagcctggatttgtctgagttggcaaaagctgcgaagaagaaacttcaatctctgagtaatcatttgtttgaagaacttgccatggatgtgtacgacgaagttgacaggcgagagactgacgcagtctggcttgccacgcagaaccacagtaccttggtaaccgagacgaccgtcgtccctttccttccggtcaaccctgagtactcctccacacgaaaccagggcagacagaaattagctcggtttaacgcccacgagtttgctacgctggtcatcgacatcctcagtgatgccaagaggagacaacagggcagtcctctgtccaggtcaaaagacaatgtggagctcatattgagaacagtcagtacccagcacagcactgagagccaagacaacgaccagccagactatgacagtgtggcctccgatgaagacacagacgtggagacgagggcaagcaaggcaaaccggcagaagcttcaaactctccagagtgagaactcaagcctcaggagacaggccacagccagtgcctgtcaggtgcagactggctctgaccacaaggacactgcaagccactcgtccctaaagcgacggccatctgcccggggcagtagacccatgtccatgtacgagactggatcaggccagaagccatacctcccaatgggagaagccagccaccctgaggagagccggacgagacttcaacccttccccacgcatattgggaggagtgcacttgtgacctcctcttcgtctctgccctccttcccctccacactttcctggtccagggacgaaagcgcccgaagggcctccagactggagaagcagaacagcaccccggagagtgattatgacaacactgcctgtgaccctgagccagacgacacggggtcaacccggaagggacggcagcggagcatgctctggcaaggtgatggcttattgccagatacagcagaaccccactcggtccccagccccaccctccccagcacagaagacgtcatccggaagaccgagcagatcaccaaaaacatccaggagctcctgcgagcagcccaggagaacaagcatgacagctatattccctgctcagagaggatacacgttgctgtaaccgagatggcagccctgttccccaaaaaacccaagtctgacacggtgaggacttccctccgcctactcacgtccagtgcctaccggctccagtcggagtgcagaaaggctctcccaggagactccagcttacccacagatgtgcagctggtcacacagcaggtcatccagtgtgcctatgacatcgccaaggccgccaaacagctggtcacaatcaccaccaaagagaacagcagctga

SEQ ID NO: 1489 - DNA, 2127 bp, Mus musculus; identical to SEQ ID NO: 1488

SEQ ID NO: 1490 - DNA, 67783 bp, Homo sapiens
  misc_feature (34024)..(34043): "n" at positions 34024 thru 34043  can be any base
  misc_feature (39350)..(39564): "n" at positions 39350 thru 39564  can be any base
  misc_feature (50784)..(50917): "n" at positions 40784 thru 40917  can be any base
acaaaacaacagataataccaagtgttgacaaggatgtgaagaaactggaatctcatacactgctggtggaaatgtaaaatagtgcagccacttcgaaaaattgctggcagttccgcaaaaagttaaaacatagagtaactacatgacccagcaattcctctccaaggtatatacccaagataaatgaaaacatatacccatacaaaaacttatacatggggctgggtgcagtggctcatgcctgtaatcccagaactttgggaggccaaggtgggctgatcacttgaggtcaggagttcaagaccagcctggccaacatggtgaaaccccatctctactaaaaatacaaaaattagccaggcgtggtggtgcacacctgtaatcccagctactagggaggctgagacaggagaatcgcttaaacccaggaggcagaggttgcagagagctgagatcatgccactgcactccagcctgggcaacaaagcaagctgtctcaaaaaaaaggaaacccacaaaaacatatacacaaatacacacagcagcgttactcataatagccaaaaagtggcgacaacccaaatgtccatcaactgacaaacggagaaacattttcgtctaacaaacaaaacatagtacatccatgcaatggaatatattcagtgataaaaaggaattaagcacctgaaacatgccacaacgtagatgaacctccaaaacattatgctaagtaaaagaagaaacaaaaggccacatatgattctatttatatgaaatgtccagaataggcaaatctagagacaggaagtaggttagcaggttgcctgggctggaggggttggggagaaatgaggagtgactactacaggtatggggtttctttttcgggtgaggaaaatattacagggtgggtgcagtggctaacacctgtaatcttagcactttggcaggccaaggcaggaggactgcttgagcccagtctgggcaacatagggacacattttctctacaaaaaaatctttaaaaattagccaagcgtggtagtgcttgcttgcagtcctagctatttgggaggctgaggtgggaggattgcttaagccgagaaggtcaagggtgcagtgagctgtgatggtgccagcctaggcaagagagtgagaccctgtctcaaaaacaacaaaaaaacaaaaaagaaagaaaaagaaaaaaatttctgaaatttgacagtagtgatagttgcataactcagcagatatactaaaaaccattgaataacctttaaatgtagattatataagtgaactatatcgcaataaaaatcttttgaaaaaatcaatctgtatatgtttatacataatacataaaacgaatctctcatgtactgtttgacaagttgcttaattcctcctgagcttcagtttgctcgcttgtaaaactgaacaataaaaaaaacctaccttacagttcttacaaggggaaagtccttaacttagcacggtgcttgacaccacagtaagtgctgagaagagttacctgttattatcatacgcccacactatgtagtttcatatagctgtcactttctccctaaaagggatttgctcaaattgcattacagttattagtggggcttagaatcttcaactaataatatgagttcagagaacaaggagtttcagaatttagctggaattcactttttcttttgagacagagtctccctcttgttgcccaggctggagtgcaatggtgcaatcttagctcaccgagatcttggctcactgcaacctctgcctcccaggttcaagcaattctcctgcctcagcctcccgggtagctgggattacaggcatgcaccaccacgcctggctaattttgtatttttagtagagacggggtttctctgtgttggtcaggttggtctcgaactcccgacctcaggtgatccgcccacctcggcctcccaaagtgctgggattacaggcctgagccaccacgcccggctggaattcactttcgaaactgatcatttaggttttccttttaagtttctttagccatgagctatacccaaataaaaatacccatcctcctttaactaggagtttccttcctatttgctcatttcagctcatccacttttcttgctcaaaagccttaaaaaaaatttattttttttttgagatggagtctcatactgttgccgggcctagagtgcaatggtgcgattttggctcactgcaacctccgcctcccaggttcaagcgattctcccgcctcagcctcccaagtagctgggattacaagcacccgccaccatgcccagctaatttttcatatttttagcaaagatggggtttcactatgttggccaggctagtcttgaactcctgacctcatgatccacctgccttggcctcccaaagagctgggagtacaggcgtgagccaccgtgcccagccaaaaaaaatttttttttaaggagacggagtcttactatattggccaggctggtcttgaactcctgtcctcaagcactgaccccacctcagcctcctcaatcaaaagccctctttactatcttgccatcctcctgccgagctctgaggccaggctgcagaaccagacaactggacaccccttccagcttgcccactagcctcaggtgaattatcagttcccctgtgccttggtacctggcatgcaggaagtgcttcataaactcactgtcacctttagggggactccagcaagaggctgctggctagtcctcctctctctcaacacagacaaccaccctcactcctcttcactctcagaccatcctggtcctgtgtggcccccacgctgagtcagtggaaacaggaatcttgaggccagtttcctaaggtgagcttgaacccccgatgaccaagggggcacatgaggagagcaggctctaggctcttcatcttggatgcctagcccatggctcagcgatttgaatctgtgcccggggcctcacctggcctgccccaggctggagtgagaaccccaggaatgtcctcctcttacctaggtgctatacttttcacctgctggcttcctaaacagggagcctggctctagagtcaggcctcatttgccaccctccacctcacacaacccaggttttccaaccctgtctaaggtacactgactcacctttgcatctgtccccttaagtgttcatgtctcaccatcagtaagaaggccaaagaagtttaacagacttctttagctaagcggccaacgacataagcagaacacaaacagtttcaacttcagcaaccaacttcaaggccccactgaatattaatgagctgatgggttaagaggcactttattaaatgcctctgctgatcaaatgaaggcctgaaacaatctggtagttggcatagttacacaactgcctgctattagtgagacagtgggattggggctggctcacacacacagaaacacgtgcttatcctcttcatctggataaacttgattctttcttgtgttgctgttcctggaacaggaacaaaaaacctggaaaaaaattcttacagctatcagtatacatgctccaagtctcaatcaggtgatagacggaatgaggaaactgacagcagaaactcaccagcaaacaaaacattaagggaaacagccactttattgctggggtgataagaattttttgggttttttttgttttttgagtcggagcctcgctctgtctcccagcctggagtgcagtggcacgatcttggctcactgcaacctcagcctcctggattcaagcgattctcctgcctcaacctcctgagtagctgggattacaagcacgtgccaccacatccagctatttttgtatttttagtagagacggggtttcaccgtgttggtcaggctggtctccaactcctgacctcaggcgatctgcctgcctcagcctcccaaagtgctgagattccaggcatgagccaccgtgcccggacttaagaattttttgtttttaattatgcaatcaatacatcttccttgcagaaaaactggaatatagagcaaaaaagctcaatccccaggtttacaaatgatgattataatagcagcagctactagtaaatattgtttccaattaccatatgcctgcactttcaggtccattatcttccttatttattctccataatcttgaaatgaagtcatttttactgaaagaagtatagtaggggttaagaatacaggatttgggcaaggcacagtggctcatgcctgtaatcccagcactttgggaggctgaggcgggcagatcacttgagtacaagagttcaagaccagcctgggcaccaaaagaagtagattcctaaaaaccaaaactggtcatttttaaagtgtcctagctgagtcttacagtttttacctctgtaccatgtctagtaatagaaaaggaattaaatgatcagtatactaaaatgcctaatggtgaatcatttagtctgagggcatgtgtcatatctccttaactcttaaatagttggtctgtcatctaattaagaacgatgactctcacaaaagtttatcgtatctggaattctttttaaatgaaaaaaggccggcaacagtggctcatgcctgtaatcccagcactttgggaggtagaggtgggcggattgcttgaggccaggggttgaaaccagcatggccaacatgacaaaataccacctccactaaaaatacaaaaattagcctgtaatcccagctactgaggaggctgaggcaggagaatcgctggaacccgggaggcgaaggttgcagtgacctgagatcgcgccactgcactcaagtctgaatgacagagcgagactccatctcaaaaagaaaaaaaaaaaaaaagaaacagaaaagaaaagagggtaattttggacttcggtgagggctcaaccaccttaaatatggcaggttgcaagcacacagcttgcagcacccattcaccaaatggagtaatgctaaccttctcaatttttgtcaaccataagacaaacaatcctcctcttcctctacaatttcttgacaattatagcaccaattttgagccattcaaaaaccaggtctgtaagacactggataaaatgtatgaagtcaacaagaacaaccatactagatttcaggggtaatcacaaatcctcatcctaactgctaagtttgttagcttgaaacttgagggcaccaatacctcccagaattgttgggagactttaaaagcagagtttctcagccaggcgtggtggctcacacctgtaatcccagcactttgggaggctgaggcgggcggatcacctgaggtcgggagtttgagaccagcctgaccaacatggagaaaccccatctctactaaaaatacaaaattagccgggcgtggtggtgcatccctgtaatctcagttacttggggggctgaggcagaagaatcgcttgaacccaggaggcggaggttgcagtgagccgagatcgcaccattgcactccagcccgggcaacaagagcgaaactcagtctcaaaaaaaaaaaaaaaaaaagaaggaaagaaagaaaagcagagtttctcaaccaagacgctgtcggctttgggggccggagaagtcttagttgcggggggctgtcttggccattgtaggatgttgagcagcataaccggcctctacccactaccagaagcacccactccccactttcaacaaccaaaaatgtcccatacattgccaaatgtccccggggggtcgtgggtgcaaaatcacctccaactgagagcactactgctttaaagagatagcaataatgaaaagattaaagcatcaaagcactttagaacaggaagggattttaaggagcctgagaacccgtgattctcaaactttgctaggtatcagcctccctggggagtttgttaaaaatgcggcacctggacctcaccccagacctatcaatagagtcaagtgttgggttctgccccagcaccaacatcctcattctacagctaagttaacgtcggccagagagggaaaatgccttgcccaaggtcacagggcgagttagaacctggactccaaaaccaaccaagcccttccttacaacaaggagagtgtgctattcttacgtctttgaggcagcagaacctaaaaatggttaagacggtgcattccggagccagccggcccgagttaaaatcccgacttggcatttatcagcggggcggcctcgcacaaggcacgtagcgtctgaggacctgtttccttctctgtccagtggaaaagtaacagtacctacccaccagcgttattggaaaggtgaagagagaagatatttaaaaagcccgtcgcacggtaagcactcgatacgtgtcctattattaggactgtcccacacctgcaaagtggaaggggtctggggatcccggggacagagggctggaaatgggctcagggaggcgaaacgacccccgattccccgaagtccccaccgggagacggacccccgccccgcccctcacctggccctgcagctccttctcgagctgccggtagtcgtttttccagactaggaggtgcagggggtagtggtcgcccgcgtcgcaggccgaggacatggcgaggaggccgtaacctggtcctcgtcgcccgccccaagtctcggccccggcggggtctcccgcgcccgcctgcctgccctgaggccggcgagcaagcgagcgtagggcgtgttacgctgccggccggctgagccggtcgggtgcggggcgcgcgggaggtccggggtcgccggccggctcagggaccaggtcggccgcgcccaccccgcgccccgcggcgttcccgcccgcgctgacagctcgcggacagacttctgcggacctaactgccccaaacagggaagtgcggagagcgaaccaccgcatgccgcggcggggataggcgaccttgggcaccgggtccggggtccgcgccattgcacccacctccagctcacaccgagaaactcagtgcagcccacagaacagagctgaggctcattctcttggccaaagatctccacgcggaaagttccgtctacctgtccccagcttctttccccctgctccagtagccccatgtggttcggtccacaactgggcctcttccattggctctgaagtcagggggtgacaactgagccccggaccaaaccattccagctgccgacacccttgcagcctttttggagcaggacagatgcttccacgacgggtcaaaagccattttggaagtgggcaacaccggacaatttttgaaggaggaacgctaaaccctggcgaagtggcttcaaatacagtatttgcataaaaggggatatttctacttcatgatttctcaacctcggcacatattgaactgggcagtttttgtgtgggggttgtccggtccttgtaggatgctgagcagttgccctggtctttctccccactcaatgccagtagcactccccaaaacatgtctctccagatattgccaaatgtcgtctcggggagaaaaatcgtcctcagttgagaaccgcttctatttgaactccgaaccgggttatgattcaatagctaactatggtggtgatttagtccatgtatgaatgtcatttttaagctagctttttggatttgaggttatggctgaaaggactgataaataatatacatatttgaccacagtctgcgaatatgaagtttattctttgagtttcaggcactatgcctccttgactcaatgaagaaccaaatcaacttacagctagctactcatgggcttgaactttctgctgctgcttcagctcagctgtctacaactagaccacatagctggatgaagctatttaatgcattgtgaaaacattccctctgccctctgagtgtatgcacatccagctcttcagatgcctgcaacaacagctgttcaagaatcccaacctaatccattctccacagatgtggagcccagaagatttgtgagttgttaaaccaaaacaggatgcaggagcaccaggatggcacccggagactctaaccatggaatgcgtgggaattctgtgattatttctccatcacacatttatcacactgtagagatggactcaagaccagtgcttctgaggccttttccagcacttctcattctttcagatgccttttgcaacttaacgttctccttcttcttcatcatgccgtgtttattgaaaatctccctatctcattaatcagaaaaccccataatgacaggaaccacatcgttttgcttaccagagtatctaaaaccaaaatagtacctggctaacaacaggcattcaatatttgctgaatggagatcatagctgtgtttatatgtaagacagacaataagtagtcattggtattagggtcacatctcctttctccttcacactgatttacctcatttcattgtgtttatctcacaccattttgtaaattatcccatgttagctattgttattctcaaattccacgcatatgaagaaaaacagtaattagaaaataatagcaatatccataattatgggagctactatttactgaggggttactatccagcaggtgtatcacatttttcccataatttattccatctgtccttagccaaaatgaatgtttaactttgctggtcacatacaagttttgtcgcatattcttcttcctctttttctttatttccctctctctcttcttcattttcatctcgcaaccctttaaaaatgtaaaaatcattcttaagtagcaagccatacaaaaacaaatcgtggactagaagtaaacaatgcattatcttaattttgaacatgagattaaaactgaagcctaaggaatcatctaatatattcttttttgttatttttgttgttgttgttgaagttgtttttgagacagtctcgctctgtcccccaggctggagtgcagtgacgcgatctctgctcactgcaacgtccacctcccaggctcaagcgattctcatgcctcagcctcctgagtatctaggattacaggcatgcgccaccacgcccggctaatttttttttttttttttttttttttgagacggagtctcactctgtcgcccatgctggagtgcaatggcgtgatctcagctcactgcaacctccaccccctgggttcaagctcctgcctcagcctcccaagtaactgagattacaggctcctgccactgtgcccggctaatttttgtatttttagtagagacggggtttcaccatgttggccaggctggtcttgaactcctgacctcgtgatccacccgcctcggcctcccaaagtgctgggattacaggcgtgagccaccgcgcccggccaatttttgtatttttagtagagatggggtttcaccatgttgcccaggctggtctcgaactcctgcctcaagtgatcctcctgcctcagccttccaaagagttgagattacaagagtgagccaccacgcccagcctggaatcatataatatattcttattttactttaccccagtaaaatgcaagcttcataaggactagaaattcagtctttgctcactgctgtttctccagtggctgggacagtatataaagcatggtaagtgcttgataaacatttgttgaatcaaggaatgaatgaatgaacttgaccattgattgcctcaggaaggttgtggctgcagggttctcatcacaagatattgctacttcccctggtattaatcagttgggacgaggggaatctctgccagagaagaagacccaaattcaatatttaaaggtaggacagatgatactcgggcagtctcctgccctcactcaagatggcgacaaggcagagtgccctttccggtcacatgacctgacactcgccgaagggcacctccccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccgggtgagtcgcaccggccgggcccgctcccctctgctttcctggcccggacccctaccccggggccgccccctcaggtcaggctgcatcccgcggctagggtcgcaacgaagaggtccctgggcggccttggggtgggaaccgtcccgggcctgtcagagccgggcgggcagggggccgccgccctccccgtccctcgcggccctcccttccctctcgttccctcccgttccctccgtcctaggccaactggggaggtgacgggggccagggctgctcccccaacaggaaggggcttgggcaatccacaggaaagccaattacagaagtaaaatgtgagcgtcctcccggctgcagcctccagaggctgcaggtgtcacctcccactagaccctttctccgcctgggtgtcctgcccggggaggatgacactccctgagactcgccagagggtccccgtagatgacttccccgctgctgacatccgacagctactctgcccgggagaattgccaggagatcggggtcttccaaacacaaccagcacttaggaggcagtgcttgtctcaagtttgaggatctgaacggcctgggttcaaactagattttgcttctggctgaccttgggctggtgacttcacttggtcacttgcttgatttcctcatttttttcaatgaggataatcgggagtatcacgcttagtggtgaggaagattcaatgaatactcgtagaatcatatcatctaaggcttttcttttttgcattatgctgtctacagtagaactcttgtagtcccttaaagctatatttgactatctaaatcatacgttgattacaacggaaacaaacgcaaaatcaccagcaatataggggcattgaaacgctaaagccattccttcataatgatgcataactgttcatacataatattcacatttagagatcaagtgtgtcttagcaattgcaactgaattgtcaggtctctggatagattattacatgctgttttaggtgcttggatgtattggctttgagttaattcgaaggtaacatggctttcttggcacaatagtgtccgataaacaatcttaattaaatcattgaacaccactggctttgcaactgttctgatcttaagcttgtcatttggaagtggagaccaattgtaaatagaactgtgataactcaaacctcatgtggttgttttatggcccgtacagtgcaggtgttaccagtttcctttgaagatagggagggggtatggaggagtttaaaaagaagtgttttctaaaccaagttagtgtgagttatacaaactccatcattttctctaaaaatgttatttgttccacttccttattttcttgcctattttcagttgaacttaccgtgatgtatttgattcacatgtgtctagcttctaacttcctcttggaatgcatattgttttgcttcttgatagggtacagggcaaagcaaaattgttcctccattgccatcctaaatatacttttgcagcattttgtgcatttcagaacattttctcttccattgtatcgctttagttgttgtctcatacgcctaatctgcagagacttgagtcacttccttcctgttttgaatataattaggctaccttgaaatattctgtgaaattgagcagctgggaatttgtgctgccttttctgcacagccctactgagagaattacctgtagggttagggacccctttgagattctgttgaatgctaaggccttctcccctaaaatgcacgtgaacgaatttacctaagatttgtctgggggagtcacaaacatttttgaagttcatttgtggtgtccctggagccctggctccagatgaacttaaagggttttacccaatctcattcatacaaacatttttattttactatgttaacattctaatattctttccatgggattctgatccaggatgctaaagtggttagtcgaatacttgtcttaattaatatgtgttaaatacttgctaaaaaaagaatactgcaaatcctctgaataagtgaaaaccaaagctatgcttcaaaacagtcttttttttttttttttttttttgccattagtgtcagtactatactgcaggaagcagtgttgttaatgcatctttgtagagctccttcatctggacatttccaatctctgctttttaggatgatacagtaatagcgacagagttatactaaattgaattattttgattctgttttattttatgcaaacatttaaccatgatcacatcttcttaaatattctacttttttttttttaatgaatctggttcatttcaaatacatcacactctgagttcaattacttgaaaactccatggagattttcagtacagtagtagagtggtcacatgaaatgttcaatgttttaagtatttcccatcaaaaactttgtccagtgatcatgaatttcacgtctagaaaatatctgaatactgagaaaataatttagaaaagatataacaactaacattactactttactatgtgtgaggtacttcacttattctctatatccttactatcccgagatttgtcattgttctcatttgaaccatggtgaaaacactcaagtaacttgtctgagatcattgtgcaagaagtggcagagttggggttcaaaccctgaactccttgtctctagagccaaccctcttaaccaccatactcactggctcccaggattcgtctttgattgaaagcccataacttttcattatatggtttgaaagggtttgaataaactcttaaaaaatggtaaagatggtgtacatgcattttagagatttttgtggacattgaagaatttttaaatgtaaccctttgaccaggcagcttaagtggcacctattgtcaccccattgtgagtctgacgaagtatagctctttctttatttgaggtttctaggtattcagtttacttacccagatccatcctgcttgccaagtatgaaattattccttgtttcaaaggacagctaatgaagctctatgactttaaagggaaaaaagtattatacacacactaaaaatattattcatttttattttacatctttgcctctgtgaagctgctgttattgcaacttcttttttttttttcagatcagttgcaggattggacttggtagtttatgtaaaacaattaattggctgggcacagtggctcaagcctgtaatcccagcactttaggaggtcgaggtgagtggatcacctgaggtcaggagtttgagaccagtctggccaacatggtgaaacctcgtctgtactaaaaataacaaaaattagccgagctggtggcacacacatgtaattccagctactcgggaggctgaggcaggagaatcgcttgaaccctggaggcagaagttgcagtgagccgagattgcgccactgcactccatcctaggggacagagtgagactctgtctcaaaacaaacaaacagacaaacaaaccaattcatggacatcatagaacatttcctaatggaagaggccaggtttccctgtcctcagaaccatagcagctgagtgattttatgattctgtaactcgcagctttctgctaagcatattgacatgttgattcatagcagtgaattaggacagcagtctacaacatttactgcagaaaatgctatctgcataattcactgtcaaaattatattatcttggccgggcacagtggctcacgcctgtaatctcagcactttgggaggccgaggtgggcggatcacctgaggtcaggagtttgagaccaacctgaccaacatgatgaatccccgtctcagctaaaaatacaaaaattagccgggcgtggtggtgcatgcctgtaatcccagctactcgggaggctgaagcaggagaattgcttgaatctgggagatagaggttgcagtgagccaagattgtgcctctgtactccagcctgggtgacagagtgagactccatctcaaaaaaaaaaaaaaaaaaaaaaaagtattatcttgatttttatggagatggatccaaaatcattcgtctgtaccctctcaatttgctttcttagcttgaatgaaaaagcatgcatctgaaatggtagatccacattagggctacaaactgtggccctgaaccagaaagaagataactgtttacccaaggctcccactggtgtttttagtctcaattaacattgtacctaatcagccaaggtaggtcataccatccaacaagatgaccagcctgatgcattgatgagcatactgaaacaaaaatgtctcctttttctgacaaaccaaacttcagtcatcttttgccatctggcggtatagcaacctgctggtatccctgccactgagatttcactctctttccagatccttcctgggcatcagtaaataggggaacgtttttatgtgatgagtgctgcagtgtccatcggagtctagggcgccatatctcccaagtgaggcatctgaaacacacaccgtggcctccaacactgcttcaggtaaaggataagaattctcctgacagttggtaatttacattttagggctcatcatgttaataacttaaatttctcctggtgtacttcttccataagacaaaactgtttcataattgaatagagatggcatgcccatcaatgctatttacaaatattatctgtattgaattcagtaaagacttttcttcctacttgacataaatcttgttcaacaagctcaattataggtagatagatgaatagtcattaaaatatcttggtactgttgctctgttgactttctagactgtcatcggaaatgttttttttttttttttgagacggactctcactctgtcatccaggctggagtgcagtggcgtgatctcagctcactgtaacctccgcctcccgggttcaagcaattctcctgcctcagcctcccaagtagctgggattacaggcacccgccatcatgcccggctaatttttgtatttttagtagagaaggggtttcaccatgttggccaggctggtctcgaactcctgaactcaagtgatccacacctcaacctctctcgaagtgctgggattgcaggcgtgagccaccgcgcccggccagtagtccatcttttctatgcatgataatgaatgtttctgaaggctactgcctgagaatcttttctttaatgtacttattcctgagtacctgctaatatttttagaacatgtttttctgctttgatagcagcatgggctgggattcctcagaaacttctgaaacattttaagttttcttaaagctcttgttactagtcagagagaccaaattaaattaatatgttttgattgcatgtagaataccctgttaaatgagttctttgttttatctggagtccaatgtcatgtcacctttacttctatcttggggtacacattcttcaagttctcttggaactcaaggttaagtgtgtgttttgccttcatttgtcttgattacacatttcactgaatctgtgacagctgcacatatcccttaaacttggctgtgtgaaccaaggagccaaaacaagtgggtttgtatctctgatgtgaaaataactacactgctgtaaaaaacagatggggctgttttaggagtcatgccttgaaatgaaatttggagatatgatttattactaacttttgcttagaagtttctaaccgctcacgctcatgtgaaaggggctgtttactgctctcaggtctgtctgtgtttgcaaagccagattgtagtacagagtctcagtaaagtccagagatgagttgtttagaatgccagggttgaccctaaagcaacaattccccaaatgtggaaccaccagtggtattcaagacagatgtaggtaatacatgttttttttaatggttacattattttactgtgtatgggaaagctataactagcacatcaaactgtagttgtttttacaagtaagtggctttaaagacaaatattaagtgaataatatagacagtacatgggtcattaagaatgttgaaaatagtgtttaattaggtttgggaaaccctgctctaaggtgtcagagtacttttttttctttcatacagaataagaacagttcagtcacactttaggtatttaactatcctactagtcaaagctgaatcctgcatatagattgatcatctttctcattctcaaatcagaaaacaatgatatgaatgatattcctaacaaatgagtgtttataacaggactttgtttactctgttcagtcactgatccccattgaatatttgtgaaaagaaattaaagtcttatgtcatcctgcttggttttagatggttgagaccttgtataataacggtgctaactctatatgggagcattctttgctggaccctgcgtctattatgagtggaagacgtaaagctaatccacaggataaagtacagtgagtggaatgtttataaatacttttatttcttcataacaaatggggcccactgaaaggagtgcagctatttttggtcagtctccgcaagggcagcagaggagggggttaccctagttgtgcatcaggttctttgctattagaaatgcagaatggggtggggcaggaccatctgtttagcatggccacccagcaggagtaagtggcttcctcagttggaaaccatggcttggagtctgtaaatgtaatcagatttaaacttatactcaaataagaggcgatcagaccagaaatctaggtctgggcacccgtctgcctgttgcctcacttataagatgggactaaatgctgctttctcccaaagttgctaaatcagttcagacaattacacagagaagagggctactataaaaagcaggtactctggagtcccagccattataataactaatgtatgttttcaaactgcaggtcttaaaccttgctgaaacttacttgagcattgttcattttattctcaagtgggggatgtgggtcacttcctcttctttttacagtacaaagaatggggattgttgtatctgaacgagtgaactgttttcttttttgtttttgaaccagtcccaataaagcggaattcatcagagccaagtatcagatgttagcgttcgtccatcgcttgccctgccgggatgacgatagtgtgactgccaaagatcttagcaaggtgggtcacaccttttaaaatccctaaaagagcgggctgagacagcatattgttttatttgaaaaaacgaaaaaaaagtctggttgtgggctttttttttttttttttttttttgagacagagtctctgttacccaggcgggagtacagtggcgcgatcttggctccctgcagcctctgcctcccgggttccagcgattctcctgcctcagcctcctaggtagctgggattacaggcgcatgccaccatgcccagctaatttttgtatttttagtagagacggggtttcaccatgttggccaggctggtttcgaactcctgagctcaggtgatccgtctgcctcggcctcctagtgttgggattgcaagcgtgagccactgcacccggccagggtttttttgtttttcgtttgttttttttgagacagggtcttgctctgttgcccaggctggagtgcagtggtgcaatcacggttcactgcagccttgaccatccaggctctagcaatccttccacctcagcctcccgagtagctggaactacaggcgcattaccatacccagctaatattttttattttttgtagagacgggttcttgctatgttgcccaggctgaaaaaagtttttaaagaaagaaaaacaaaaactcatttctgcacattcattaattaatagcttttttgtcagtcggtttcgtctttaatctgaattcaaatggcagccattcatatagtggaggttcagggcaaagaggaaaagtaagtctctggaaggctgtttgtgtttttccaatatggcttttaaattatattttgataagttttttgtttgtttaactttgaaataggaaccatctcagagttgtttctagaagggactagaaagattataggacaattgtttctttttaataaggactagaaaaagtactaaaggaaggggacttcttcaggtttccaggttgaacagtaagtatgatcttcagaaagcaatgtgtgactcaaagctatagtacacagaatggtttatgatacttgtaaaacgagtgaggtggttttctttatgtgggccttcgcatgtttttgagagatgctgtaagaaatgtgcatattttcaaagcgctgccttggataaatgcttactcacacagagcatgagaacttacttattcagaactttttttattactttttggccgggtgcgatggctcactcctgtaatcccagcactttgggagactgagactggcagatcacttgggctcagaagttcaagaccagcctgggcaacatggcgaaaccccgtctctacaaagaatataacaattttagccgggtatggtggccgtgcctgtagtaccagctacctgggaggctgaggttggaggatgacttgagcccaggaggtggaggttgcagtgagctgagattacaccatggcactccagcttggacaacagagcaagaccctgtctcaaaaaaagaaaacattttctgcatctattgagatgatcatgtggtttttgcttttgcttctatttatttatttatttatttatttatttttatttatttttgagatagagtcttgctcagtcgcccaagctggagtgcagtggtgcgatctcagctcactgcaagttctgcctcccagttcatgccattctcctgcctcagcctcccaagtagctgggactacaggtgcccaccaccacacccggctaattttttttgtatttttagtagagacagggtttcaccatgttagccaggatggtctcgatctcctgacctcgtgatcctcccgcctcggcctcccaaagtactgggattacaggcaggagccaccgcgcctggcctgcttttacttctattgatgtggcaaattacatttattgatttgtgtatgttgagccagccttgaatctcagcaaaaaagcctacttgatcatgatgggttaatttttttatttttatttttattttttattttttatttttttgagacagagtctcgctctgtagtccaggctgtagtgcaatggcatgatcttggctcactacaacctccgcctcccaggttcaagtgattctcctgcctcagcctcccaagtagctgggattacaggcacgtgccaccaggcccagctaatcttttggtttttttttgtttgtttgtttgtttgtttgtttttgagacggagtcttgctctgtggcccaggctggagtgcagtggcgcaatcttggctcacttcaagctccgcctcccgggttcatgccattctcctgcctcagcctcctgagtagctgggactacaggcgtccgccaccacacccggctaatttttttgtatttttagtagagacgaggttttactgtgttaaccaggatggtcccgatttcctgacctcgtgatccgcccacctcggcctcccaaagtgctgggattacaggcgtaagccaccacgcccggccattttttgtatctttagtagagacggggtttcaccacgttggccaggctggtctcgaactcctaacctcatgatccgcctgtttcagcttcccaaagtgccgggactacaggcctgagccactgcgcccagccatggtggattaacttttgatgtgctactggatttggtttgctaatattttgttaagagttttttaaaaaatctgtgttcatcatggattttggcctgaagttttccttttttgttgtgtctttgccagattttggtatcaggctgatgttggcttcacagaatgagttaaggaggagtctctcctctttgattgtttggaataattttagtaggatgttcttctttgtatgtctggtagaattcagctgtgaatctcttgaactggggagacgaaggttgcagtgagctgagatcatgccacggcactccagcctaaacgacagagtctcactctgttgcccaggctggagtgtcgtggcacaatcatggctgactgcaccctcaacctccctagtctcaaatgattctcccacctcagcctctcaagtggctgagatctcaggcatgtgccaccaagcctggctagtgtgtgtgtgtgtgtgttttgtttttgttttttttagatagagtctctgttacccaggctggagtgcagtggcacgatctcggctcactgcaacttccacctcctgggtttaagcgattcacccgcctcagcctcctgagtagcttggattacaggtgcccaccaccatgcccggctaattttttttgtatttttagtagagacagggtttcaccatgttggccaggctggtcttgaactcctgacctcaagtgatctgcctgcctcggcctcccaaagtactgggattacaggcatgagccaccgcgcctggccagtttttgactttttggagagatggggtttcaccatgttgtccatactggtctcaaattcttgggcttaagcagtctgcctgccttggcctcccaaagtgctgggattacaggcgtgagccaccacatctggccttttttccccccccttttttaatccccagcagaatctggctgaagaattcagaatttgaaattttgcatagaaatgcatatactagctacttccattgattaataagacttggtatgtgttgggttttttgttttttgtttttttttccttgccagagttttaaaaaattaggcacagtggcacatccctgtaatactagctacttgggaggctgaggtggaagggttgcttgagccaaggagttcagtcctgcctgggcaacataacgagaccctgtgtttaaaaaacaaaaaaactatttaaaaaattaaacttagatgttagagtagatttcttcattcctgtgataagggttactgcatcttggacaattctaggttagatttgaaggaaggcagctcatcttctgactgtataagagcttttctgcagtagtacagaattcggtatatcacgggccttttcctaccctgaaagactttattaaagcatattatacaggccaagaataatgtggtagagagggtattgtataaggcaggatcctgtagcttacacagtgtagaatttgaagtcctaaagccctaattacagtaacaactaataataataactgttattatagcatttgtattctttgagcactttattatatcactaaatccttataataaccctgtgaatagggccaggcacggtagctcatgcctgtaatcccaacactttgggaggccgaggtgggaggatcacttcagctcgtaagttcgagatcagcctgggcaacatagtgagacctcatctgtattgaaaaataaaaagttagcagggcatggtggccggcgcctgtagtcccagctgtttgggaggctgaggtggaaggattgcttgagcccaggatactgatggctgcagtgagccatgatcactccactgcactccagcctggatgacagagcaagcgagaccctttctaaaaagaaaaatgccacctatttaaaattttttttattttttattttttttgagacagggtctcgctctgtcaccaaggctggagtgcagtggcatgatcacagctcactgcagcctccactgcccaggctcaggtgatcttcccacctcagcctccttagtagctgggactacaggtgcgcatgccaccacacccaactaatttttgtattttttgtagagccagagtcttgctatgtggcccaggctggtctcaaacccctgggctcaagtgatcctccaacctcagccccccaaagtgctgggattacaggcatgagccactgcatctggccattgttgacatttttgagatgaggaaagtgaggttcagattgcttaaagccctttctccaggccacacagcttgaagtgggtatagtttgaaattcaggtctgtcgtatgtcagagccacgcatagtcacctcttcacacagtcctgcctctcactcaggttctggttgtgccacttcttagataagtcatgcatttgggcaagtcagccttcacagccctagtttccttatcagtaaagtggcctcactccaccttacagcccagggacagttgtgactggcaaaggagagactggtccatgcactttaccgagacaaataaagattatgcgttactgatgtaacatatattaaaatggtctatcagctgccctaggacatcattctttacacctctaaccacgattccttttttgtttctgcgtttttcagcaactccattcgagcgtgagaacagggaatcttgaaacctgtttgagactgttatctttaggagcacaagccaacttctttcatcctgtaagaaaacatgaattgcttcagatattgaaactaagtgagttgtgttcatgtagcctttatttaatgtgctcttttgcctactttttattaatgattcttaggaaaaaggaaacaccccactccatgttgcctccaaagcagggcagattttacaggctgaattattggcagtatatggagcagacccaggcacacaggattctagtgggaaaactcccgttgattatgcaaggtaagagacctagattctcgctacttctctctgggatttttttgttgggtgtgattccttgttaagtagctaagttgtatatgttgatattgaacccctttaaagatgtacgttattttattttacagatgaagacatttcaaatgcatataagctcagcctggcaaagttgaggaaggctagaatcatgaaccagtgtgctaagcttccagtcttttacttgatcctttataacacagtgatgtttgagctgtagtcagattccaaatcaagtatcaagaattacagaatgtactcttctgttttttaatactcttagttatttcttgaacttaaaagcaaatatatacatagatatgtgattaaacaagtatagtaaaaagttaattgtaaggtttgggtagtagacatctaagtgctcactctaggccaggcatggtggctcacacctgtaatcccagcactttgagggtccaaggcgggtgggttacttgaggccagaagttcgagatcagcctggccagcatgctgaaaccctgtctctactaaaaatacaaaaaaaaaaattggctgggcatggtggcaggcacctgtaatcccgctacccgggaggctgaggcaggagaatcacttaaacctgggaggcagaggttgctgtgagccgagaccatgccactgcactccaatctgggtaacagggcaagactctgtctcaaaaaaaaaaaaaaaaaaaagtgctcactgtaaaattatttaaatttttctttattaataaagtccttgaaaaataaatctataggttagtcttgaatatcatttaaatggccaaagatcagtcatctttccttctttttccaaagtacttttattaactgtgaagcacaatactctgttccacagaggataaaatgggtgaataacaaaactctgccttcccagaatttactctcttggaaaagatgattcataaatgcctgaaagagttcaaggaggcaagaccatatgggattcattgccaaaatagataattggtcttaaaaagcatatatagggtttcttcattgtggtccaaatcatttaagaaatttcttcagctggtcttgaagaatgggttggatttgaatgtgtgaagggagagctgaagcattccaggtaagaggaaaggcaggagtcaagatcaggaggcagggagggacaaagtgtgttcagcacagcaggagacctgactggaaagaacagagtgggtctgggaataacagcaggagtacagtattgcatggtgcttcattatttcacagagcactaaaaaagaaaagagttcagccaattaaattatggtgtatcatcaattgtaggacatttcctgatttcacagatactaaaaaatgaaaataagatgtgcctctcacaaatcaaagctgtgtggtaggttgaagggtgttgtgagtgccttgaatggtggggagagaagctggctgaaactatcaggttggtgcaaaagtaattgcagtttttgccattacttttaaggacaaaaaccacaaaatatacttgatcttggacgagagccctgggtaaatgatacttattatcacttaccttggaattttcgcacttgtaccttgcatataataatctcaatataatttgtatccttgttgctgaaaggattctaagcagcctaagtatttatttcatggatgttgaaaggtaaacttaatattttctgttgtgcaaattgaagataaggaggcagaagtagctgcaggcgtgagctgtgcgttaggttggcgtgtctctcactgatttgaagcctttgaagtggttactagactcttatccagagtcagactggctgcatcagcatcacctaggggaaggaccttcttcaacatattggcccctggccccatcctgtccccattgattcagaatttccaagggtggggcctgcacatggtatatttctagaaatgcgctagttaatttttgagaacttctaccgtaaaccattgattaatttcatttttttacctcattaaattaagtcattctgtatccttccctctcataagtctttgaatttcttattaaatattctattttggccttaataaaggaaaggcgatagttcagatggtgaaaacagtttataaaagtgggatgcaaagtagacttcagaaatctacctaccacaagaaggttgatgattctcaaaagtcttgtgtgataaactgctcaggtgtctcaggagacgtctttgtactccattttaaagtcagtgaatagtgagcaatataaatggtactttgttttctcttggtaggcaaggagggcaccatgagctggcagagcgcctcgtggaaatacagtatgagctaacggacagactagccttctatctctgtggcaggaaaccaggtgagtggatggagaatgaccgtttcacatctccagttgggaaggttctagaaaaacaagttgggacactatttgttattacctcctctgctgtaacatatcactgagaaagctatacatacggcttttaatttgaaaggataactacagaattgtcagttacatgtaaaagatataaagttggacaaaactccttagatttttcatttttaatagctctagagaaatgactatttcaagaatcagactgaataatcaaagcaaaattgaatgggtaccacagttcttgaacatggtgggactaggaatgtaggagcaaagcaataacctttgtagttatttgaaaaattcttcttaaggaatggaaaaaaagtccagaagtaaactttgccaaagccaacttggctatttgtgatagggaacaggggtcagcaaaccatggtttgtagcccaaatctagccagttacttgttttattaaacaaagttttgtatcgtgccactgcacttcagcctaggtgacagagtcagactctgtctcaaaataaataaataaaaataaataaataaataaataaagcttctgccgggtgcaacgggtcatgtctgtaatcctagcactttgggaggccgaggcagaaagactgcttgcacctaggaattcgaaagtagcctgggcaagaggggtgagactccgtctccacaaaaaagttttttaaaaaatcagccaggcatggtggtgtgcgcctgtagtcccacgtacttgggagactgggacttgagcccaggaattcagggtggcagtgagctatgattgtgccactgcactccagcctgggtgcagtgacaaagcaagacccccaactctctaaaaaataaatgaataaagttttattgcaagaaagccgcgcccaattatttataccttgtgtatggctgctttcacataacaacagcagagttgaataggttaagtcgttgcaacaggccagatggccacaaagcctaaaatatttactatttggccctttaaagaaaatattggccaacccctgatgtacaacattcacatacatgtatgcagtgattctccatcctggttgtatgatagagttaagagcctctggtatagtttcagttctgggtgagatggagtaagcacaccccaccgtgtctcctgcaaaatagaactaacagacctggaccaaatgcttggagtagctagctaaagactctgaaaagtaaatcctggttggtagattagggaactcaaaagtgtcatcagctggtggtgagtgtcctgtttgtcttacttctgataggacttcaatgacagcctgaaacctggaggtacataatgagtgcaaaaaagcctttttctgcggggtgcggtggctcacgcctgtaatcccagcactttgggaggctgaggtgggcggatcatgaggtcaggagatccagatcatcctggccaacatggtgaaaccctgtctctactaaaaatacaaaaaaattagctgggcatggtggcaggcgcctatagtcccagctactcgggaggctgaggcagaattgcttgaacccaggaggcagaggttgcagtgagccaagattgcgccactgcactccagcctgggtgacagaatgagactccatctcaaaaaaaaaaaaaaaaaaaagcctttttctggttaaagagcaggaaatgggacttctacaggacagagaggaaggggattcccctggggttttttcctcctcctccttcctttttctgatctctcccatccagcccctaggcaagcctgtggctgcaatagcagcagcagcagtggcagcacaggttcctaaatctctgagcaaggggatgaggggggatcctgattgcttgtctttttctctctattctctcaccatctgcccaggaggcagaacctcacctggtcagttgcctgctaagacaaaaatatgaacatttttgcataaagtttaaagaaggcccagagtctcataacaaaacattcacagtgtctaggatatcatccataatgacttgacatctgagtaattctcatgtacttgccagggaaggcagccaacagatgccaaccccaagatgacacaaatgttggcgttatcagacaaagattttaaagcagctagtaagaccatgctataagaagtaaaagcaaacattcttgaaacaaacaggaatatagaaagtcccatcagagaaatagaagatacagaagagaaccaaataggaatattagaactgaaaaatacaaacactaaaaatttaaaacttactggatgggcttaatagaagaatagagatgacaaagaaagtcaatgaattgaaaacagatcactagaaattatctggtttaagcaacagagaggaaaaaagagtaggaagaaaagactgaacagagtctcagggacctgtgggaaaatactaaaatgtctgacatttatgtcgttggattcccaataagagatgagaaagagtggtgtgtgcagaaaacgtatttgaagaaatattggccaaaaaaaccctctaaatttgggacaggctcaatggctcacacctgtaatcccagcactttgggaggctgaggcgggcagatcatttgaggttgggagtttgagaccagcctggccaacatggtgaaaccccatctctactaaagatacaaaaagtagccgggcatgttggtgcgcacctgtaatcccagctactcaggtagctgaggcacaagaatcacttgaacctgggaggtagaggttgcagtgagtccagattgagccactgcactccaacctgggcaacagagcgaaactccgtttcaaaaaaaaaaaaaaaaaaaaaaacctctaaatttggtgaaagacataaacttacagattcaagaaacttagaaaattccaaagaagataaactcaaatccacagttgagacacatcaaaatcaaactgttgaaaactaaagttgaagaaaacatcttgaaagcagccaggaaaaagtgacacataacatatatagaaaaacagtgatttgaatgattgtggatttcttatcagaaaccatagagatgagaaggaaatgaaataatactttgtttgtttgagatggagtatctctctgttgcccaggctggagtgcagtggtgcaatcttggctcactgaaacctccgcctcccaggttcaagcgattctcttgcctcagcctcctgagtagctgggattacacgtgcctgccaccatgcccggctaatttttgcatatttagtagagatggggtttcaccatgttggccaggttggtctcgaactcccgacctcgtgatccgcccacctcggcttcccaaagggctgggactgcaggcatgagccacctcacccagccagaataatacttttattattattattattttgagacagggtctcactccatcgcctaggctggagtgcagtggcgtgatctcgactcactgaaacctcaacctcttgagctcaagtgatcctcccacctcagcatccacagtagctgggactacaggtgtgtgccactgtgcccagataacttttgtattttttgtagagatggggtttcaccatgttgcccaggctggtcttgaattcctgagctcaagtaatccacccacctgggcctcccgattacaggcatgagccactgctccttttttattattattattttttctcatcttctttgtgatggtagaaacaatacttttaaagtgctaaaagaaaagagctgtgaacccagaactctatatccaatgaaaataactttggaatgaaggcaaaataaggacattctaacaggaaaaaaaagaattattctttactttaacagaaatgctagagaaagttctttgggtggaagggaaatgatgccagagggaatcttggaactttaggaatgaaagaaaaacaacagaaatgttaaagatgtggcagagtaagaccctgtctcaagaaacaaacaaaaagttgaaattgtcatacatatcttaaagctgtaacattgtcagccaggtgcagtagctcaagcctgtaatcccagcactttggcaggccgaggcaggcggatcacctgacatcaggagtttgagaccagcctgaccaacatggtgaaaccctgtctctactaaaactacaaaaattaaccgggcatggtggtacatgcctgtaaacccagctactcaggaggctgaggcaggagaaccacttgaacctaggaggcaaaggttacagtgagccgagatcgtgccactgcactcctgcctgggcgacagggagactccatctcaaaaaaaaaaaaaaagaaaagaaaacgccaggcgcggtggctcacgcccgtaatcccagcactttgggaggccgaggtgggcagatcacgaggtcaggagatcaaaaccatcctggctaacacgatgaaaccccgtctctactacaaatacaaaaaattagccgggcgtggtggtgggcgcctgtagtcccagctactcgggaggctgaggcaggaggatggcgtgaacccgggaggcggagcttgtagtgagctgagattgcaccactgcactccaacctgggcgacagagtgagactccgtctcaaaaaaaaaaaaaaaaaaattatctagtagggttttcagcatatatcagtgtaatatatttgacaactataatataaaaggggatagggtaaaaaatataatggtaagatttctaccttctactggaaatgtaaaataggatttctaagtagactgtgaaaagttgtgtgtgtgtgtgtttgtgtgtgtgtgtgtgtatagtaatttctaccataaccactgaaagaagactacaagccaggcacggtgtagtgcctgtaatcccagcactttgggaggctgaggtgggcagatcatgaggtcaagagattgagaccatcctggccaacatggtgaaaccctgtctcttctaaaaatacaaaaattagctaggcatggtggtacgtgcctgtagtcctagctacttgggagggtgaggcaggagaattgcttgaacccgggaggcagaggttgcagtgagccgagatcatgccactgcactccagcctgggtgatagagtgagactccatctaaaaaaaaaaaaaaaaaaagactacaaagatatgtgatcaaaaatgctagaggtaaatgaaaatggagtattaaaaattactcaaatcatcaaaagatattttgattcaaaatattcaaaagaggagggggagaacaaaaaactaaggaccaaatagaaaataaataataacattatagacttaagtccgtacatatcaatagttacattaaatgttaatgacccaaacacatcaatgaaaagcagagattctcagaatggattaaaaaacaaaaggggctgggagctatggctcacacctgtaatcccaacacttcagggagcctgaagcaattctcctaatcgcttaagcataggagtttgagaccagcccaagcaacagagcaagatcctttcactacaaaaaattttatagaaagcagccaggcatggtggtgcatgcccatagtctcagctactcaggaggggctgaggtgggaggatcacttgagctcaggaggtcaagtctgcagtgagtgctgatcatgccactgctctccagcctgggcaacagagcaagaccctgcctcaagaaataaacaaaaaaccataaggcctaatatatactgtctacaagaaacccattttaaatataacaatataggtaataagttaaaaaccaaaagtataaaaagatataccatgtaaaggctcaggaaaagaaagctagggtggctatattaatatcagacaaagtagacttcagaggagggaatattagcacggatagagagggacataatattatcataaatgagtcaattcatcaagaaggcataatagttctaaatgtgtacacatccagcaacagaccttcaaaatacatgaagcaaactttgatagaactaaaaggagagaaggtcaaatctacaattattgttggagactctacactcatcttttagtaatagatagaactagtagatagaaaatcagtaaggatatagaactaaaccagaccaaaacccaactagatctagttgatgtttatagactcttctacctgacaacattagaatacacattcttttcaagtacatattgaacatacacccagatagaccatatcctgggtcataagacaaaccttagctaatctaaaagaattaaaattctataaagtatattttcagaccataatagtattaagctacagataggtaatacaaataaaactggagaatacccaagtgcttggaagttgaacaacatgctgcttttttttggaaacagagcctcgcgctgttgcccaggctggagtgcagtggcgcaatcttggctcgctgcaacctctgcctcctgggttcaagcaattctcctgtctcagcctccctagtactgggattacaggcacgtgctaccacacccagctaatttttgtatttttagtagagatggggtttcaccatgttgaccaggctggtctccaactcctggcctcaggtgatccacccaccttagcctcccacagtgctgagattacaggtgtgagccaccgtgcccggccctgaacaacacacttctaactaatccatcgatctaagaggaagtcttaagggaaaaaatattttccactgaatgaaaatgaaaatgcagcatatcagaatttctgggatgcagccaaagcaatgcttagaggaaactttatagtattaaattcttaccttagaaaagaagaaaggtctcaaatcattctcatcattattttttgagatggtgtcttgctctgtcacccaggctggagtgcagtgatgtgatcttggctcactgcaacctccccctcccaggttcaagtgattctcctgcctcagcctcctgaggaactgggattataggcatgcagcaccatgcctggcacatttttgtatttttagtagagatggagttttaccatgttggccaggctggtctctaactccccacctcaaatgatctgcctgcctcagcctcccaaagtgctgggattacaggcgtgagacaccgcgcctagcctcaaattattaatataagctcctcccttaagaaactttaaaaaaaaaaagagcaaaataaacctgaaccaaacagaaggcagcaaatagtaaagagcagaaatcaatgaaactgaaagaaggaaacagtagcgaaaaatcaatgaaactgaaagaaggaaacagtagcgaaaaatcaatgaaaccaaagctggtttttcagaaggattagtaaaactcataaatgtctggcaatactgacaaaaaggagagtgtacagatggagttgtcactataaaccccacagacatggaaggataattaaaaaaaaatacaaagcagaccgggcgcgatggctcatgccatgtaatcccagcactttgggaggctgaggcagatagatcatttgaggtggggagttagagaccagcctggccaacatggtgaaactccgtctctactaaaaatacaaaaattagctgggcatgatggtgggcgcctgttatcccagctacttgggaggctgaggcaggaaaatcgcttaaacctgggaggcagaggttgcagtgagctgagattgtgcaactgcactccagcctgggtgacagagtcagactccatctctaataataacaataataataatagtaatacagaccaggcatagtggctcacagtggtaatcacaacactttgaaaggccgaagtaggaggattgtttgaggccaagagtttgcgaccagcctgggcaacatagcaagaccccatctacaaaactgcaacaacaaaaaaatcagcctagcctgatggcacgtgcctgtagtcccagttactctggaggctgaggtgagaggattgcttgagcccaggaggtcaaggctacagtgagctgtgttcgcaccactgtactctagtctgggtgacagagtgagaccctgtctcaaaaaaaaatagagaaaaatgcaacataaccaagtgggatttccagataggcaagactgatttaatatttgaaaatcaggccaggtgcagtggctcacgcctgtaatcccaacactttgggaggccaaggtgggtggatcacctgaggtcgggagtttgagaccagcctggccaacatggtgaaaccccgtctctactaaaaatacaaaattaactgggcatggtggtgcatgcatgtagctacttgggaggctgaggcaggagaatcacttagaacccgggaagcagaggttgcagtgagctgagattgcgccattgctcacctgcctgggcgacagagcgagactgtgtctcaaaaaaaaaaaaaaatcagttaatgtaatctatcaagttaacagtaaaaacgaaaaactatgtaatcatatcagttgatgcagaagaagcattcaacaaacttcaacatccattcatgttttaaaaaaactcttagcaaactaggaatagatgagacttccttgatctgataannnnnnnnnnnnnnnnnnnnctagcctgatggcacgtgcctgtagtcccagttactctggaggctgaggtgagaggattgcttgagcccaggaggtcaaggctacagtgagctgtgttcgcaccactgtactctagtctgggtgacagagtgagaccctgtctcaaaaaaaaatagagaaaaatgcaacataaccaagtgggatttccagataggcaagactgatttaatatttgaaaatcaggccaggtgcagtggctcacgcctgtaatcccagcactttgggaggcagaagggggtgggtcacctgaggtcgagttcgataccagcctggttaacatggggaagccctgtctctactaaaaatacaaaaattagctgggcatggtggtgggcgcctgtagtcccagctattcgggaggctgagttaggagaatcgcttgaacctgtgaggtagaggttgcagtgagcctgagatcttgccactgcactccagcctgagcgacagagtgggactctgtctcaaaaaaattaaaaagctccaaattaaatacttaggtataaatctaatgaaatacacaatacatgtagtatctatatgccaaaaactgctgatgaaagaaatcaatgaagacctgaataagtggagagatgtactgtgcttatggatatgaagactcaataacatgtcaattctccacaagttaataaatgtataaatttacttcaattgaggattttttattagacatagacatgctgattttaaaattcaaatggaggccaggtatagtggcttacgcctgtaatcccagcactttgggaggccacggcgggaggactacttgagcccaggagtttgagactatcctgggcagcatggtgagacctcatctctacaaataataaattagccatgtgtgatggtgcatgcctgtggtctcacctactcaggaggctgatgtgggaagatcacctgagcccaggaggttgaggctgcagtgagccatgatcgtgccactgcactctagccttggcaacagagtgagacctcatttccaaaaataataataataatttaaaaattcaaatggaagggtgaaggaactagagtagcccagacaattttgcagaagaataatgtggaaggaagtacagcacccaatttttcagaattgctatgaagctgtacagttctcaagactgtgatatctatgaagagatagacatatagaccattgaaacagtatagagaatccagagatagatccacacaaatatgttcaattgatttttgtcaaaagtgcaaaggtaatcagttcagtggtggaggaaggatagttttttgttgttgttgttgttttctgtttttttaagacggagtcttgctctgtcacccaggctggagtgcagtggtgggatcttggctcactgcaacctcggcctcccgggttcaagtgattcttctgcctcagcctcccgagcagctgggactacaggcgcactctaccacacccaggtaattttttgtatttttagtagagatggggtttcaccgtgttagtcaggatggtgttggtcgcctgacctcgtgaactgcccgcatcggcctcccaaagtgctgggattacaggcatgagccactgcacccgccccaggatattctttttaatgcattgggacaaccggacatccatgtgcaggaaagtgaacttcaacctaaacctcacaccttaccccgaaactagaaaggatcatagatctaaatgtaaaacctgacactgtaaaacttctagaagaaaatgtaagaggtccgggcacggtggctcatgcctgtaatgccagcactctgggaggtcaaggcgggtggatcacctgaggtcaggagtttgaggctagcctggccaacatagtgaaaccccgtctctactaaaaatacaaaaattagccaggcatggtggtgaatgcctgtagtcccagctactcaggaggctaaggcaggagaatcgcttgaatccaggaagcggaggttatagcgaaccgagatcacaccactgcactccagcctgggcgacagagtgagaccgcgtctcaaaaaaaaaaagaaaacataagagaaaatctttgtgatcttggatgaaagcttttagctatcagctgagtatggtggctcacgcctgtaatcctagtactttgggaggccgaagtaggaggatcacttgagcccaggaagtcgaggctgcagtgagctatgactatgccactgtactccagcctgggtgacagagcaagacattgcctctgcaagggggaaaaagaaacctcttaaatataacaccaaaactcaatgcataaaagaaaatattgataaattatacttcatcaaaattgaaaatttttggccaggtgcagtggctcacacctgtaatcccagcactttgggaggccaaggcaggtggatcaccagaggtctgaagttcaagaccaacctgactaacatggtgaaactgcatctctactaaatacaaaaagttagccaggcatggtggtgcatgcctgtaatcccagctacttgggaggctgaggcaggagaattgcttgaacccgggaggcagaggttgcaatgagccaatattgcaccattgcactctagcctgggcaacaagaacaaaactccatctcaaaaaaaaaaaaaaaaaaaaaaggaaaagttttgttctgagaaaactagttaagaaagtgaaaagaccagcaacagactgggagaaaaatacaggtatttggaaatcacatatccagcaaattactcatatttagaatattcaaagaattttaaaaactcaggccgagcacggtggctcacgcctgtaatctcagcacgttgggaggcttaggcaggtggattacctgagcccaggagtttgagaccagcctaggcaatgtggcgaaaccctgtttctactaaaaatataaaaaaattagccgggtgtagcagtgcacgcctgtagtcctggctactcaggtggctgaggcatgagaatcgcttgaacccaggaggtggaggttgccagtgagccgagatccacgccactgcactccagccatggggggcagagtgagaccctgactcaaaataaataaataagctgggcacagtggctcacacctgtaatcccagcactttgggaggccgacgcaggcagatcacctgaggtcaggagttcaagaccagcctgaccaacgtggagaaaccccatctttactgaaaaaacaaaattagttgggcgtggtggcgcatgcctgtaatcccagctactcaggaagctgaggcagaagaatcgcttgaacccaggaggcggaggttgcggtgagccgagattgcgccattgcactccagcctgggcaacaagagtgaaactctgtctcaaataaataaataagttaattaattaaaattaaaactcaacagtaagaaaacaacccaataaaaactgggcaaagacaagatatgggatggcaaaaaaaaaaatcacatgaagacaagcgtggcatgattagtcattagcacaatgagatgccacagcatacctattagaatgattaaacttttaaaaacaaaaactgaaagtacaggtgctgggaaagacaggaagcaactgtaactctcacattgctgtttggaaaacaaagtgatagcgctactcaagggaaaaggtctggcagtttcttaccaagttaaacatacatttaccatataacccagcatttctactcctgggtctttacccagaagaaagatagacttatgttaaagaaaaacctacataggagtgctgatagtggcgttattcattggcacatggatcagtgttctccaggagctagattagggctgagtcagtaagcttccttgcagatggagtccctgtctggatctgcaaaggccacctgtcccagccctagctgttttatactaatagattcatttgagcaagacctagagctcatccactgtcccacaccgtgggctgatggacacctgctgtgagctgattcagctccctcagcacactttccatggccaaagatcgtcagttacactgagggcaaactaatcgtcgtgattggggtgagcataggtttctgctaaatgatgcctggacctttgtaccagaaaaaaacaaggctatgagccttactactagctgggtcttcaggaatttttagctagtctagcaacatgactcgtcattatgcacaaatactaatcgcaaaacttagtttgaggaaataatggtgatgttcctttacagatcttatcaacatttctatgaacaaaactttgacttggtttctgtttcagatcacaaaaatggacagcactttataatacctcaaatggcagacaggtaagctcattgaaataccagttagttttgtctatcgctaatatttccttggttgtattatgtttaagtatattatattttgtgtttaacaaagcccatacatttttctcttttatggctataccatttggaaataagacggctgtaagtaaaccactatataaaacttaagtttcaaagagcacaagtagcaattttactaataggaaaattgaaaccagtgatattgtcactgttttagccagttgtgacagtattttgtatttatttatttacagaatacttctgtattataggagattacattatctatgacaggggttggcagacttttcttctcaagggccaattaataaatattttagactttgtgggtaatatggccgctttcgcaacagcttaactctactgttgtagatgaaagcatctgtggacactctataaatgaatgggtgtgtctattccagtgaaattttatttctggacactgaaatttgaatttcaaatagttttcacgttatgaaatattgttttttctttttgcccccaaacattttaaaacgtaaaaaccattcctagctcaactgaacaaaaagaaggccataatttttctgacccctggtctataagagcagatgagttcattgctacaggaatgatccttaaacccttgttttgcaagttacctttgcacggaaactgtcaagagtttatgaaatgactaactgctattccagatataatcttgccatcctgatcttttacatcttccctttttgttttgttttgttttgtttttttttgctttggtagagacagggtcttgctctgttacccaggctggttgcaaactccgggactcaagcaatccacctgccctggcctccctatgagcaactatatctggccttgtattttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggccaagatggtgaaaccctgtctctactaaaaatacaaaaattagccaggcacagtggcgtgtgcctgtaatcccagctactctggaggctgaggcaggagaattgcttaaaccctggtggcagagattgcagtgagctgagattgcgccactgcactccagcctgggtgacagagtgagactccatctcaaaaaaaaaaaaaaaaaaacaaccctgaccttgtgatcctcccacctcggcctcccaacgtgctgggattataggcgggagccatcgagcccgacatattttcttatatcatgctttttttttaatacttcaaaaattgtgactcctcacataagggcctggaaggtaacctggcaatagcttttgtcgtttagttggtggacgatttttttttcctctttaacacttacatgattgtggtatttcagaaggagttactttcaccagattgttctgtttagagctcctcactgactctactgggctgtagaatgcttggttctaacatggtccatgaactgtaattaatatttttatctcttgggtgtcttaaactttacagagttcacaagtctggctttatttatttgcttattagctttgtatgttttcttagcagcctggatttgtctgaattggcaaaagctgctaagaagaaacttcaatctgtgagtatttctctgtactggttttctctagtatgagaatcagtgcaccctgctgatacctactctgaatgcaggttacctattgcgtctgatgactttatttcatacttttatttgttaaactagaagcagactgttgagtatacagcagtgatgaccacaaggactattaagttcagtatattcagttcattggttctgcttcagataatctcatttttctctatcatgtaacaagtgcagatggcacctttggcattaggcagttgttctcctcaggagagttccctagttcctctcagtgtcatgagtaagtagggcacgcgttcttggggtgacttagccatgtagggttctagagctggtaaatgctgatgctgaaatggtggcgagtcccatagattcactggctgccatttggatccagccatattgtaaacctctttcccatcccatgccattcatcagtgctttttaaatttctgctgttaaaagctggtggtcttggcccatgtgcgtgctcagagtttgccggctctgtgccacaacctccctttagcctgtgtctttcttccagactgcccacctcagccttaggaaaggcctaagggcccaaggcctcaaggccctgggaaatctacttctctgggattgacttctctttgtctagttctctcacatgaagcctcaccggggcacttctctccactttaaccaccaaagtatactcctcagctgttcccattgctctttggatcagaaccaagattcttaacttctttttgtaacctgtaagggcatcattcagctctcacctttcagagattgccctgcttcccatctggttccgtgtgtgtgtgtgtgtgtgtgtgtgtgtgtgtgtgtgtgtgtgtgtgtgtgtctttagattaacaccctctgaggccatgagctgcacattcaagtcctcttccaggaatcctcctttgcctacagcgtttgcctttcccagcttccatctctctgattcaaggacctgaaatctgaccagtgtaggtagcggctttcccaaagcctgactctgacattgcagcttccctcatttatgactttctcctcatttctgttttcacagaagaccctttactaaaacttcatataatactcagtattaaatattacattaaatgaatttatccttactagtatttaactgtattatgaaataaatgtgttttatgcaatttgtttggtgtctctgtgttctgtatctacagttttgtgtgtctgtgtgttttattgccttaaggaagttgtaaactaagatgatcaagatgataagctttggagtcagatagcactaaatattgtgtgatttccttttaattactcacaatctgtaagtaaattttattataaataattcaaacctagataaaaacccacgttttcttagactatcctacatttgcttcactggaagctgcatgaaagctgagattatgcttgtaatatctctagcacgtggcaggcatgaagtaaagacctggaacagagtctagtatagctctccagagctgcagctctgagtcagactggtcagtacatatctcagccctgccaagcttcctagcctccctgtgccttggcatcctctcatagaagagggagataaggatcctgcaggggctgccggccagaactgctcagagtgggctgccccattacttgttgaccctcaccctgtggtctccttctcataggtgaccatcttatcagcgccaggtcagtgtttatcctccagtatcttcctcctgtcctccctctcttcctcccttcatcctttctttcctttctcttttccttccctccctcctgatgaagaactgagagaaatataacaaaggctaatgtattccttgaatgagtaaatgttagcattttcaaagatgtaaacttggatctcaggtctgtcactagctttgtgactttaggcaagctactatcttctctgcctcagttttcttgtcttaaaaatgggacaatagtagttcctgttttcatagaggtgttataagtgaaatatgatactgttagcacagtgcctgggatataagcccataatcagcgttggccattgtagttgttgctagtaataataacattagcttgtagtcccatggaggaagaaactagatatttatgaagcaaagtcaagctcccaatccttcaacatcttgtctagcaacaggctctctgggtttgtttttaattatagtgcgaccacatttgggaagatttggaaaatagagaaaggggaccatcctcattgctatactcttaatggagtcaggctcaatattttggtacatttctttcagttcttgttttatatgcatatctttttttaaaactggaacttaatcataattgtagacgtttataacctgcttttttcactcagtaatatatggtacccattttaacatgttcctatgaggtctctgtaaccagcacttgttttttctttttttttcgagacaaggtctcactccgtcacccaggctggcgtgcagtggtgccatcgtggctcactgcagccttgaactcccaggctcaagtgagtgatcttcctgcctctgcctcccaaagtgttgggattataggcatgagccaccacacccagcctgtagccagcattttaaattgctgcattaaatcccttctggccagccagtgcctcttttctggccacttttaaagtgtgaggtaccatgtgtggatgtaaggaacccaatagggaatataacagattcagcatctgccctcccaaagcagatgtcagacagtttaagagtcacaactaccacgtgtcaaggtgttgcatgaggcagaaagtgcagagagaggcggagccaccccagaagaggcttaacctcatctgggccaggaagacctcaattatcctccatgtgcccagggaggcactgcaggctgtgaggtggttgttgtgtgctgaagagtcaggctgtgctttggtaggaagcttccttctggagactgaagcagtaggactgctactgagaaagagagcaaagaaactcagctgaggtctgagtcacgtttttgtgcaagggcacattttatcctctcaaaacagcatgtcttttgcttttcttttttcttttttgagatagggtctcactctgtcacccagcctggagtgcagtggtgtgatcttggctcactgcagccttgatatcctgggctgaagtgatcctcctgcctcagcctcctgagtagttggcactacaagtgtgcaccaccacgcccagctagtttttgtattttctgtagaggcagggtttcaccatgttgcccaggctggtctcgaactcctgggcttaagcaatccacctgcctcagtctcccaaagtgctgggattataggtgtgcaccactgagcctggctgtttttgcaaggttataggttcccttatactttggggaactgataagcacttttaagtgcagaaaaggaggcttacaggatgatatcacaagaagagtagagaactggaacctacttctgagatgatgcactttagatgcctcttagctccttaatagcagcagctctgtctgtgtcataaagtagtgaaattgctgtggttggcagacatttctagaggccctgtacgattttgaaaatgttatgtctgtttaacagtgggtatgtaccaagcactggcattggataagacgtaggcaataaaagggtgactaagtcgcagttccctcttgtcctcctggcattaatcattgtcccttgtgttcctgatattttttattttcagctaagtaatcatttgtttgaagaacttgccatggatgtgtacgatgaagttgacaggcgagagacggatgcaggtgacttgacgtggctttatctaataagcttctgttatcagtgggcagtgaaaagctgccaggctcagtgttttactagtccaatttctgctgtcctgatggtgcgagtgtcgacgtttgcctttgcgtgtgttggcttcagagtgtgtttcccctcgtagtgcgtgagctgtgcctcccaggagcagtggcacacaggcgtgatgaggtttgtctctggctctttcctctgactagtctggcttgccacgcaaaaccacagcgccctggtaaccgagacaacggtcgtcccctttcttccggtcaatcctgagtactcatcaacacgaaatcaggcaagtggctcagtttggaaaggaatagtagttggggaatggctgatgtcatgtttcatttttcccaggaaaactattctaaatgttttgattgattaaaatttaatatcctttatacatatatacacacacaacccccaaattgataagaaaaacaatagactataaataaatgactgggaaagaatatgaaacaattcacagaagaaatataaatggcttacaaatgtgaagaaatgtttaaccttgtcagtaatctaagaaagcaacttaaaagcattagtgcaagttttatcagtcaaattaataaaatatataataaaggatactccaaactggtaaggatgtggtaagctgagctttctcttgcaacagatagaactttaaattgctgtagatgttagaaaagcaatttgtttaccagtttcagaagcctcaaaattaagtacatccttttacatgggaatttctcatttgagaatatgctctaataaaataaaaatagatttatgcacgtgattttcatcaaagcaccattgtatacaatagagcattaaaaacagctaacacatccatcaagaggagaaatgttgaatgaattatgaaggtgttttagtctttataattagcagctatatataaggatagggaatatctagactatgattttgtttaacttaaattttttttttcttttgagacggagtcttgctctgttgtccaggctagagtgcagtggcaccatctcagctcactgcaacctccacctcccggacccaagcgattctcttgcctcagcctccccaagtagctaggattacaggcacccgccaccatgcctggctaatttttgtacaaagtcctgacctcaagtgatcctcccgcctcagcctcccaaggttctgggattacaggcgtgagccactgcacccggccttaacttaaaatttaaaaattcccctcaaaattaatttattattactgggtctacttccaaactgaagcattaatagaagaaaagcattcagtagacccattttatttttgcttaccaaaatagacctgcattgtgagaacaatgcatatgtgagaaatgccataacatttgttatgaaattctcttatataaatggttttaaactgttcatatggaaaacaagcattaacttggtttgattatggctgggattaattgtactttgatcatgccagaagaaagtatttgcagaagtctgtcaatagtctgactagttttatgtgactatttatgtatatatttttacactgggaaatatttccaattattttcccacctttagggcagacagaagttagctcggttcaacgcccatgagtttgccacgctggtcattgacattctcagtgacgccaagaggagacagcagggcagttctctctcgggttcaaaaggtaactgctcaaacctccaaacacttgcattttttggccctctaaatttgactcaggtgttaaagttataaactaattaaagcagtcatcaacatgacagttctataggtttttggttttttgtttgtttttttactttaagttccgggatacctgtgcagaatgtgcaggcttgttacgtaggtatacgtgtgccatggtggtttgctgcacctattgacctgtcctctaggttccctcccctcagccccacccactgtaagttttattggtagtatattgtgataaatagtttacctgtctgagccctggtgaattaacaatatttcagagttattaactgctacacatatttatcttatatatgatttctgttttgttttgggacacttaacctaccctgtaaaattgcatcctgaaattaacccaaaactctggcttagatcttgttaaaggacataagaaaataaactcttcttggccgggcgtggtggctcacacctgtaataccagcactttgggaggccgaggcaggtggatcacctaacgtcaggagttcgagaccagcctggccaacatggtgaaaccacctctctactaaaaatacaaaaattagcaaggcatggtggcgggcgcctgtaatcccagctacccaggaggctgaggcaggagaatcacttgaacctgggaggcggaggttgcagtgagccgagattgcaccactgcactccagcctgagtgacagagcaagactctgtttcaaaaaaaaaaaaaaacggaaaagaaaaactcttcctgattgaaactgcataatatctgctgttgcttacctacaaaactgagttcaacataattaaaatttgttgccataaactttaaatgtcttcagtgagaattactgtgatatacaattataaggagagctctgagcatctgtttcaccagtgccctgttgagtctagttcagtagcccaggtcctgtctgcatgcttaggaatgtccttcctctccagccctattactgtatccatattggttttttctaattatagaaattagacgtttttcattgtaagtcatttaagcaaaagaaatatgtaccataaaaattaagttttcagtcagtatcacattccccaaagacagtaatcattaactgacaacaactcattcattcttctttcctgttcaggaatttgattttatctgttcaaccaggaataaggaagttctgaaaaggtttattaaattttggtgaaggcacagtgacaagagtctttggataagtttaaagtcttaaaatggcctgggcgtggtgccttacgcctgtaatcccagcactttgagaggctgaggcggacagatcatttgaggtcaggagtttgagatcagcctggccaacatggtgaaacccatctctactaaaaatacaaaaaaattagctgggcgtggtggtacgcgcgtataatcccagctactcaggagactgaggcaggagaattgcgtgaacctgggagacagaggttgtagtgagccgagatcacaccactgcactctaacctgagcaacagagtgagactctgtctcaaaaaaaaaaattgggggccaggcacggtggctcacacctgtaatcccagcactttgggaggctgaggtgggcagatcacgaggtcaggagattgagaccatcttggctaacatggtgaaaccccgtctctactaaaactacaaaaaattagccaggcatggtggtgggtacctatagtcccagctactcaggaggctgaggcaggagaatggcgtgaacctgggaggcagagcttgcagtgagccaagattgtgccactgcactccagcctgagtgacagagcaatactccttttcaaaaaaaaaaaaatttttaacttaaaaaacaaagtcttaaaaaatacctgctctttgatttgataattccactcttaggtattaactgaagggaaatcatcagagatgttatatgtagaacaacacaaacattagaagcaactaagtaataaagaggaacaattagtcacattttaaaatagtacatgctgcactttgggaggccaaggcaggcggatcacgagttcaggagatcgagaccatcctggctaacacggtgaaatcctgtctctactaaaaatataaaaaattagctgggcatggtggcagacgcctgtggtcccagctactcgggaggctgaggcaggagaatggcgtgaacccgggaggtggagcttgcagtgagccaagatcgcaccactgcactctagcctgggcgacagagcaagactccgtctcaaaaaaaaaaaaaaatacatacttatctttttttaaaagaatatgtaattgtcttagtcccttttgtgtggctataaaagaatacctgagactgggtagttcgtaaagaaaaaaggtttatttggctaatgattctgctgactggaggattgggcatctggtgagaacctcaggctgcttccactcatggaaggtgaaggggtgctacatgtgcagagatcacacggtgagagaggaagcaagagagcgaggagggaggtgccaggctcttttcaataaccaggtcctagcaggaactaatagagcgagaactcactacaaagggagggcattgatcagttcataaaggatccacccccatgacccaaacacctccctttagtcctcccctccaacactgaggatcacatttcaacatgagatttggagggaagaaacatttatactatagtagtaattatatgagacaaagtaataaagtttgattttgttttgtttttttttttttgagacgagtctcactctgtcgcccaggctggagtgcagtggcgcgatcttggctcactgcaacctctgccacccaggctcaagtgattcttgtgccttagcctcctgagtagctgggattacaggtgtgcaccaccacacccagctaatttttgtattttttagtagagacggggtttctccatgttggccaggctattctcgaattcccagccttaagcgatctgcccacctcagcctcccaaagtgctgggattacaggcatgagcccccatacctggccaaataataaagtttttaaaaggttttgtataaccccagttttgtaaggaaaacatatttatgtaaatatgtgtgtacaagtgagtataccacatgtaaatataaatacacaattgatcctcatgtgcacatcccatatttacaaattcatctacttgctaaaatttgtgacctcaaaattaatacagcattttcaaggtcattgtaagaaatgtacagagcagagaaaaaaattgagtcaccaaaagcacatgtttccagctgagattgaacagggaggagactccttgacttcttgtttctgcactcatgctataaacaagtgtctgtggtctatttagtgccatgttagtcatatttgtgtgcttttcattggtcatttcactgttttaaaatggccccctaccgcccaggatcaattgagtgcccaggagattgaggctgcagtgagccatgatcacgtctgcaccctagcatgggtgaccctatctcaaaagtgtctccttggccagacgcagtggctcacgcctgtaatcctagcactttgggaggctgaggtgggctgatcacgaggtcaggagttcgagaccagcctgaccaacatggtgaaactctgtctctactaaaaatacaagaaaaattagccaggcatggtgacgcgtgcctgtaatcccagttactcaggaggctgaggcaggagaatcacttgaacccaggaggtggaggatgcagtgagctgagatcgtgccactgcactccagcctggatgacagagtgagactccatctcaaaaaaaaaaaaagtgcacacctgaacaacatagcaaggccccatctttaccaaaaaatttaaaaattttctaggtgtgttggcatgtgtctgtagtcctacatactcaggaggctgaggcaggaggatcacttgagcccaagagttagaagctatagtgagctatgattatgccagtgcactccagcctgggtgacatagcgagaccctgtctcaataaaaaaagaaaaaaagtggcccccaagcatagtcctgaagtgctgtctagtgtttctaagtgcaagaaggctgtgatgtgccctacggagaaatgtgtgttaaataagcatcattcaggcatgatttatagtgccgttggccatgagttcaatgttaatgaatcaatactatgtattaaataaggtatctttaaacagaaacacacgtagaacaaggttatatattgattggttgataaccccagaagcactgatctaatattggccaagtcacagcaactttttagaacataactaccaagaggctgggtgcggtggctcacacctgtaatcccagcactttgggaggccgaggtgggcagatcacgaggtcagaagatcgagaccttcctggctaacacggtgaaaccccgtctctactaaaaaaatacaaaaaaattagctgggtgtggtggcgggcgcttgtagtcttagctactcaggaggctgaggcaggagaatggcgtgaaaccgggaggcggagtttgcagtgagccaagatcgcgccactgcactccagcctgggcaacagagtgagactctgtctcaaaaaaagaaaagaacataactaccaagcataacaagaattgactgtgtgtggctataagtgctcggagaaaaacctagaaatagatcaacaaataacaatggctataagtgattatcttacttgttcattagtttctaaattgaatatattgactatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttattattattattattttttttttttttgagacagagtctcgctgtcatccatgctggagtgcagtggcatagtcttggctcactgcaacctccaccttctaggttcaagcgattctcctgcctcagcctcccaagtagctgggattacaggatgtgcaccaccacgcccagctaatttttgtatttttagtagggatggggttttgccatgttggccaggctggtctcgaactcgtgacctcaagtgatccatctgcctcagcctcccaaagtgctgggattacggatgtgagcccctgcgcccagctaggacctagtctttttaaataaccaccattcatcacccagatatcatccatccattgtttcctcaacatctctgggaaacaatattagaagtcagagtttgagttgcctgaaagaaatcagagagacttgggtagtttgtgaaatcttttgttcaaagtgtattagatcctctagaataatccctgctccctatgggatagacactccctgtaacatgcacatgtgtatttgtttgattcattctcctttatctctttctctcgctgagatgcaggtaattgactaaatgccaatgtttctattcttttttttttttttgagacggagtcttgctctgtcgcccaggttggagtgcagtggcatgatcttggctcactgcaagcgggttcatgccattctcctgcctcagcctcccgagtagctggggctataggcgcccgccaccacacccggctaactttttgtatttttagtagaggcggggtttcaccatgttaaccaggatggtttcgatctcctgacctcgtgatccgcccgcctcggcctcccaaagtgctgggattacaggcgtgagccaccgcgcccggcccagtgcttctattgtttgagtgcctaggttctggctccagtttaacaatttgctttctgttttgagtgacattaccttgtaaatatgttataggtattcatagaattacagtttatcttccattacctacagccttatcttcatgacctggagctaggctctatctctagaaacttgggaacctgccttctttatctgagcagttccttcctaagccatctgtttaatttgcccatatttggcaggtagatgagaggaatgctggagtctcttatgtagctgtccacctggttgaaaactttttctgttatctctgtattggtgtgaatataacgttgccatttctgtcattttttttcagtccttgttcattttgtttttgtctttgtttttgctcttagagacagggcctcactctgatgcccaggctggagtacagtggtgcagtcatggttcactgcagcctcaatctcctgggctcaagcaatcctcctgtcttagcctcctgagtagctagtagctgggactacaggcctgtgacaccaggcctggataatttttaaattattgtgtagggatggagtctcattgtgttgcctaggtaggtctcaaactcctggcctcaagcagttctcctccttggcctcctagaatgctgggattacaggcaagagcacagcattcagccctttaagtcctttaaatggctaaaccaaaaaatcctctccgtagttttttggaagaaaagcaatgttttaagcctgaagtaaagttgtttgcttttattgatagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaaggtgagaggccatgcgtcccatggaagggcaagcacgcatcagctgagggctagccctgccaaagctgctgtgcagtgaggttgggtttgttactagctcaggccaagcaaaggtgaaacaaggttaaatggttttaaaatagggatccttgtccctgcatcacagccctgctgcagttgagactttataaaacttgtgaggagtgattggtgtgttttattcattcaacaagtgtttactgagtgacttctctggatattactctcctgaatgaggcctcgtccctttcctgtgaggctctcattgcctaggagagagagaactgcggagaaggcacaaagtgatgtgtgtcatacgaagcacacacaggctgagggagtgagcagagagagaatctatggctgggagcatcaggtggggctgtgtcataggacagctcttaagatgcgcctcaagggacgcttgggattggggcatgtggaggagtcagaaagaaagtgaaaccagggcatctaaggggaagctggtcatgcatagggacagcctaaaaaggttgggactcgaagctgcagcaggaggggtatgacacccgacggaagagagtgggcctcacaggcagtgcagagcccaggatgccatgtctggggaggactcttctggtgggttagagagtggagggagagatccatactggagctgatgcaggccacctaaggacccatgctaggatggtgcgggtgggagagacctcggcaccagagtgtgagctgggggagagggcagcaggaccccaggctgtgcaccctctgctgacccccaggacacacccacagaggggcttggcaatcatttgagaatggatgaataggaaggtagaatagaaaagtcttggcaataagtcggaaggttgaagtggggagacagatttatagaagatttgtttggagttcttcggcccacatgactgtgagaaagatggcgtcattagcagatgcaggggacacccctgcgcagacttcccggaagccacctggttcactcagtgagagccgaggtcattccaagaccctctgtgaccaggccctctgtcaaccgcctggcctcctgcccagtccatcccacacacctgctccctctagctgagctccactgcaggctggaatgttcttcctccagattcatgtgactcatcccctcacctcctggggctctgctcacctctcacccactcacaggcttaccccagctccccgcttaacatgcagccccctaccctgctctgtcttatcttttcccacagcactcatcaccctcaatcatgcaatatatatactctctcatgctgttggaatataaacaccatggaagcaggaatctttgtctcttttctaatatatcccaagcacctagaacactgcctaatgttcaatgaaaatgttggaatgaatgaattaatgaaagaatgaataaaaacaaaacaagagtgaacgagagaaaggcttacaagacaggacagacctccttagacagtcattgtcagcatagatgtgtagcctcactgcctgttctattagaaaatactgactttcaaattttttaaatagtatagtgaccctacttttatgttttagttttgcattactctcagaggccttgatttggtttgactaactttgcaattcagctggcttggtcagaatttgaaattcttgagctgttagtctttaatgttctcgtcatctcagattgtgaacgttttcccaatttatttttagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaaggtaacatgttaataaatgccaggacggttgacgctttaatcccatagtacaaggaagaatctcaggcactgtgatgtggtccgaggaaagaaaaacagttattgtaacagccttagaaatctttgggccaagttgtctttttgaagcaggatgtatttggatatttaaaatgaaatatatccagagtaagttccccaggtaggagaaacctaacatctatttaagcatttgtgcccattagaataacccttggactattctgtgcttcctggaaacctggatggggctccatggatgtgattcttcccattgctagggaaggatgatcacaccatggagacagagccaatgagagccctgggcaggggcatgtttatcagcattcaaaccctgctcccaccctggcagccctatcccacatccccaccttattgctcaccagtttttactactaacttgtattatccccagagcctacaggagggcctgccacagagtaggtgctcaaaaaataagaaaaaacatttcatttgtactaggaagagctgcacactggtaaaaaacaatctcatttgctcagcattttctcattcattaccttttgagagaatcagaaccgtgtgaatatattaatccctaaaaggagtgtggttgatggtagcaaggaatacccttagtaggagggggattgtgtatgcaactccttatgagatggctaaataagggaattcgaaaaattgcaaattttgcccatgactttgtgggtatcactcatcattcagctctaaaatgagatttggacactttacttaaccagaaacaaaatgaaatatataatctatgtctttaggctgtcatttgagaagtaaggttttcaaatcattttcaagacctgaggacgtggcacactccatgtgtgcctggactcttttcagtgctgcttcctaaaggaaggtggaagaactaaaaaggggcccatgcccctctgtttactagggaaggaaattgctgtgcacttttgcctggggtttggtctaggattcttttgatgttgacttctagagcatttttgagactttttgaaataaatggctctaatgcctatagtagcagggaatgaagaatgcttaagatcagctagccttaaacgaacagacacttgttctgtgtctcccagccctgtctagggctgccgtgcagctgtaaacgagacagaccgagagcccctttgtcataacatacaggacctgtattttctttgccttctttggaatatattttatttagtggattatagtttgttccattaattggactaataattttgaccaggtgactatttctgaaacatgctgattttgccactgtaaatcaatctgctgcacatcaccttttaaaatctaacaatgcttcttttagtatttttggaaatcaccagagagagcctcattatctctgaaagcaaatgtcttgagcttctttgagaaatgcaaagtgaaattatttgcttttgcttattgattatctcatcaattcttagaagtgcttttgatttctgaaactattgaattgtctataactttttattttcccttatactccttccaaataaaaaagtgtagcctggttcttattaagataaacgtcattaaaatttatgtgaagacatctctctaaatacagagtactaacatttttaaaaattgaaaccaagaacttgtgctcatgagaacacattcagacaaaatccaggcatgaaaagtgttaggataaagtttcagatttcaaggccttaactaaataactgccacagaggctttttatacagacaaacacgtgatcacatgcaccagtgccccattgagggacctgtgtcagttacacacctcagtccttgaaccttgaccatttcactctaggccctgggttctctaatgaatagtttcaacaggcacttcatgcctgtctgtatcctggaatgtagaaatgttcagggctgctttgtcagctgctttgcagctgttctttccctggaaagggaattgcagatatgagctataccctgccagcctttgtgatataaaagcattctatcattctgtaatggcttgctcttcagagaaacagaatgagtggtctttttgtggaagaggcagtaagtcacactttcacagcagtttggcatgattaatataaagtatatggaatttgtttatttagcaaagatgtattgattatatttcaaagttgggtaaagtttttaatatacataaagttgacaaagtagcatgatttgtatctgatctttcacatttaacagttgcttggaaaagatgctaattaatgaagaggagcaactactattggtgtatttttcacagattggtgctttctaaataaaaattgaaagtaactcctaacattgaatgggtttgctactgaaaaagtaatgatcttctggtgcaaacagttgcttgtggacttaaaccttggcactggtggggaatttggtcagattttacaatctctgtcaaagagtagacagctgaactcacaccacacccagcttatagaatgtccatggaagatgaaggcgcaccagaagggaaggaccctgcgcagaatggacgtggtgaatggtgtttaaaatgccagatgccaaagagtaacacgattccctgctgaccccttaactctaatccatccagcaccatggagcagcctgcatgtgaggaatggaaggagcattcagggcctccaagtgacagtctctaaaatggggtggtgccaggcagattagcatgttcaaagctgacaccactgaggtcgtgttttttgggtgacaaagccaaaggagagaaaggccaaatattccagccctggccgaaagatgatcactcaccagacggaagcaagcgtgctgcgtggagcatccatgcgaagatgtcaattccatagatcaataggtttccagttttcttcgtgatatgttaatatagcaaacttaccatgatccggttttctcttttttctttttttttttacaaagtgctgaattgtttggaatatcaagagtattatgtaataaaaacttgttgatcataatttttcttgttggctttttggaaagcaataggcgatctgatttttcacaagctgaacttctgtctttcttgctttgcaaagcaaccctagtcatctttgtgctgcttccatggtgtctgctgtcatttttggcctttacaaattgctcagggctcatttgaaaagcaagttacctaaatgatgttttaatgatctcgaactcttgcttgaaacagccttagtaataatccagtgtacagcttgcctgcaaacatttcccagccccaccatgacaaattttaaagtggttagacattttgttttgaggaagtccaaaccacaacttttccacattcagaaatgaagctatttaatttgcttacgtgatgaagggagttgattgtgtttcacccaatccagaagaaagggtccttgtttgtattggctttttactttcagcccggctagctgttactgtccttattgtttaaaactggtagttgtattcatttacttggtgtttgctttttctgcttgctgtaaaaaaacacagtcccactgccaaacatttctttcagcttcaaacactccagagtgaaaattcgaacctcaggaaacaggccacaaccaatgtatatcaggtgcaaactggttctgagtacacagacacttccaaccactcttccttaaagagacgtccgtctgcccggggcagtaggcccatgtccatgtacgagaccggatcaggtcagaaaccatatctcccaatgggagaagcgagccgccccgaagagagcaggatgagactccagcccttccccgcgcacgtaagtaacaccactggcgcttctgctgttcactctatgcagcctgtctactctgttccctcttctgaacctacaggtccccacagctctgctttgccaaattggactaagagagttaccattgtgtttgctgtattaacatgtccacagatgcttgcgatattcccacaagcacacagggccatgggctgatggtttcctaaccaagttggggattctggctcttgcccgaactgctgcttttttctcccccacatccatgattatttctcaaccagccagtgttggaactttttttggtaaagcttccttccttctctacttccaaaaacaaaaataaatcataaagttcactctcagaaggaagtgttgccttcttggagctagacagggatgtgcccctttaagtactggagcccttagaatccaagacgtcttttcagctcctcctcaagcaggtggccttgagtctgtggcccaggtacccaggcaaggctggaaggctccaggcttccgcagcctctccatgtgtgctcagtgtgcctgctaggttcgcttctgcatcctgctcctcccaccgtggtgggggaagtgtggctttgttgtctcagaaaaggaaatgtaatactctacatcagtcttagaagcgctgaattccagagattgtgttctgcagcagggttcttacaatcttattttgcattgggatacatactgtgttataaggttttcaaatatatttcttctggattactttattataaaaatatgtgttttgccaagatgttacatttaaactttttcatgggatgctttttcagagagtagtatttgtctttttgagtgtcaaagtttattatttcttcagtcaaattttatgggagtttccaaaaaaattctcaaggtagatgcaaagcaaggacatggtttcgtgaattaaaccctagtttaattttgtcaattttcagtgtggtaaaattacaatattgttttactataattgggagtctgttatctcagattctttttaagatatttgggtttaacattctaaggcaattgatttgatacatttgatgtaatgggaatgccactgaactaagttaagaatcttttttttttgagatggagtctcgctctgtcacccaggctggagtgcagtggtgtgatctcagctcactgcaacctttacctcctgggttcaagcagttctcctgcctcagcctcctgagtagctgggactacaggcacatggtcctgtgcctggctaatttttttgttttagtagagacggggtttcatcatgttgcccaggctggtctcaaactcctgagctcaggcaatccgcccgcctcagcctcccaaagtgctaggattacaggtgtgagctaccatgcccaccctaagttaagaatcttatttttgtatagctgaagacaaaatttaggaaaagcaactttgttatttttcagtgtactttcttattttagaaaaaattagaatataaagatatatcaggaaggcactgtaattgtactaaaaattagattgatagtgtatagcaacttagaatcatttttatagtttctcatttcacatcagtcctgattgaaaaacaaatatgcatttcatagtatccattaaaaaattattgacaagtttgacaaattatgttaggtatttcccttatggaaaagcagccttattaaattcagagtaatttccaggaggtgtttcaccaagggtttaagcatctctggggtcctgtcactggtggccactgagattgcagcactcacgtcacataatgtgtggtgttccaggattcttttactgaagctggcaaggtggtaggtttttggtttgttttgtattttcccgagtgtgtttctctttcccattccagatcgggaggagtgcacttgtgacctcctcttcatctctgccttccttcccctccacactttcctggtcgagggacgaaagcgcccgaagggttaagtacattctgaatggtctgctctctggaggaggggccgtgctcctgggcgctttgtgcttgggctctggccctcctgtccctgctaactgcccttccgtcctgcatgaggcagcacttcctcctggtttctcacagtgcatcaggctcacactcgtccacatgcacgctcacccatcgagggcgcctccctttctctaaccccatactgctcatgttcacgtcatatttaacaaagtttgcaaatcaccctacagcatttattctgagcaaactgtttttttaaacaacgagaaaattagctggctgctggttagatattataataggccaaatttgttcaatttgttcagggctacagttgtcagattgaaactgctgtatgtggactcgctgaagtactaaaatgtcatgcctttttttttttttttaacctgtgacacattttatgtcagcaccacaagtgctgacaaaccaaggtttacaagtccctgcatcttgaatcagaattgtaacaccttgtggcattggagctatgcaagcagctgttaacctaaagctgttcacttgtacgggttggttaaacctcacctactggtgtataatttatggtctcaatagcagtgcatgattcaggtaagcctcttttagagtagtcaggcagtaagtattaagcacctcctccatacacagcgtttgggtaagtcaatgaaagggtcctaaggacttagctggcacagcccctgctcccaaaggcactgtcaattaaaaaatactttcatgcataaagagtggtacatgaccacaacctgggaaagccgtggaaagggcataggctttgaaatccacgtcccagttctggctccatctcttttttaatggaagggtaatgtaaggtaagaggaggaaggtggctgtgggtaagggaccacctttacaggcaaggtggggtttgcactgggcctttgccattccctccacacctaggaattatggagagcctttctttcctagttccagtggcatatggattaccaaggccctttcaggattcgtttttttattttttattttttagagacagagtctcatgttgcccagtctgtagtacaatagctatttacaggcatggtcatagcgtactgcagcctcaaactcctgggctcaagcagtcctcccacttcaggcttctgagtagctgggcctacaggcatgcgccaccatgccctgacccttttggaattcttcacttcactttcagtctattaagaattctcagccgagtgcagtgactcacacactttgggaggcctaggcgggtggattgcttgagcccaggagttcaagaccagcctcagcaacatggcgaaatcccatctctataaaaaatataaaaaattatccgggtgtgttgatgtgcacctgtagtcccaggtgcttgggaggctgagatgggaggatcacttgagcccaccatgagagatcgaggctgcagtgagccatgattgtgccattgcactccagcctggacaacacagtgaggccctgtctcaaaaaaaaaaaaggaattactgtactaaaaaaaaaaaaaaagaattcttgatacattgtacttaaagtctcggctgggtgcagtggctcatgcctgtaatcccagcactttggaaggccaaggtgggtggatcacttgagcccaggaatttgagaccagcctggccaacatggcaaaacctgtctctactaaaaatacaaaaattagcggcgggtggtggcgcatgcctgtaatcccagatacttggaaggctgaggcacgagaatcaagaatcccttgaacctgggaagtggaggttgcagtaagccgagattgcaccactgcactccagcctgggcgacagagtgagattgtcttaaaaaaaaaaagtctcctgagcagttctgaaattgaactgtaatgtttcattaaaatagcccagatacaactaaaggacagttagacagtgattaaatatctcattagaaattttgtaagtcaaacctcttttgtctactgtgaaatttttgttttttaatttgtatggtagccttaaaaatcattgcaaggactgcttgctgagacagagttttgtacaaaaatcatttaaactgatcaccctgattgttcctgacagcttcatcatgagtttagatttttatggcgtgtctttattcagagaaaactgcaaacctattaaatacattgaaccagcaccagctataaggtaaccttcctattaacagctttgagagagcagcactcttaaccaatagcttttggctctgcatgcttataatatttttgatacaattaaatgctggctacactgaaattctgtacatatgcttttgttgacaacgatggaaggacttaactaacgtgtaagtaactgatttcctgggtggttgctgctatatgttgttttccatacttgaaaaaacatttaccaaatgcatttattaggtatatgagtcactactcttctaaaatgtttaaatgaaacttggtacttttcatcattgagggtaatgcatttgatttgcgatttatcacattttcatcagggaaggcaaaaagattcattataaaggccagacatggtggctcacgcctctaatcctagcactttgggaagccgaggcaggtagattgcctgagctcggtagtttgagaccatcctgagcaacacagtgaaaccctgtctctattaaaatacaaaaaattagccaggtgtggcggtgggtgcctgtagtcccagctacttgggaggcttaggcaggagaatcacttgaacctgggaggccgaggcagaagttacagtgatccaggattgcaccactgcactccagcctgggcgacagagcaagactctgtctccagataaataaataaaaaagattcattataaaaatgtagaattttctgggtttaattctgtttctagtttgttttccactggagcagctctgggcaaatttttcagtataattacgtaaatgcaagtttttatctattcatatatgtgtatatgtatacacacacacacctctgtgtgggtgtatatataaaaaccaaaataaaacttaaaagttagttggggccaggtgtggtggctaacacctataatcccagcactttgggaggccaaagttggaggatcacttgagctcaggagttcaagaccaggctgggcaacatagtgagaccttgtctccacaaaaaagtacaaaattagccaagcgtggtggcacgggcctgtggtcccagctgctcaggaagctgaggtgggagaatcgcttgagtctgggaggtcgaggctgcagtgagccgagattgtaccactgcacttagcctaggcgacagagtgagaccctgtctcaaaaaaaaaaaagaaaaaaaattggcagggtgcggtggctcacacctataatctcagcacttttggaggctgaggcgggaaaatcacctgaggtcaggagtttgagaccagcctaaccaacatagtgaaaccccatctctactaaaaatacaaaattagctcggtatggtggtgcatgcctgtaatcccagctactcagggggccgaggcaggagaattgcttgaacctgggaggcggaggttgcagtgagcctagcttatgccattgcactccacaggcaacaagagtgaaactcaatctcaaaaaaaaaaaagaaaaaagttaggcattccctgtgaaagataagaagggttttgggtttttcttctttctttttcattttctaagctcatctctggaagaccacagtgcttgcccatgatcttcctgctataaacttctagcagccaaactcactgactgttcataaagccagatcaaaacaaggcagcaagagaagcagaactacttattgataggagatataaacaaagggatcatcaaagttgtcgattctacagaaattagctttacagactccccatatggctccaagctaacgtttaatcatttgccagatggatttgagtggcttcaggatgcacgagttcatagtgaattttaggagcccacagcaagtgtcttgtatttgagcagctgggaactaaacagcatgcgtggaggtgtggatggaagacctcagccgacagaggagagaacatgcgccctgggagcagaagagtgtatggggatagcaaacaaagtgtggtgtgaataaggggggcttctccacgtgggtccggctgccttgcctgtacccaccaggtgttatcagtaaggagtgacaggctttatgtagagttttgtggggtttttttttttttttctttttggttttgttttgttttgttttgttttgttttttgagttagggtctagctctgtcacccaggctggagtgcagtagtacgatctcatctcactgcaacctccgcctcctaggctcaagagatcatctcacctcagcctcccgagtagctgaactgcaggtgtgcactaccacacccagctaatttttgtacttttagtagcgatgacgtttcaccatgttgcctaggctggcctcaaattcctgacctcaagtgatctgcccacctctgcctcccaacatgctgggattatgggtgtgagccaccgcacctggccatgtagaccttcttaaaccaacttactcaaaagtagccactcttttggatgaagctacagggtttccatatgtttaaacaaagctcttagtttacatctgtgtccttagccacattttattgcagcatcaataaaactccttagtcccatgttttgattaacttggatgaaattcaaggagtaaagctagaaatagctcacacttatattttataaggtaagtggtttaggttttaaattagcctccactgatctctgttccagagaagttctcaagcattatgggtgaaataaatagggaaaataatgttcatgaaatactcagaacatagtccccttcgaaggaataaagtccccttcaaatttcgtcaccctagaagatcgtgtgtttagcagtgctgccatttgttcaaaacatttttaggattcctcttttgaatctgtatcccatttttgatcaccacagttgcaccaaatctttacattttaaggggtagatttgagcccaggcatgaaatattggaggtagcaggaggcaggagacctggtgcttggtcctgtttttctgcagactttgtggcctttggtgggccacccagcttttttggcccttcattttctcatatggggctcaatgagataatctgaaggtggcttccagtgctgaaggtctgtggtcatataagtgctggcatgtttttttgtttgtttgtttctgagacagggtcttatcttactctgtttcccaggctggagtacagtggtgcgaccatggctcaatgcaaccttgaactcctgggctcaagcagtcctccctcagcctcctgaggagctgggactacaggttcatgctaccatgcctggctgatttatttatttatttatttatttatttatttatttatttatttattttatttattttttaaatgttgcccaggctggtctcaaactcctagccttaagcaatcgtcctgcctcagcctcccaaaatacagggattacaggtgtgagccaccacaccctgcctgtattttaactgcatctcattatgttataaatttgagaactaaatgaggatatgttgccttgcatgtctgttagtttgtactaaggatctgattaggaagtggccactgagctaagaagaaaatggtgcaaagaaggaaagaggccatttctggatccaatattcatcttttactaaattttcactagagagttgtcccctgtcccaaatgagatttgggatgtgaaggccagtagcctaacaggtaacaattcctggggaagactcctgagaagagtctcatgttacaaactcatgagggtccctcttctttcttgtaggcatccaggctggagaagcagaacagcacacctgagagtgactacgacaacactcccaacgacatggagccagatggcatggggtacatgcacaggacgagcgtgccaggggaggggctccccagggccagagacctggcaggcctgggccagcagaagcagttcaccacacacaccccttttctctattttcagactcataaagtcttaaagtattcaagcatacgctcgtagtttacatgtcttgtcatctcacattgttgccgaaaggcctttttctttgtaccagcatgttatgtgtctctagctgtctgtagtgtgtttaaagtcattaccccacttcatcatgaagacaacattaggttacattctgcatttgtacccaaggagttggcccacctgaggatggctttataaacaaacaccctccccgctccaggtatttccctcccttttcccctccttcacccttcctgtgagagtcaacacttccagccctatggtagagtgaaatagccgattttagagccttaccatgagtctcctgctagacaggataaaggaaatgacgagaccagcctgctcatgcatttagccagtgcatacaaagtggctcctagaagcagaggggcagctgataagcacctgctgtatttaactgcatctttaatgttcacaggtcaagccgaaagggacggcaaagaagtatggtgtggccaggggatggcttggtaccagacacagcagaaccccatgtggccccaagccccactctccctagcaccgaagatgtcatcaggaagactgaacagatcaccaaaaacatacaggagctcttaagagcagcccaagaaaataaacatgacaggtaagcaggattgaagaccctgctttgggagagcatgagttatgcgcccagaaagggatgatgcccatgttcctaatggcagctattcccagcatgctgacttcaaggtcattgaaaacaagtctacataacaggcttaagaacaatgtcagttttggtttgctttgtcttgtttgatttacatggtattttcttttttttcatcttgttacgaagctccgaaaataaatgcctctagaaacaggattgcggcatagttagggtggtgacaatgctagttctaggagggggacaggggctaccttacacctcgctt

SEQ ID NO: 1491 - DNA, 2287 bp, Homo sapiens
cgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagttgcttggaaaagatgctaattaatgaagaggagcaactactattggtgtatttttcacagattggtgctttctaaataaaaattgaaagtaactcctaacattgaatgggtttgctactgaaaaagtaatgatcttctggtgcaaacagttgcttgtggacttaaaccttggcactggtggggaatttggtcagattttacaatctctgtcaaagagtagacagctgaactcacaccacacccagcttatagaatgtccatggaagatgaaggcgcaccagaagggaaggaccctgcgcagaatggacgtggtgaatggtgtttaaaatgccagatgccaaagagtaacacgattccctgctgaccccttaactctaatccatccagcaccatggagcagcctgcatgtgaggaatggaaggagcattcagggcctccaagtgacagtctctaaaatggggtggtgccaggcagattagcatgttcaaagctgacaccactgaggtcgtgttttttgggtgacaaagccaaaggagagaaaggccaaatattccagccctggccgaaagatgatcactcaccagacggaagcaagcgtgctgcgtggagcatccatgcgaagatgtcaattccatagatcaataggtttccagttttcttcgtgatatgttaatatagcaaacttaccatgatccggttttctcttttttctctttttttttacaaagtgctgaattgtttggaatatcaagagtattatgtaataaaaacttgttgatcat

SEQ ID NO: 1492 - DNA, 1419 bp, Homo sapiens
atgtcgaaacggctccggagcagcgaggtgtgcgctgactgcagcgggccggatccttcctgggcatcagtaaataggggaacgtttttatgtgatgagtgctgcagtgtccatcggagtctagggcgccatatctcccaagtgaggcatctgaaacacacaccgtggcctccaacactgcttcagatggttgagaccttgtataataacggtgctaactctatatgggagcattctttgctggaccctgcgtctattatgagtggaagacgtaaagctaatccacaggataaagtacatcccaataaagcggaattcatcagagccaagtatcagatgttagcgttcgtccatcgcttgccctgccgggatgacgatagtgtgactgccaaagatcttagcaagcaactccattcgagcgtgagaacagggaatcttgaaacctgtttgagactgttatctttaggagcacaagccaacttctttcatcctgaaaaaggaaacaccccactccatgttgcctccaaagcagggcagattttacaggctgaattattggcagtatatggagcagacccaggcacacaggattctagtgggaaaactcccgttgattatgcaaggcaaggagggcaccatgagctggcagagcgcctcgtggaaatacagtatgagctaacggacagactagccttctatctctgtggcaggaaaccagatcacaaaaatggacagcactttataatacctcaaatggcagacagcagcctggatttgtctgaattggcaaaagctgctaagaagaaacttcaatctctaagtaatcatttgtttgaagaacttgccatggatgtgtacgatgaagttgacaggcgagagacggatgcagtctggcttgccacgcaaaaccacagcgccctggtaaccgagacaacggtcgtcccctttcttccggtcaatcctgagtactcatcaacacgaaatcagggcagacagaagttagctcggttcaacgcccatgagtttgccacgctggtcattgacattctcagtgacgccaagaggagacagcagggcagttctctctcgggttcaaaagacaatgtggagctcatactgaaaaccatcaataaccagcacagcgttgagagtcaagacaacgatcagcccgactatgacagcgtggcatcagacgaagacacagatttggaaaccactgcaagcaaaacaaaccggcagaagagcctagattcagatttatcagatggaccagtcactgtacaggaatttatggaggtcaaaaacgctctagtggcttctgaggccaagatacagcagctaatgaaggtgaataacaacttgagtgacgagctgagaattatgcagaaaaagttgcttggaaaagatgctaattaatga

SEQ ID NO: 1493 - DNA, 55998 bp, Mus musculus
  misc_feature (653)..(1291): "n" at positions 653 thru 1291  can be any base
  misc_feature (12656)..(13095): "n" at positions 12656 thru 13095  can be any base
  misc_feature (20153)..(21482): "n" at positions 20153 thru 21482  can be any base
  misc_feature (25312)..(25675): "n" at positions 25312 thru 25675  can be any base
  misc_feature (33216)..(33235): "n" at positions 33216 thru 33235  can be any base
  misc_feature (36721)..(37194): "n" at positions 26721 thru 37194  can be any base
  misc_feature (42797)..(42816): "n" at positions 42797 thru 42816  can be any base
gttaataaaaggtgaattcgtgttacaagatggttcacacctatagtcccaacacaagagagcctgaggcagcagtagtcaaggccagcctgggagctacagtgagactggctcaaaacacaaagtaaaataagtaaaagcaaagagggatccttatccatgactcctcagatgggagcacttgctgtttttatggaggactgggggccagctcctggagatcagcaaattcagctccgtggggaccaataccttttggtttccagggacacttgtgcacacgcaggcaccacatgcctgtgtgtgcacacgcacacacaaaatacatctaaaataaacacatactgaaaggcagtctttcacagctgtaatctcagcatttgagatgctgaagcaggaggagagtgaagttaagggccagcctgagagctacagactgaactctgtgtaaaattaaataaagaaattgtggggtggtgaaacctttaatcctagcactcgggaggcagagacaggcagatctctgggtttgaggccagcctggtctagagagtgagttcctggacagccagaaaccctatctcaaaaaacaaaataaaaatagatggaaggaaggaaggaaggaaggaagggagggagggagggagggaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgatgctatataactagaactggtgagtaaagatattttttccatccagatgttaaccaggcttgaccctgcttagctttcaagtacaggggatatggccatatatgatcgaagttacttctacagtggtttttacgtgtgtgtgtgtgtgtgtgtggtggtggggggggggtggagctgggttttgggtttttttgagataggttttctctgtgtaaccctggctgtcctggaactctctctgtagaccaggctggccacacgtgtgccactactgcccggctgagtgtgtgtgtgtgtgtgtgtgtgtgtgtgtttaagacagagtctccttaggtggtaaccacctgccacagtctgggatgacaggtaagtgccatcttgctagggtattaggtactcactctgctctgttcaaatgttgggtatcttgatattttatatgggtgttgaagatttgaactctggtcctgactgcccagcaagccaaaccatcccctatctctttgcctgtcatttcttgagcttccttataactctttattcagagttcattgggatgtattgtatgttttatggtaccttaaatctcaagttcaaagatatattgtaagtatagcattattccaattcatcgttgatctacaaaatcagaagtggatacgtcactaggatggaaaatgtcaaagcctgttagtgaattagtgagaacaagctacagtaatgaatcaaatacaatacgacatgccactatagtttctgtcttagaacacaggcctgtaatcatagctctgtgggaggctgaggagggaagatcacaggttccaaggcttgcttgggctgcagaatgagttcaaagatagcctgggctacttagagagactgtttaaaactgactagtacaagaacaagtacttttgggggtagctcagtaagacaacacttgcctagcatatatgaagccctgggctcaatcccaatacacaaagaaaaaaccccacaacaaacaactttgtgtctgtatcatagtttctcccttcaccctcagttttgtcttaaatttatttgtttgtttgtttgtttagtatgtgggtgcacatggctcacgggtggaggtcatacgacaattcttagttctcccaccacatggctcccagaatcacctagcttaacagcaagcacatttacccagcaagttaactggctgactccccagtttctctcttgatagacagatgagtaagttgctggaatggctctaggggacacaggctgctgtgataggttctacgtcataatacatggttgccccggccgttctgtggcatccttctcccatgcactggtgatctcaggccctgaaatggcaggctcactgccgtgtagactctcctggttagaactcaattccgtgatcccataagctgcaagggtagctgagaagcatggtcaagcttccactattcacgaagaagagaaaatggatgattttgggtgagtaattagcactctgtcatgatttgtattcaatcatccgagaagagcggattcctaacacacggagttcttggttgtagagaacattttgtataatcagtaagcaggatcgttagtgtcacttctctggaaagaagttattggcaccgacaaagaacattgttcatgcaatagttatgccactgtggtgtcttgaaagaaatgtctcccataggctcaggtgtttgaacacatggtctccagctagtggcgctgttagccttagagcatggagcttccctgaggaagtttgtcactgaggcaggctttgtgaatgggtaacttcagattacttctgtttctggctgtctgcttcctgtgggcagctgggatgtgatttccttagcctccagctttggcccacctgcaatcaggcctcccctgctgtaatgaactctgcctctggaatagtaagctgaaataaactttatctacaagtcggtttggtcatggtgttttatcacagcaaccaaaacgaactaatacaaccacactttaacaaatacaaaaatattgaattcctacaacacctttttaaccttaaaaaaaaaatcaaatttattaaggttctgtgtgtgtgtgtgtgtgtgtgtgtgtgtgtgcgcgcgcgcgcgtgttttctagctgaaacacaatataactgatctgaaatggtgtatgaaggggtatatttcagccttggtattgatttatttttcaattgtgggggtcaggcaagtactctatcactgatctatatccctagattccttgaactcaccctgaagccccagcaaactttgaattttttatcctcttttctcagcctcccaagaagctgagggtattgacctggagcacccatctatccatttctacaagcgcgagcttggttacctttttgcccacaggaataccagttttaatgatgtgtctgtgggttttgcattcattttgccattaacatttttctggttttcccacagtgttctttaaggtgtctacatcgtgccaggagcccagggaccacttgcctacttctggacatcttcactgtaatgttcctagccttcagcttcgatctgcacctaagtctgaaccctgcttcaggtcaatgctaaacatgtaatgaagtccctttcccagtaagtacagcaaacagagaaacagggatacttgagttatatgtatcctaaccttccacgcaggctggggaggtggaggcaggatgatctgaacttcaaggtcatgtcagctactcaatgagtgaacaaggccagcctgttctgcgtgaccctctcgacctttacgctggagacagggcattccttttttgtttggtttcctttagccattatgaaagtgcctgggcagcagatccccgtgctgggcccgcatctcgtcccacacgtttcccagtcatgcatgctcttctgctacagctaacagcagtgctgcgccacactgatctagacacaaagttccatcctgccgagtgaaatgtatttgtcacccctgctaaattttccttaaataagtccaagtgcaagtgacaggatcgtgaaacacaagaggcgtgtaagtggcgttcggatcgatcagccagtctagcagagaataggtgtccttctgctgggtgggagccctcaaagtcctaacagggtcatcgggtcatatgcaaatgatttcagcacttttctattggggctggtgagactgctcagtgggcagaattgccaccaggtttaatgacctgagttccatccccaggagccacatggtagagggagagagctcactcttttgggctgccctctgatatccacacaaaagtatacattttaaaagactaaaccccccccaaaaacctttatattcaagttacaatcatctagagtgtccagagaaggcttaaggccttgcaatattcctcggggatggcccaacatttcaaatgaaaatatagtacaaatttattaatttatctgagtgcattcagcagacttctaactccaggagactagtgcagggtacaactttgaatatttgtcagttcgaatgagagttgctattagagagcggaggttccaatgaggcagacatgcctcggaagctaatgaagaacaaataaaaatgtgctagaaggctcttggaatagtttatttgcatccccatattaatatattccattttaatattgagacaaggtccggaactcactatgtataccaggccagcctcaaactcagaaatctgcctcttcagtgttggaattaaaggtgtgcaccacacctgtctcttaatgcattttaacaattttcctatagaggtgagcttcaactccatattgattaaaaaataaattaaatactcaaaattagttgatattactctattctttttggtttctcctgacagggtttctctgtgtagccctggctggcctgggactcattttgtagaccaggctggcctcaaacactgagtttctcatgtctcccaagtgagattaaaggccaatttttctatattctttagttaattgcctttagttaattattgttaattgacttcatattccattgtcttttttcatatttattttacacatatgaatgggtactctgtgtctaggaattagatggttgtgggccacctgtgagtgctagggatggaacccagtcctttataagagcaataaatgctcttaaccacttggccatctctccactccctgcattgtcttcttgctattgttttgttgaatgtttcatgtagcccaggctagccacaaactcactaggcagcaaaggatggccctgaacttctgaccctcttgcttgtatcttttgagtactgggtttgtaggtatgcatcactttgtccactttctttctaagatttattcatataggtgttttgtctgcatatatgtatgtgcaccacatgtgcctggtaccctcagaaatgaggacagggtatcagatcccctgtaactggagttacagatggctgtgagctgccatataggagctggccacttaattcaggttctatgcaagaacagcagttgctctaagctgttgagccatgtctcctatcttactttttttttatagtcatattttatttttaaaaatttcagagctgagcagtggtggcgcatgcctttaatcccagcacttgggaggcagaggcacacatggtggctcacaaccatccataatgagatccgacaccctcttctggagtatctgaagacagctacagtgtgcttacatataatagagaaataaatattttttaaaaattcatttgtatgggtgttttacatggatgtttgtataccatgtgtgttcctgatgcccttggaggctagaaggcaccagatcccctggaactggagttctagacagttgtaactgccacgtgggtgctgggaactgaacccaaatcctgtggaagagaagccagagttctccattgctgagccatttctccagcccaacttaacttttaatatagagatcttgggtaggtcagtctactcctacttccatgctggaccaacaggaataggctatcatgcctgacttactgttttgcccaatagcccaggctgcctcaaactcattgctattataggtaggagtcaccatggtatatattttttaagtgacctgtagtaactatttttggttagtactttttctccatgaccaactcagtaacaaagtaactattcaatcattaaagcattttaaaaaaaagtcacccaggctagccagatggctcagtgggtaaaggtgccaagtttgatgacctgatttcaatctctgggctccacaaggtagaagagctgactcctgaaagttgttctttggtcttcagacatgtgaagtagcacatgtccccagcaacacacaaaaatgtaatatacacttaaaaaataatctaatgcttcattaagcaatagaaaactatgagtgactttttagaatttggacttcaacattcctttgctattcaaatcaaaatgcagacatcctcacattgttaccatggggtttcaaaagaataatctacatttctaaaagctatttatatgtaaggacagaagagcacacaggcaagctggagcctttccaggtcattgtctctgggatccaggcagccaagctccagggtaagcggaaaagggttatggctaggttccagtctagatgcttcaagttaaagaagttcaactgtgcacacgttagcttgactaataaaaaccaaagggcctgcatcttcagagactgaacaaaggacccctcgagttaaaacagcagcaacgatgtgggtatttctaaagcaggacttctcaccatgttggagatggttgagatggctcagcagttaagagcacttgctgcactcacagaggacatgagtacctgtcccagcacctatgtgtccattcacaagttcctggaactccagctctagaagaacgtgttccgggctagcttccttgggcagctacacttatgtgagcaggcgcgtgcacacactcgacacataaataaaaacaaaaccttcaagacacatagaggctaaggacacccactgctcttatctttgagaacaggctgctcattagtttgggatggttcttggtagcccttgaaggtgcccttcttacttgaagcccactcctttctggggaggctcaaaacttgatttgcatctcattaattcccagcaggaatcaaacactgctactgactgcctagtccttcccccctcccttgttttttttcaggcagggtttctcggtgtagccatgggggtcctggtcctggaactcactctgtagagcaagctggcctcaaactcagaaatccacctgcccaccactgcccagcatcagactgcctattcctcgaagcctgttgtagtttcagtctgtaatgaggaaccgcacctgttccaggtccatataaaaattctcccaagagaggttgggtttttcttactactttcctgaaatacagatcaactgggagcagtacctaccactaaaacacacaataaaaatgtaatttaataaccctgtaaataataattacacacattcatatatatatatatgtgtatatatatatacatatatatatatatggttcagcttctatactgactgacaccgagtaaaagccatctttcagttttgtgacactaaatgcaaaagctgttcttcaaaatttgtaaaaggaagatgctccaaaatgaagtgatgtctaacactttcagttttctattctaattagtctctaacactttggtttctcttcatatgaaacttccacctcttcacaattctgttttcttctgtccctgtcacttgagctcttggcttcttagcagaggaggtagaatggacacctccttgctccgatgtgttttgagagttattccttggaaaggactctctcacaacactgctgatagcaggtcctcaacttcagtgtttaagaagcaagcaagcatttaccatccaaaagaacaagaacttcaagacttctgctataatagattttgtacactacaccttcttaaaatatttgtaataaaaagctattattgctttaaaaaccttatccagaaacatgagctgatacattggcaaagagataatttggagttctttgtgtttttaaaaggaaacaatacaattgaaacattccagatatacagcctttgtaaaaattaacaaaaatctaaggataagaaatgtcaaatgaacaacgtaaagaaattacatatttacccagatgaaatggttttattttgtacttacagctacttagaataaacatttatcagctttcaaatccatttgtttgatataaaagaactaactaaataaaatacttagttctaatgtctcaaaaaaagaattactttgggggtgtttgcagaagcgtgtagatgaagacacataggaaaagacactatgataaagttgtgtgaataaaattaaacatgtatcccgtaatttgttcacagccggacatccacatagtaccatgaggtccgagggctgcccataagaagctggtaacccaatgggaaccagggctgtaaaggtttcttaaaaaacgtaacgtggtcgaacaaaaacaaaacccaaagcaactgtaagacctggcgtaagtgccccagttagcgactctttggcaatgcagatccaaccagacgattagaatgaaacgtgcaacgctctctctcaaaaaatcctataaagcccgtcaattatgttcggctctgagaatcggcagttcccagcaccttccttttccactttttaatattttatacagttctccatctgcggcctttccattcattaattgccctatacaagatccccccgatgactctcggggaattgcttcttttaagacagggcatcagattgccaagcctctggggtcgagatcgcgccctcgctcctttggatgtgggagcgtcatgcacttaagacttgattatttaattgcggagatgggagcagaccggtcggaggggttgtgccaagtgggcaccccggggtgtgtgtgtgtgtggtgggatttgtccttcgtgcgctccaaaaatgcgcgccctccttgggcctgccttgtgcccgcgcgccccaggcctcgtccgcccgcccagcacccagaggatgcccccgcaaggaccccgcccctcccgtgtccacgcacctgcggccccgcccccggccacgaaccttcaggtccacgcacctgccctgccttccctcccgcccccagcgcgcaaccaccaaggtgcagccgcgctcctcttcggcggccccggtatctaaaggggtccgtctccggcaccacagccaaatggctgagcctccctggcccgctgcgcaggatgcccattggaccctgccccccgccgccaccaccactattggctggcgtccgaagcctcgccatttgattggctcttgatgccgccgctccacgcaaggagccgcaggtcccgcctctacggcgatcaggttagtgtgcgccgcgggtgctgggggctcgagaaccgagcggagctggttgagccttcaaagtcctaaaacgcgcggccgtgggttcggggtttattgattgaattccgctggcgcaggatcctctgcagaaagagagagcgcgagagatggagatggacaaacggatttatttagagctgcggaacaggacgccctctgatgtgagcatttgccaaaaatatctctgtcggtccattctcctactttgtgttatgtgtgcgtgtgtgttttggggggaaggcacttttttatggaggggggctccggggaaggtgtggggtttggggtctgactgcaaatgaattgcaaggttggatggcgggggtgggggggttgcaatgccaccggagcatgtttcgtccgccgtcgctgctgcccttggtgtgtgactgactacctgtgcgtgtgctcccgcgtgtgcgggtatgggtgcgagggtgtgcgtgcgagtgtgcacccagcggggggccggcggggcgcacgcgttcgggtcggagggaaggcggcaatctcaccctcgtccgagctctcagctcccacgacttgcatctggatggaaaagatgatcgaggggaggagaagatgggctgcctcctggattaaacaacaaaaaggggttgttatattttagaagcgtaaccccctttccgccccctcccgcgcctgccccctccctttgcagtctctttcgctcgctcgcacacaataagttttgggcttcgcgagtccggtatagtttctgatcaatgtagcccgaggaccccggggagagcgcgtggggacccgactgctgcggagttgggagatggctcgagtttaaagcgcgtcttcgtttctctgcggggatgaggcgagaggtggggagccatatttgtaactttgtcgtgttcgtgaacgcgccctttctctccctccctccctttctctgtctgccttccttctcctttctctctcactctttccaccccacctttgggccagatgctgtcttttctcccttcttcctcgcggaaagggagggggggtaccttaggttaagggggagggattgtgaagtgtgcaaatgctcagataatcctcgcgcctccccaaccacgagcgtcgctaatgtaagttgcccggaggctgcgtcccgttctggcccccggctccctccccagatgccagccttggcaccctgacgcctcatcggcagcagacaccccaccttcccggtccttgcttctcctggggtgggctccctggcagccattcggcgcttggttaataaatgggcacgagaaactttatcagaacccgagctgcccagagctagtgccgctgtggggaccgacccagtctacattcttgcgggcacggcaggcacgcagctctgggatgggcagttcgtctggccgtagccgttatggattgggcagcggcgggagtatggcaggaggaaacttacaccggtgggaacagggaggctgggcgcgagcccactgcaaggggaagtgagggttggtgggtgactcgaaagctactgtttatttttgtctccctctcgctttcacgcactcgtgttgtctgcgagttgacccattcgagagaccttagggtctgcggtggaaaccctagccaacttcccctctaggctcggtagtagggagcaggagctcgcgggcgggaaagatctcgggtctagcctgagggtctggggctcgggcgagttgggggctcgcgtagcacgttgtgctgacctgtcgcccctccagccacttggcccctcgaatcctgacaaaggcaggcctcatttcctcttttctcctaattcctccttctaaacctgagtaagacttttgaaaacaagctcctttctgccgaccgcccatcctcacgcagctgtgcactggagacgtgctacagccttatggcgcgcagggcggaaggagggggcacccctagcaccaggacttgccgcgggggctgcctggttcgcccggtggcgtcccgacccagccagggtgcccgatcccggggggtggaagggactgggtgtggtgctggggggagggggccgaacgcgacttcccgcgtactttccgggaagacccctatatgtagttggggggcttcagggtcccggcgagtaggtgcgcagcagcgccggacccgaccgagcggttcacagtactagctgacccggagcgaaacggaaagcgggtcgaaccggctctttaaacttccccgagtgtgtgcgctgggggaggggcgggcgctctgggctgggcgcgatttctcacgcttcgccccctcgccgtgagtctgctgcccactcgccggcctccgggcttatggcggggtggggcgcgcgggtggcgggggagggggcacttgctgcgcatgggggaggggagggcagaaagctctcgaaagagggacaaaaggggtgggggaggaggaactggctttttgttgttgttttgctgggtttttgcttttttcaaataaacgtttttggaaaacagatcgttccggggaacctccctccccagagtcccccccacgcacccaccttctgcaacctctctcccaagtcgcatctcggggactggtggccgcgaagccgccgtactaggacgagcagccatgtttcccggggcgccggaggcccacccctcccccacggcggccgcggaccgggctccgcggggaccgtggcgcccagcggtggggggcctgagagcacacaggcacagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgaaacgatcgcgctggtgtttgcgccttcagcggaaatgattgggtggtgtatgggggtgggggtgaaactagagggcgggaggggctcagggctctttaatctggtggccctctgtaatgccgagggcgtcagccttctacccgggagggacgagttgttggatgcgctggggaaacgccctccggggctgggctctctagaaaggttggtcgagtttcaggtgggtgtcgcagcactctgcaggctgagggagctctctcgctctttatccagttcctcaccccgcgcctcccaccccgccccccatttttgttttggcggggaaggtaggtaactacatagtaaacgctaccttaaaccgaaagagaaataggatttttctttaaaaaaaaaaaaagtaaactgtccttttgtattgccttcagactcgggcagtttgttcctaatgcaggccccgatgtgggactcaaaagcgtgtgctaggcacatcgcaggctgtaggctggtgtctgcatgtagagactaacttccatggaagtgtcgggcaaaggctgctatcggagccgggagtctactttgacctctggaatgcgttgcattttttttttctgtccaggttgacttactgcctaattgggttcgggagagtggcctggcggtttgctccaatttatgcaagccaagcggggattgggggcagagaactgaatgtggccttggtatggggtgatcagttgactcttgtgactggcagctgctgaggcttgtttttgatctgaaggttccatggtgaggctggcttctgaagccacacagaccctggcttgagttcaccagctacaaggaggtaggatcctgccaacctgtggtctgggacagattaccttagtctacatccaacgttttgtacatgtgtcctgtaagactggacagttctgtttttatcaatcaataagtcactattggcttgagttggcccttcgcaggtgcttgatatagtcgcagatactggggagtggggaggaataatttagggccccttggaggtttaaaataacaactccagcaataatagcagatgctcacataactccttactgtgtctggcatgttgctaagtggattacagacatcagttaatttagcctcacaagggcactatgttaagtactgttgttattcttatactaaatgcaaggaaatggagtcagaactccagatcaccgccagtcggtgcagaactgggattctaactccgttagactcagcctctgtactgccctgaagcaccacgggaaggactttttctcctccagttttggagtgaggccacctattagcaagagggtgggtatgggtttgttggtgttgagggcacagaaacaaagcatagcttcctggtggagcgataggtgaaacagacaagtggagtgggtaggcattttaagggggagcctgaccctggtttggaatattcagtatacactgttagatgtttccggtaatgagaagacaagcaggagccattcttagtggttatttaggtgtcttatataagtagttttttcattagcctttctgtagaaagaaaaaacaatctcaggatagaatagacaggaccttagtgttgggatgtagccatgctagtaatactgcctagagccactcacctaaccctgcctgaagttccttaaagatagccaacctctctgttctgtggatggatcacttaggactcagagtcagcctcccaaggtagtctgtggacaggagagaatgcaggttctgtagttgaccaaggcccatacatgacctatattaccagatcatccagggaaccggtaaaatgcaaatgtctgggctccaccccctgggtgtgggcttagtaccaggtcaccgtggttcgctctttatgctgctgagttgaaaacagtttgtatgtctaaccactaagagatttgggaatctgggagcgaacctttgaatgatcctcctccctacaaatctcgctcgtcgagttaacaaagttgtattaacgagaaaaaagattgtacttattttgaacttgatcaataaaagaattaagagggagatgtgtatccttttgttataaaagcacctgtgttatgttctcaattttgcttcttgaagtttactacctggaaagttagttctctttgtttagcaggcaggggaggtccctggggtcctgtgctttgttcttttaggaatgtggcaagtcctacatttgatggtgcactgtgaattttccaagaccttctgaatatgcgattaaacaacttttgatcctcatagaaatgggctcccgttcacaggccttcatgagaagttgttctcattcctggctccctatggagcagtcctctctgtctcagaggtagagaggaggaaatttaagtccagggctactgaagtttgcaaagctgcttgctgtatacctagtgactagtgagggtcaggacatatcaccacagtccccaggtcaccctggcacctccgtcccaggcctgctgctggggggggggggggggggggagacagcacacagcaaagcagaaatggctttgggttcaaaacctttgtctaattgcctcttaatgcttgggccactaagcagaagtgtgtggaacgtgaagttcccggcagcagtgtcagaccctgtcccctccctgggctggggccacattagtggcctctcaaggtgacttacttgggactggtgcagttaggcatcttctgtgcagcactgtgggtgacctgactcagtactaactcaccactctgaagagccaggcaggagctgtctgccagctgtctgctctcctctcctctctcccttctatgtcggagcccagggcttgttgctgagtggctgtggtgggggtctgatggaatgaacttggcctagcattctggcctgaattctgacctgagagaagcagctcattgctacggtgtctaaaagggtgttttccttggagcatccccttttaggctgtgtctcctgggacctactctccatcggtgctcagcacctgcttcccatagacaggtaagaagaaaaacatgaaccagacttgagtcttttttttttaaacatattgatttttaaaaattttttagatatatttatttttattttatgtatatgagtacactgtcactgtcttcagacacaccagaagagggcatcagacccccattacagatggttgtgagccaccatgtggttgctgggaattgaactcaggacctctggaagagcagtccgtgctcttaacctctgagccatctctccagcccctgacttgagtcttatattacattggcatataattatacaacaaatactgagttaaagagagggctcctgactggactggaggtagttattcagaacatttcagtgatagaattggttgaagccatgtgagcaaaacacccatggcctcaacacgtccaattccagacctggaaactgcctcctagtatagaaccacgtgtcccggtgacaccggtatctttcttcacgccctgtcctctgcggtgctccacagcaccttccgggaggtcccttcaaactgatcttgtttttactctgttctgtgcaactcccctcacccctgacacgcccagtctaccattttctttaccaaactggctccaggcagcaggtctaaaagatgagcctacttgatcacttactccagcgtggattgcagtccctgcctttctcccagaggtatttgcattttgagagtctggtttagtgaggaaattattgagaagaaccattaaagacttggacgcacttctcagcttggtcattaacttgagttggacaagttgttcagcttctctccttgtcgtctaaaatggagtgggaggggggtcgggctggggttgtagtgactgttgtagtaattgtagtaacacaattactagagttcttatctagaacatacagagccctaggttctgttttctgtactttgtaaggcagatgtaatgccagcacttactgcaatcccagcacctcgggggtggaggagggagaagttgaaggtcattctctgctccatatcaagttcaaggttagcctgtgctacatgtgaccctgtccaaataaataacctgagggtgctgaattcaagcccagtgctgttcagattttttgaacccactagtaacaggattcacaccgttgctcagcacatgcatattatttttttaaacgtgaacacttttgattcactgaaaaatatgatagctcagactcataagttgatttcactctattaccgtttggaaaatattaaaggttggagattaagcttccttccacagttttgccttttggtgtggggctggagcttgccctcccgagccttgtgtagtgtgtgcagcaacacaacagggcttttcccaatttcccaatttcatggcagctcactgctgggtcctctggtctccagctgctctctggtctaccccagacaacctcatggtaaaagtagccattagcttaagtgtgtattctccatggtgcctgcagttattggctacaccagttctccttgctacctcgtcccctagcccctcctgctgtgcactatgaagagcagccacactttcttttactgagtcagagcgttttttagagagcggtgcctggtacgtgcctgtctctcactcccagtcctggcgagttgcctcacagtgtggactggggtctccaaagtgaggctgtcaccaccaacagtctcaggcaccagatgcgtcactgccgatgtgctagagtgtgtgagctggcaggcgcttaaaaagagaaagtgaggctcgtgaggtggctcagtggtaaaaacacttgccacgcggccttgacctgagttcagatcctcaaaacccacataaaagctggaggtgtggagatgcgacatgggcagctggaatccggggctccagacaagagactaggcaaactacccggaaggttgctgcgggcaacagaaaatcaacagggcctgtctcaaaaaaggaggaattgaaggaccagcacctgttgttgcacgtgtgtgtatacacacacacacgtacatacatacatacacatacacacacaaaggctgacattaaagtggtacttgtttctgtaggaaaggaggtttgaatctggagatggcatccagatgccactgtctgttcgggatcagctgcagcagtgcagagcagcccagcccttggctctgcactgccttcccaccagggtttctgtagaggtcgatgcctatccactctatccactgccctctctctggaagctcctttttcactgcacatctgctgcttcaggcattctctcagatcgcctcctggtccttcaccctctcccagcctgcagcagcttccgtaagaaatgcctatctcctggtttcctaggaagtcctttccctgcagtgtgtgtgtgtgtgtgtgtgtgtgtgtgtgtgtgtgtgtgtgtgtttgcctgtgcatttgcatgggtgccatgctcctagaggtcaaaggcagtttgggggagttagttctctcctttcaccatgtgagtttggggaatcaaacagagttggtagcaggcagagttcatttacctgttgaggcatctctccccaactccactgccccactggttctctttctatatagattctttttcagctgaggatgcttctctggctttagagaactggtcctggacgggggaagcaatttggcaactgagacaggaggatcacaaagttatccagggctctacaatcggaaccttgcctcaaacaaaacaaaaagaccagacccccttgattgagctggatccctccatagccgctgcctcctgtcttttagattattgtaactgggtttaccctccctgtctcctctaagtagctgtgatttttggatatggctctgggaatccgtcagctctttcatgagtcctgaggtatttggagtcctagactttggtgaaaaaaaaatccatctttctgggcatgcttcttatggtctgtctatttctcaagcttctaatattttaaactcagttggatgtgggacccaggtgcccttattctatccttcttccctaagacagcttctccttagtggatgtgtacgaataccacatgctgtctgggctggggtgtttacctcacagtcacagtatctggatctcagcagcgccctgtcctcagggaacccatggcctctgtaccctgtcaaccaccccctccccttctacctaccacaggtcctatttactatactgttcagtccatcccagataacttccccataccacagttctggtctctttgaagccaggattccaactttagccaaaaaacaaaactatgatccaatcaaagcacagatgacggttgacagtgtcttttttttttttttttttaatcctgtgtgtaaaattcaccaccgggataaagtctaaaaatccttagtactctaagtccgcccctgctggccttctaactggtctttcctctctggcactgttctccccccccaccccagccccttcccaaaccactcccatcccacttcgcagttgactcctccccttccttcctgagagtctaagtcagattcttttaaaattttgtgaaactttcttaggagttttccttgtaattgcacatttctattaattagcatctcttccccctgggaagccagtatgctgtgtgctttaaagggacctgggtttccttcacccctgggtatccccagggctcggcactgcattcacaagcattctctagtgtttttggagtgaagaacctgtacgcacgtggtccggtctctttctgttattgttcactacagggtttctctgcataacagttctgactgttttggactcggtttgtagatggggctggcctcaaactcacagagatgcctgcctctgcctccccaatgctgggattaaaggtgagcaccaccacgccctggggactggtctcttctttatacccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcaagacaggtctttccttgtagtgccaattggcctagaactccctatgtagaccttgaactcacagagatctgcctgcctttaccctctaagtgttcggattacaggtctatgctatcacgcctggcttgcttgctttatttttaatttggttgtaaaagtccacggtgtaaaagaagtgcctgtaccatgccaaacgctgtctacgggctgaacgtcccacccctggcatggaaggcagggtcgaggatagtcacagcctccacttctaagccagcctgcctcaggtacccagctcatccaaggccactgctgcatggcagcttgactgactgacgattagtgtgtgtgcagatccaccaaagcccactctgatgctcttgaggctccaggggatctgccctgtgttctccccacagatagcctgagaacccaggagtgggcctagtgagaggccccataccagaggctcaggaccaatgatacctaggtagtttttttttttttctcttgcttttctatgtttgagaatgttaccagggaaggttctgcagcaggctggaagatcagcgatgggagggaaggatgagggtctgattgtgtgtgtgtgtgtgtgtgtgtgtgtgtgtgtgtgtgtgtgtgcataggactctgcagccagccatagggcccaggcctggatttctccattggtctgtgtcctgctaaagtcatgaggaccatgggggtaaggggactggcaaggtggaggccaggacctgttatagtaaatttagaaggaccagacatttggggaagggattcagtcctcctttttgcaactggtccaccatcttcccttgactttacaggaaaccaacatggtgtggcctctgagggaaatcagaggacccccgcagtcatattccctgtccgtcagttgggttcaacgtactggccttggaagaaggctgagttattctcctaagccatgtgcacagctgacttacttaattgcattctctttctgtggcttgggtggggcagaggtatgggaggactagattgccgagggcggtgatgcccatgtcttgcggtggagcctgtgtgatagacaggaggaaagaatgtggttaatgactcagattgcagcctcatctggcatcagaactaccagaggagcatctgagggacttcccaggctcttccccaactgctgaatctgtctctgcgtggtaccccaatgcatgtgtttttaaagccctaggggggatgatgctaaggcacactgaagcaggattcagatcttcacagtagaagcaagctaaagggaagcaaaagagagtggaactaaagaatggtccaggcttttaatgtgctgggctgcaagggcccatttctccgcctgtgtctgtcccctgcacctcccctcccccgccaccccacccctcgcccccgctaaaggcagtctttaaacattcctactttgtgcttatcaaacttgtatctatgtacctgtgttccatgaggctgctgctaccagagtatgaccaagaatgggcctggttgggctggagagatggctcagtggttaaaagcactgactgctcttccaaaggtcttgagttcaaatcccagcaaccgcatggtggttcacaaccatccgtatgagatctgacacccttttctggtgtgtctgaagatagctacagtgcacttatttataataataaataaatctatataaaaaaaacaaacagaataggcctggtgagatggcttagttgctgaagtgcctgccctctgagcatcaggacccagatgcccatgcatggttgtgtatatctataataccagtactaggggcttggcagaaacaagaggattcctgagtgcaccggctcagcccagtcactgagctccagtttcagtgagagaccctgctttagaaaatttgatgaagagctattgaggaggacatctgatgttggtccacaccatgctcagaaagagttcctcctggactcagtggagggaggagaccctctgcgtctatccaggtggcatacaggatgtgaaggcgtgttctatccccttgtggattcccatcgtgtctcacgtgctggttgctctccccggttcacctggtcagtgtttctttgcgcacttgccagggaacattccaaggttatgctgagtccagtgtggctcccccacagctggagcaggaaggctccctggtgaccaaggtgcttctcagcttctgcccaactgcttgtgagaagcagccccatccatccacatgcaggagtgggagctggccttcctcctctgttgcatgtccccccttgccatgaggacgtcgagctgtgagtgtgctagccagcctcccctcgccagctctgagaggctggagaagcttctgcagaggctggcctgcagccatcgcaagcagctacttctctgaacaccggctagtttgcggctccattacagacatgcttatatacgtctatgggtgaatgccggtggtgtaactgttcttccaaggaggagtctggggtggtttctggagcaacactctgggctgccgagtgggatgtggtggcaggagcccaattggattgcaggctgtctgtcctaagccacaagggtattgaattcagaccatgtttgttctctgggagcattcaggaactttctgtccactctagtggcctgtgtggtcatcgataggagtggcacaggacatgtttacatgttgaccagtggctgtagaccccgtctgagggggcggggtgcccattgcaccagaacacagacttgtatcttctgaatgcatgagctccatggaagttagggcatggatgtctcagtggtaagcaacgcttggctgctcgatatttgacattaaccagttctatgcggcttgtccagtgcttcccagctggcaaacagcagtgcaggtctggaatcccttcccactgtgacccccggccttggtggtttctgttctttctttccgcacacagagattgaacacctgctgtctgctgggttttttgcaggctgtctgtatatgacagttatgcagataagcacatcaccagtcctgagcacacacagcctccattcatggcaaaggccccactaagtgccatgaaaacaaagctgtggctcagggaaggcttcctggaggaggtgacattctaatggacagcataagaacactcaagagatcccaggagaataggatgtggattgacatgcctgtgacaccagaggcaaggccaagaggacatggcaagactgagaccgggatcgactagaggcagttccaggctaacctgggcaacttagtgatactctgtgttaattaagaagtaaaacagagagccgggctgtagctcagcggcggagtgctggcctagccgcaacagaaccctgggttcaagtcgcagcactacccaagggttggtgatgtgttccatcactagggaggttgagtcaggaaaattcaaggagggaggagagaaaagggatgggatggacaaacacgaataaactggtacaagagtgggaaatgcaaaattatgttggggctggccagtactctgtgcactgcagccttagacaggaccttgccatggtagaatgtcttgttactctcttaaggctcagaccttaaataatctgaactttgaagtatgtttttctaggtttgtttatttatttatatatatatattgtgtgtgcgtgtgcctgtgtgtagggggtggaggttcaggtgctccgaggtgggctggacagtattatactgctgctgctgttagtcaacgtgttgatgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaccccacacacacacactttccttcatctttcctcactatgagcttgggttctcctggtgctctcaggatgtgccaggttcttagggaaggtcctttcccttcatgactgacatactttatacagtcaggtttgtgctcacagatgagaaacatacccagaggttttgacctaggtctagaaagtaggaaaagatgcatagttttccaataaaagtaggctaaggtgtaattaggggcctagggcctgcctccgcaaacaggagcagggatcggataggcagcctctttagcaggagcagagtagcacccctgtgactcggcgtggcgaccgtgtatgcagagcacctccctaccctgttaagctaagccttctcctgggataagaggtggcttccttgacctttactaagtgcctagggtgagtttgcggtagtgcttgttgttagatacttggtaaacattaccttttggatctattagcacatcccgaggtataggctgggccacttgtttttgagataaggaagacaggcccagagaggtcagattggctaactgaacctcgatcctgtgttgtgatgccccttccagactagacacccttgggtcaggaggcaaggacaccgtttccactgtggtcccccccccccccccccccgcgttgtagtctccattgagtgagttctagcattgagggataaattgaggctgagtaaccttctaatcgggaaaggtgatgaggcccttagatttgtaggactttgaggactgtgaccttacaatcagggtgggatctgatttaagtacttgtccctaagccaggggatataaagtgacatgtgccagcttattgtattccatggttcctttattacactaaagatcagaagccacccaaaacacccccagccccaaagtcagtgttataggttagtttgagggtaaaggcaagaaaaataagattccagagttctaaacacaccctggagataggtggaatagttactgggccaacagggagcatatatagtggggaagtcaggccttaggatgtcttcccaggttagttttgatgcctttctgatctacagaatttcctaggtgctaagcacaaggaggagtaggggactggggcggacagtacgtcatctctgttctctgggtacagcatcttgcttggtaaggaacatgcttgtgaaatgtattgcagtaatgccaagcacagcacagtctccccaagtgccttcctacccagcatctagcctcgttccctggattcctctgcggggatagatcttcttcccattctagtggtgatcactctgagttggcgaagtcttgaccaaagccacagttctgggctggggctgtatgtaactcagtttgtagagtttgcgtagcatgccaaagtcttgggttcatctccagctcagctgaaaccggatacgcccctgacttcctggtacttggatagaagagacaagaggatcggaagtttcttcttcaattgcaacagagactttatgaccaccaggcctacatgagaccctgtctcaaaacgacaaacaaaaatatgtctagattcttagtagaaaagtctagcgccaaaccagactgactccatctcaacgtgtccctgtgctaataatcaaagcagcattccatagggtgtccccatcgtgtggcagaggccacttccaccagaaaatgtggctatttgcagccttttgctcacgtgtcgtggagccactgtaaaggtcagagttctgtttgtctgagtcacttctctccttccctgtgtggggtccagggattgaactcagttcatcagggtgacagaagcccacggagccatctctccagccctcccacagactacccagctgcagcgtgtggccaagcctggttcccacttagcgtcttagccatagctgctccttccattgtaagagccctccctggtcagatactcttagggtcaagtatgcgcagaagacgggccttgggtagtgttgctggccaccctccagtgctgttctctgtcactgatgattttctgttttcctttgagcatcaatcgtgtatttatcactcactgacttaggatctgactccccctgcacgtcggagggcattggcattggttgtctgccatgctatttcttaccgcctagcttgatgtctggcatactgggcctgtggtctaagcaggtaactttcctccagaggaaaaaaagaaaacccaagcagcatctttagaagtgacccacaacacacacctagcagcgagcgcttcataagatattactcatccatatagcgggtgctcagcacagtttgtatacaaagctcttcttacagatagttgcttagggttttgattagcgtgggtctcccacctttctgcctaagcatccctagttccttgtcatcaccccggttctcagatgccttcccaccctggttgtcttcttcctcgcagtctgcccttgaagttctggaatttacagtttggtcttggaggtgcaaatggggtttgggacgctgccatcaagtgcctttgggtttttccccacttgtcttaaagtttttgttacgttttctgggcagttgtgtgctcagacatcggtgtcatagcatcatgtggaggtcagaggacaacttgcaggagctggctggttctttccacatgtatgcttcaaaagtcaaactcagatcattaggcttggtgacaagcagcttcagccaccgagtgccccccactcccatccttggtaggagagcttgaatataataaggcttgttagtacctgctaggcaagcattctatcagtgagccacaccccccaccatgcctgctcttttttctctcaacccagcctgaagagcttagctttgtctgtgtgggctgcagtgactgaggtaggtggggtgtgctctctcggagactggtctccccagcattgtcacctatttccagccaactagcccctccctgactctcacagtcctaaaagttgtaacattttgttctttagcattttaagattaaagcaagcccggtagtggtggttcaggcctttaatcccagcacttgggaggcagaggcaggtggatttctgggttcaaggccagcctggtctacaaagtaagttccaggacagccagggctacacagagaaattctgtcatgaaaaacaaaaacaaacaaacaaaaattaaagcagttgctgggcagttggtggcgcacgcctttaatcccagcacttgggaggtagaggcaggtgagtggaatctctgtgagttcaaggccagcctgctctatagagcaagttccaggacagccagtgctacacagagaaattctgtcttgacaagaaatgaaacaaaattaaagcagctatagacctgtgaacaacagctaactcaatctgcattctatttttaaaataattaagtataggtcaggttccactagcaagaccaggcggagaaaaaacggcactctggagctaaaccaagccaggcgttccccttccccctttccttcccctcctccctttcccctccctttcttcccccttattgccctcctcttccttctccttttgccccttctccctgccctcccctgctccttccaccaggagttttagcataagtatttgatttgtccacttaggcaagttgaatgcatcctgttaggctagggggaaagggctgattaactcacttcttatgcattaccgtggctaataggcgaggctcttctgcgtgattgctgcccaaatcatctgctccccattggagcttgggtgccagacttcagcaccaggaattgctcagctcgtgtgattgaggaggctgcttgtcaggtctggtcaaggtggcaggaaggaagccaagggcaaaatttcttctctgaggctattagacttcttgtctatttccatgccttctggggagtgtaaggcctggttgagaggaggtccagctctagtctgggcactaccctctccgttccttttatttgttccagttttctcctgcttcaagcagttccccctggatagctgagccctaggctgagaggacggggaacagcccaaggtttccatcacagactaactctgatctttgcatatataatggttggcttccagctcattatgtggctgaggatagctttaacctcttgattctcctgcaactacctcctgagagctgggactactggcacttcatcaggcgtggcttatctggtgcttgggatcaaacccagggtctcatgtgtgctaaataaacattctaccaacttagctgtagcaacatcccctaagtgtgtttgtttgttttggtttttgcaaagccaattggaagtggggtagatctccaaaccaggagactccagtgtcctggcctgtgagtctgaatgctttttgccttcagggtttagggtggtcacagtccttgagttgccagtctgtgggcctttgaacagtgaatctggggaagtgatctcacttgtatctttcagtcaacatctcaaggtagaaaccccagggagtgtgcccagcttcccacaacaggcaaccatgagcccactagtggtcacagcatcacttaggtctaaatctcctgtctgatttcagcagctggttactggcatccctcagttggcacatctgctctgcccaaccgtggttcgagtagaaagggagtcggccatctagaaatttctctagaacgattgcccacctccagcctgagtggctttgttcccatgtgaccaggagcacagactgatgccagcccctctgtgcagggagcctgggaaggtggactgagtctttagacctgtcagaggctctcagagggccttggtggacaggaacatgctcctgggaatggtaggggagggaaggtagccttcctgtgacctgcaatgtcatgtggggtgaggcatagaccgctagctgccttgggaagacgtgtgaggttgggggcctgggaatcctgctttggatttgcacttgacctccatgaccattaaaagttttggggaggaataatgctccacaatgtaacatcactggatctgtggcccaacccttctgaatccagcttttctattgcacagggacagtgctgcagctctttagtgcgaacatatcaaccaccgtaggtttttatcaggaattacactgtgggtgagtgaggtgaggtgtggggtcttgttagtggaggtggtttctgcccgttccccctaccacagtcggggcttgggtgccattgggtgcttgctctctgagatgactgatgacactcccacatttggaacctcacaacctgggccgctggggactacttttataatcgtggtgtgcagaaagagcctagctgatccgtttctccgttttagttattacctagaataatgaacagttttgtagttttgcacgctgaaacctgagctcttccacgtctaaggtccctgtgcctcctttagggagtcctggctgaggggatgttcatagacatggaattttaggacctcatctctttattccagccccactgcccagtgtgtaggctggagggaggatggggcagaagcccagagtggggaagcaacttctaccagggcacacagcaaattcagagatacagcagggacagaagccaagcatcttgcagtgtgtgggtgccttttgactaaccggcccttttcggctatctggactagtgctctgcggctgactgtatgccagcccctaccggaagacaggaagggaactgttaagtgaatggagcctgctacgtttgaccatcacctccggcctcccaagctctctctccgcactccatctctctttcatcaccgtactctcctccttggacagccagtcagaccctacagctgctctctaggctgtttccagcttctttggtaactttctgttacttgaaagttgagcgggaccagggcagggccaggcaaccagggaaggtttggttgagatgggaggcaggaacgaggctttaaatggagggctacttggggcaggaattcgcctcagcagttaacagcgcttgcttgctactcttgtcgaagaccccggtttggttcccagaatctacttgtggctcactggcgtttgtaacaccagtttcaaaatatctgataactgtcccctgtgagcatgcacatagtacaaggcatgcaggcaaagcactcataacacattttttaaatcttttttaaaaattaaagataagaggaacgcaaaggctgggggcagaagctaggtatccttttgagcaagcctggccagcaccgagcctttccagtgagtggaagcgtccctagcaccgaatactcctgcaaggaaagcacaggcgaaatcacccgaccgcgcggggaagagtggggaggagccagggacaagaacgagtcgcagggctggcgggctggtgcagtctcagcctgccctgccagctggacctatgagccagcctgatcttcctcggcccgccctcctgcctctaagtaatgaggatggcgtcaccgttgcccgcgccacgtgctcccccgccgcctgcctgcagagctgctttgtacgtagcagcaaaaatccgaagcccggagaggctttcaattctcggggagggttttgtttgtttttaaagcgaagaaggctcatgcccctggctaagatcctgagaggcgttgaaacccccaagccctggcagccacaaggctgcaggaacttgggaggatggtggatgggccgtgggttctcttacttttggggatggcggtggggggcagattctgacctaggacaggagacgtgttgtggcagaaaagaaaaattaatcacccgggccagagttctctgcccagccgcccatcccccccccacccccccccaccccggtcctctgcagaacatcaatctctctggcccacttcaccccatactgagggccacattttaaaaattgaagtaataagagggctggagagatggctcagcagttaagagcacttggggcacttgcagaggacttggattctgttctctggactcagatccggctcctcacagccccctgtaattcctccaagagattgccctctgcaggctcccctacacaagtggcattctctcacagagacacataaataaaacttttaagtttttttttttttaaatctatagatgggatcctatgtgtagtgtttattttcaccgagtgtgcctacaggcaaacagtatgtgtgtgctctgagtaaagtaggttttgtttgtttgcttgctttttgttttatttgtattaatgtggctgtgtaattaatgcgtatgcatgtgcctggggagactagagagagtgcagaatcaatccactcccctccccagctggagctacaggcagttgtgagcctctgaccctggtgctgggtaccaaactcagacaagagctgcaagtggcttgcctgctgagccatctctccagctcctaaaatgtacccnnnnnnnnnnnnnnnnnnnncgtttattatctctgcctcaaacctcaagtgactcacacagcgtggccttctagctaggaatgggatctgccagcagggggtggcccatttaaaagctgacctagttaaaatccaggagcaccaaaaaacactgggtcaatctgatttgagtcttctgttcgaagcctggaacctggaacctaaattggtcagggactgacaaggttgaaaccaaaccacatatatttatccaattcttgttcagtaaaggaagcacaaattatgtctggaggttgggggtagaaaaccaggcaaagcaagatgtagaggttgaacccagagggtttgttttgaatgctctccacagctccagagcagggtgggaggcttggggtgttgggctcagagcctgtggcaggaaggcatggaggactgggcctggttaggagccttcattccctgctaccatcttcagtgtggacaccatgggcagagccagtggtaaaggggatggtgggtagcttttttttcttcaagctggcaaaattctaggctggacttcttattgtgtaatccggccctaggtcgttggcactagaattctgagaggaaactggaagcccagagaggtgagaagggtgagagaccagtggttcccactcttcttaactgattgcaaccatacaattttttgttgctacttcataactgtaactttgctatagtcacaatgtaaatatctgtgttttctgctggtcttaggcagacccctgtgaaagagtcgtttaaccccagagaggtggagacctacaggttaggaacagctgggctagagagaggaacttggactagagccaggtctgtctggctagagtccaccttctgcccatcctgagttgccatagaagttctgaaaaagtaaggggcggctcttaaagtgtcctttccccctgggtcattattttttttagtaggcctgtcgtagacccaagctgtccattctaatcagagccagcgccacagccatgtgacctacacacatagttggctgtcactgtcttagaattctatgtgaggctttgttttgtgttttgttttgagatgagtttcacatagcccaggctggtctcaaactcagtgtgtaactggggatggtattgaacttgtcatccatcttctaccaagtttatgtagtattggaaaaatcaaacaagagactagtacaggctaggaaagcatatgctatctaccaggtaaatttccagcaaggagcccaccatctcattttgcactgggctatagttacatagccattcctgaccaagacagcgcctctctcttcccggtctccgggtacctcttatctcccctcgtggcctttcggggctgtttaccagccagctgtggatttccagcctgccaccagctctctctctctctgtccgactcctcctctaccccacatcttggatcaccatggattctgtgacccttcagccaactatgcggcaggagtgtcttatgtagggagaactgactggagtgtgctgagtgctgcgtcagtttggtagggtagcgactgatcccatccgctgtcagggctggtgcttgattggcataggcacacacccaaagctgttgcgggaaagcatgagcattgatcccacctgctatagtgcactgtttatgcttatgagctgtttgggcccctcccccctctctctgtattcccagtacttattatattgtgcctggcccagtaagagggacatttgctaagcagtgctgtcccatgcgtccctctaggctgattatggggaaggacagtctctgacctctaggagggtcagatgcttaatatacgattaaatgattcatgctgctgcctctgagatcgctgcccagccttgggttcttagagccagctacagggacggcttcctgggagggagtcttgaattagatttgggtgcaatgggtaggtgacttgggggagggggaagcggccggctagtaggtcactaaccagccgtgagtgtttcagaagctggctagagtttgcagtttataataggctaagccgatgccaccgtccttttcctaaagaggtggaatcttggactccagagaacatgatatcattcagcccagatcagggggtcttgcatccagggtgaggttggtcaacagtagcccaggctatctcgtaaccacatccttccctgaggtcacggccttcaagacaaacacgcctgaagtaactagggctgtgacgaaggctgcagcgttagagagaagaaaggtcacatctgagaacttcgtaaggatcagacttggtggttttgaaacaaacgagttgttgtgttgcgtgaatgtgtttgtgtttattatgaagttcagctttcactggcaaggaacgaaggcagacccaagtctggggtgggggtctcgggtaaggtttacgaaggggagagccagaccaggctggcttcttatgtgaatgtgtggtgcctccctacagccagcagaatgtgaatgtcagcctcctgcctggggctgaacgatcctgtgtaagcagaatagccctggcctctggggctacagaggtaactgagtgcactggggtgctgttgttgttgttgttttaagggctagtggcagttgctgttgtgtgttaagggctgctggaaccgggagggcatctaaacccaaagtacaaatattcagtttaattttaacttgcagtttgctcacactcaggacttggcaggggaagtgggcctttattctatttttttttttttttaaagcacagcacttcttggatacaaaagggatgctgtcacatggaagggctagagaagaggctgccaaggacggaggaagtgggttagaaatgataacagttgcagggtgagtccccttggtcgcaggccttgggagagaggagggggtgggggtagagagagggcaggcagaagactcaggcagacgatggctagggttttccgctttgtccggtttgagccacttctcggcctgcgaggcttgagctttctacacaatactgcgatcttcgggtctatgccctggccaccccctaaacagtgccgggcacccttactgtctgtcaggaaggaggaggtgcagaaaagcaaaggagactgggaaaggctacctgagactttgccagagggagaggaaactcttgggggccccacacccagccggaggaggccaggttgagctctgcaccttggtgactgaggaggtgggtgtgatgcccaccaagctggtggaacaggaaagggctgaaggaaagccattacagccatggggacctatggagttgggtgatctctgggcaggcacagttcctataccttggaatgtcagagatgcctcaggggaccgcgctacattgagcagctagcctgcattgacctgtttgcctaggcagccacctgctgggcctgcatttcaggctaagtatttctttttcttannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggaggtgccgtgtccccgtccccgtgtcttccccaccacacacacacacacacatagaggcaacttccctagacattcccttgactgcccagcattaccttcccaccccaggtcctcttatgcttgctaatggcattaaggggagaggccgtcgaaccactctaggaaaaccacagatgactgcagtctctgaggagacaccgggatctgcccttggaagcagggattccctggaaagccagttaaggagaaagcctgtgcacaggagtccaacacctcagacttgtgtcccttgcccacagccgctcttcctccatttgctcgatgccctcagccaggcctttctctgcaactgtcttgccctggggtgaaggactccaagagcttcattcttacactctaactgggagtggcttgacctggacccgtggcctcttagatccatcgagaagatggatggagcatggccagggcagaggcttggagctcatgattcggggaggaaggtggtgtggtgttcctggctttctttccttcagatagaactgtgaatccctgctagggatggggctgtcctgcatggagcactcgctgtctctgcagggacccaggtgccccatagtccctgccctgcctattagcctggagtgaaccctgttgtacctctgcagagtggctgaagacaagtggtctctggaagaccagaggactctctaggccaggtcctcttagaggagaagtgcagccatgggtggggactggctcgtgagctgtttatgcagggtggtggtggggaggacagtggtgaccctctgagacgtgtgggcctgtggagaaccccatggatggagggtgcagcacgtccagtcagtattttccatgtttcccagaagctgcagggtagaagctgattctgaggcggagtcctggggtgcaggggtgcatgggggacaagtgccatcgggaggggtcagtcttctccttttagagtcctttcagcctcaagccaactctaagatctctaatcccaactatttcagaagcgagtcaggattacaaattgaaggccttttaaagctatgtgcagggacaattcagatccagtttaggcgactcagagaaagactgtgtcaaagtaaaaaggggtgggggtggggggagtgaactaaagggagcaggtgcttgcttgccttgcatatgtgagcgcctctgctcaaccctcgcttctataccacagtaaggttcctggtatcaccaagagactgggttccccaagcacctggcttgcccaggattaccttggtcggcctgcggactcctttggctgtttgcgccttttctgagacccactggctttcccctgacctagcatccatttgcggtgtttacccgagccagcaactgcccctgcagtgggtgtggtttggatcctcacgagtaacttctaccgtctcttgccactttttgtcagaaacagagaaatacctcccagcaccaccctcctgtccttggagagggagtgggtagggaccctcacatttaagtacgggctgtcttaggagtacaggctctctcatcctctatgaggcagggaccaaggaagacatccaagagccatgtggtccggtaactgtgccttgtatctctgtatacctaatattaaaataacaccaagtgttcaggaccacacgaggcttgtggctccattcttggacagcaccaaacacttcctttctggtgggaccatctgctggacagtgctgtctcggcatgaggatgtggacgagggttctctgctatgctgcccctgtggtggagcaggctggggacctgattacagtgataagggccaggcctcagtgaacaggctgaggccagagggaggagggagagcaagcatgagtgtattgtgtgcaagccacgagcatttggcaagggggtatgggggaggtggtggtggtgggacagggatggggaccacaaggtgtggactgaaatgagtagcctgcctccagggagtatctggcctgggcattcgtaggcagggataccaggtgtcatggctacctccattgtggctgatgcctgtgggcagtagggactgtcatttttattgtatactgggatgtgtagcaggggcttattcacacatgtgcgagcatgtgcacgcactcacacacacacacaccagccttggtgacagcaaagcctactggatatgttctctgcagaggttccccagttctaaatatttatttattgattttatgtatttgagtacactgtagctgtacagatggttatgtgctttcatgtagttgtcgggaattgaatttttaggacctctgctcactccagtcaatcccactacctcagtccctgctcactctggcccaaagatttatctattattatacataagttcactgtagctgacttcagatgcaccagaagagggtgtcggatctcattatgggtggttgtgagccaccatgtggttgctgagatttgaactcaggaccttcggaagggtagtcagtgctcttacatgctgagccagcccatggctccccagttctagaggtgtgcttatccaacattctccatctgggtctgtctttcttaatggtagaaagatgggtagcccggtcaccctttgctccaaggcagtgctgatctggataaggcaattgatgggacgctggagttggaccgcctctctgaccccttcactcacaccaaccttccttttccaggtgaaagagctggtcctggataactgtaagtcaattgaaggcaaaatcgaaggcctcacggatgagtttgaagaactggaattcctaagtacaatcaacgtaggcctcacctccatttccaacttaccaaagttaaacaaactcaagaaggtaaacaggctgggagctgggaggctccgggtgggggcgccttgtgctccgagagcataattaagggctaggccagttgcttgcttcaacttgctggcagggtccctggggatgttcccttcccgctggctgcctggggagagtagccccgagctgggtgttaagtgtactttcccttcctgcctcatacagcttgaattaagcgaaaacagaatctcaggggacctggaagtattggcagagaaatgtccgaaccttaagcatctaaatttaagtggcaacaaaataaaagatctcagcacaatagagccgctggtgagtcccttggtcctctcctttccttgggggcggtggggagcccgactttcatggttttatttatttatcactgtttttctttgactctcgtcctgtgctgtgagctaacatgggtactatttctgcttagttcacggagaattcagttggaccaaggtcacctggtcagaatgggcacccagtgtggggcagggaatggagcctggtgtggtgtgtgcccttcagcccgggttgtggtatgtctgggctcacagcctggctggcttgccaccctttgaggagaggagcaaacctagatgtaagctgactctggatgtacatcagctatcatttcttccaagggttagggtttagtgctgacacagacgtggcattcctggagtctgaggctgtgggtgggaaagcccagtgcaggccttcatttgcatatggagagaagagtgtctgtcttggtgaccagggcctcagagacaggatggatgacacttctggttcttgctttactcattttccagttagggaaattttagtcagaatggcagtctcttgttaccaacgtcccaggtgcagcgttcttttggtttttaaggaaaccgcccgaagatgtgacaaaaagaatccattggaaatggagaaaagttgcaaagcttgacttgaggaagggccagggatgcggcaaaagtgactgttccgggttcacaaagcactcatcagtctctggacatagtgagctcatggggccaggtggtcataacagcaagcaggcgttgctttttcaagctcagactgtctgtctgtcttgctaataaagcacactgaccacaggaagttctttccaggtctcccactgacctaagtgaaggcagagctgctttcatctgctgggaagccctgatgtcatccttttgttaggaagagaaacctcttcgaagttctgactcacttgtgttgggagtgtgagtacagctgagtctatacagtctgtctaacacagaccagagctcagatgtcctcttggcctttggcccctcctaagaattacctgagcctatatacaaaatagtagagaatcaagactgactctgaggggtctactcttcctagtttgacttggtccccatggcaacagggactcggtgagatcccctgaatgaggtgagaggtcaagattcagctgcatttcttgctagctgtgggcctcctcacttcctggagcctcgatagggcgtttcccccttcccgcccctttcccacggtcaccctcaccgttgactgcctttctccacttgcagaagaagttagagaatctcaagagcctagacctgtttaactgtgaggtgaccaacctgaatgcctaccgagaaaacgtgttcaagctcctgccccaggtcatgtacctcgatggctatgacagggacaacaaggaggcccccgactccgatgttgagggctacgtggaggatgacgacgaggaagatgaggatggtaggtgtcctggggatccgggatgcagagctcactctagacaagctggcaagccatctgccaccggttttcaaagggaagagggactggtggcctcaagtccccccagagaagaacactatgtatatctctatagtgtgatcccagacgtgggagaagagaccagttgtaggggtggactccccagggccttttctccatctgagaaaccagggtcttctgctggagaggctgtggcgccccctggtggttgcagcatgcaggaccactggcctgtgttgggcccttccgtggccctagggaagttgggggctatagtcaatgtcagatcccttgggaaggaaggaaaggctaagggtctctcctccctaccccatccccctatctccacaggccccctgcagttggcaccctgcagctcttctgcagggctttatagctcaaacagaagtactcagatagtgccagtcgatgtagacataaaattcttttgtccttgttggtctgggttcttctgtgaaatgttcatatattctgtcagcatcggtggatatcctttgcccaaggattagattatacgtgttcccctgttgcacacagtatggtgttgtgatatgtggcatgggtctgtagtacagccccggggccagtcctccaagcccttggccagttgctccactacacaggccacttgtggccttgaacagggcagttctctgaagagggattagttatgttgacttaagcttcttgctcaaacctccgtgtctctgtggccttacccacacagaggttcttctacatatctgacttggaggaaggcttatagcatgagtcattttttgtgtgaacaccacctgtgtgcattattaaagcagtcgggctctgagnnnnnnnnnnnnnnnnnnnnctcaatccgagttgtcttcttgctggccacccccacagaggaggagtatgatgaatatgcccagctagtggaagatgaagaggaagaggatgaggaggaagaaggggaggaagaggatgtgagtggagaggaggaggtaaggagacggggctgggcacctgtgcagtcccacctctgacctggcaggtgcctcattatcagtcgaggcaacccaggaaggagccttggttgtctacctcctgcccgctggcggggaaggaaaaggggtccgttttccaaaacttctatggcacagactttgctgcacagacctcagctgccgttctgaggaagttgtgtcagagtaaggaaagggaggggataccggaagcagaggctccgcgtgctttgggcggggcctgtcgctgaggaggtcagaggacaacttttgggagtcagttctgtcctttcactgtgtgatttctggggattggactcaggttgccaggcttggcagcaagcacccttaactcgctgagccggcttgccagcccctaccttttgttttctttctttctttctttctttctttctttctttctttctttctttctttcttttttttgttttgagactgggtttccttgtgtagctctggctatcttagaacttactctgtagacctggctggcttcaaacttgtagagatcctcctgcctccacttaccgagtgctggggttaaaggtgtttgccaccactccccagcttctgcttatcattgcaatagctggttctagccctgtcctgagctgtgctcgtttggacagatttcttgtttttttctgggtttcttgtcatctgtgacgtagggacctctcttactgggttattgagagtaaagtcacatcgacagaaggagtctggtgaggggtacagcagccacaggtctcaggtacccacaccttcctccttgctccatgtgttggggttctatgagtttggaggctcagggtctctcaaagcagggtagttttccatgagttgtttagaatgctgaatctgttcttgccactagtaaatggtaaccaagaaagatttgcagtgcacactcatgaaccagatgccttcgggcacacatgcgcagtacacaggccatagtctctccttctcctggttttctgcctccttgcttgtagtacacgtgcccacacagctcctgagccgggttcctggcctgcctaccccagggctcaggagggtggatgccagcagaaaggccaggctcccatctgtacctgcggtttctctgtcttctgggtttaggctgacagccccacctttaagggatacttgcaggagggaacctctttccttgaggacaaggtaatgggacatactggctggtggactgtcccttgtaccattcctgcctgctgtcataagagccccacgtgtggactttgatctacttttttgtaatctcattgaccatctgccctttctcagttaccaatgaaagagctcttaaatacacacccacaaacacacacacacacacacacacacacacacacacacacacacagagtcttcgcaaacagaccagggagagaactatccaatgatgtaaaagtgaatttacttcaactgttcttagaaacagccgctgtgaaaccatagaaaccaggccttcaggtacagagaagctaccagcatggaactcagggaatgacccagaacaaggaccctaggatgggaggatgaagtcacagggctggctgaatcccaagcaggttgaagtgaggttctcaaggacccttgagtctatccgccacacccaaaccctttagctgcctaggcttggctgtggggagggcccgggaaaggagagctaggcttgcccacttgattctggacttgctgaaactggggtctttccttgaagctaaaaccatattgaggacagatgcaagaaaggatggcctactttcaatgacagggcatctacctgcctagggagcctggtctcctaaaagcctgcatgctagcaagctgcctcttttctaggggcttcacatccagtgtttctaacatggggtagtccaaaactaccccacagcccaggtaaccctcagtatcttatttaatgtgggaaatgtcttaggtcacccacatattgaaagtcatctgactcaggtggttccttgatacaaaacagtaaaaagccctactgtgtgtgttcaccctgagctgcaggccttattgtgggctctgagatgggatgaaaggcctttctaggcagggacatctctaactcatgtaggtgtgcgggtatagtgtatgtgcttgcgtgtgtgcacatgtgtttgtttgtgcatgtaccatgtgtggaggccagaagttagtgtcaattttatttctcaatttctccgccttatattttgagccagggtctcttgttgaacctggagctcactggtttggctaagccggctgccggtgagctccagggttccacctgtctgtgtctccaaggtgctggaatagaaatgtgtgctgctaggccctgcctttacctaggggctggggtggagcttggatcagtgggactgggagctgcctccccagatccagcaggggcactgctaataccctgctgtctttctttgcccctaggaggatgaggaaggttacaatgacggggaggtggatgacgaggaagacgaagaagaagctggtggtatgtcagccttctctctcccagtggcagcctgacccctttgactctagcgttgccctgcttgggctttaagggccaggcgatgggagggggcacccacgcttcctggatgtgttctggttcccagtgggggtggggctgccgggaagatggctgcctgataactctccctttccctccatttttccagaagaagaagggagtcagaagcgaaaacgagaaccggacgatgagggcgaagaggatgactaaggaatgaacctgtttggggaaattcctattgtgatttgactgtttttacccatatcccctccccctcctattcctgccccccgaaacttatttttttctgattgtagcattgctgtgggaaggagaggggaaaagtgtactgggggttgatggggggtgggggtgggggggaggggaggaataaaatactatttttactgccacactttatttccccccctcctttttcccttgtgtctggttttgtccccataaatgcaatagcttagtgcacaccaagcaagtgtttgttcttactctctggagaggatggcttggaggtctaacattttctggtatgtcctacatccccagagttgatcgggaggccgtggctggcctctgccaggtgactcacagcccctgtcatcttcactaactcctgttctggttccggttcgtgtggtcgctgccagaggcacccagcaccccggtttgtaaatagcaaccaaaaggcgtattttggcactggtttggggacagtccccatctctcatcccttttccctccctccacagatggcagtgggctttgctttttgcaaagagaactcttattactctggggctatgatcccgagagccaaaaagaaaaaatcaaaataacaacaacaagaaaaaaacaaaaaacggcagggttaggagatacttgtaaaatgggaaagaagtgaaccttcatgtttcagcttcttaaaaacaaaaacaaacaaaaaaaactgttctatttggttctgtaaaatattagagcaactggttttgtagaaatggcaggaggacgcatctcaggcgctccagcttagaacccttttacaaatctacgctctggagctccctccgagagtcctctggggttttgttctgcttgttttccttctcacatacattggagcacaggaaaggaatgcaaactcgtattttcttacccggtgggactctgaaatggccgcaggtttctcctagggaatgctgtgtgccttctgcatccttcttccagatcgctttagaagtgacgtgctgtgtccctcctaccctgcgtctcactggtacagaacaactgccactcatttttctcccgcccttgagaagagccaaactttgagttttatgtctgtttgtcattgataaatttcaataaatcttttttatacaattttttgggagatggcttcctttgagtctttacaagccattgatcgtcctagggtcacctgctggccctggagggaaggcttgtaatgtcacctgctaaacagctttcttacagagtaaatagccttacaccgagatggagggagaatttttgttcgcaaagcagcaaaaacatatctgggtgggatatgttctacttaaaggctacagtctttaaagtgggggatggtgggggggggggaagggtacaaaaccttataaataaataaataaataaataaataaataaataaataaggcaagccgcctaaaaggcacaccaacaataaatagctcctgttcttgtttttaaaatatctttggttaattttttttccatattgtaaaagaatgtatgcttaaactcaggaatgtataaaacatttaaccaaccctagacttaacagctggtatttattgtattttttacttatggtcctgggtctctgttttttttgggttttccgaagcgctcaggtggttccctgctaatcccatggctgggttctgattggatttattgtaactaaataggtagattgttgaattatttccagtttctcctgcagcatccatccttcccataagtaatcacacttaaaatctatttaagtaatcataagtaatgataagtaatcattttaaaatctatttacattgtgtgtgtgtgtttcttgtatgtcagggcaactttggggagtcagtttctcatcccatcccgtaggtctcagagattgaacctgaggcatcaggcttcacagcaaagacttgtactcagtgggctatctccagctcaccaagcccaagtacttaacatctttcatttttctttaaaaaaaaaaatattagttttctcagtaaatcgccctggttggcctggaactctgtaggtcagactggcatcaatctcctagagatccgcctgcctctgcctaccaagtgccccccacagattcttcatttcttcatagtcaactcttagacaagatgctcattgggccaaacctctcctagcatttttgtaacggtcatgtatgagattgcctaaaacttgtcagaccagggatggcacactggctgcgtgaccttcttctcagccatacagctttgcactccatagcaagcatcagctatcttgccatcatggcagggttccagtgactcttgtacatgtctgagaagacctgggcctcacctcaccctgacacctgctcttttagactagctatctctggcttcagaagcagagtcaggtggtctcctgcaggctaagctatgtggtcatgatggggaagccaggcaggcatgtctttacaggaaggtatcaagaacatgggcgtaatgtgtcaggacagatgctgtggaccccagctcctctgtggtggctcaattgacatggtgtgagtaatgaagaatacgttttgcaggcagcctccaggggactccctttctgcatcaggccaggtatttccatccacctttgaggaaggttgatgagaattctagggagatgctcagtataaacatgaggacctgaggaccttcagcatccattgtctaaagctggatgtgttgtgtgctgcttgtaacctagcactgagaggcaggcaggcagatccctggggctcactggtcagcctgcctagcccacttggcaggccccacactgtccagagagactctgtgtcaatcaagatgaacggctaggagcaccctctgaggctgacctctggcctccacatgtttgcacatacgggtacattctttgttccccttgaactcttcccccgtaaatgaggaaggctgggactgagtaccttgagcataatatgtaaaacccggcctaccacacggtaagtttttagttttgttgaatggaaaggaggaagagtgggctgtttctgagccttgaccctgtggccagcccagaacttcaaacacagccagtccagcgggttttctcagagtctcagagtgattcagtgacgtacagaagagccctgagaagctgagctcctgtctagtcccagagccttacactaaatccccctactgactgtatccttgacttgtgcaagactgctgggtgaggcatcatgaactggttcctcagctcacaccgtcacgactgtggtcaccagtgtgctagtaagtgctatatggataaaccccaagaggccagttgcccagtcctagatgtccatagtggtacctacctgtaatcccagaacttggcaatcggaggctagctcaaggccatccttgtctgtataacaagcttttggacagcctggttacttgagaaattgtctaaaaactaaaacaaaagcctcctcgttcaccccctctaacttggtgaagttcagggaggacaagtggtgggcccaaggtcacatcacgggagagtggaagagcccagcctcaagcccaggatagatagcttttcggggctttggtacactcctctgcattgaggctggaggtataaagtgcagtgtttccagtaggagccaaccctacaggtttcgcatggcaataggacctgtcatcagttctccacattcccagagcaatgggtttccggttcatctcctagtcaagccattgtctggagaaaggatggtggcgtcatctgtggtgtggcctccaggctgcgtgctttgagaccgccactccctccagtctcctagattgcacaaagatggaaacggagctttagcggcaaggtgactctccagcttgtaagtgccttaaaaccccagggctctggcaccacatggttcttacttatcctgtgttagaagtgctagcaggcagatgcaggccagaggtgaacaattcaggctctcgtttgctgacttgcaaagactatttatatcctggtcccaaaactcattgttcacatttggaaggattcccaccctgggtccctaacaagcaattcctgtggatataggctgggcataggcaagaataggacagagagaggctggagatggagacagatctgaagccagccaggaaggtgttagcagggtagagactagagaaagccaaacccaggggggacattgtcactgggactgcaggagcagacacaggaacataacaaacaattcctcttagtggggcaccgttggactgtggacggcccagtggatggggacattctccactccagatgttcagttagatgatgtcccatgctcactcacaaggacagcaggtgtgaaggagcccctgcctggtgtccagagacatgattggatagtggtagagtagagacagtttggttattgtttgaaagacttaatgttttaaattatgcatgtgtgtgtgtctgtgtggggctatattcacatgaggtgcaggtgcccaaggaggaataggaagtcagaaaccctgaagttcataggcagttgtgagccacccagagcagaggctgggaatccattctgcaaacacagaagtatgtactcttaaccacaggcgcctctcctggtccacagagacagttattaataagaccattctcaggccatgcatgatggcaaacacctttaatctcagcactcagaaggaaggaggatctctgggagttcaaggccagcatggtctagtccagccagggccacaaagtgagacccagtctcaacaaacaaacaagcaaaaaaccaacaaccaaaagcaaaacacagatcttgctgcacggaactggaaggaggagcctggttgtggaggcacgtcttccagggaaaggcagcctgtcaccagagccaggaagccatggaacttaacatcccgtggcaccattcagccttggtctgaccagcgcagagtgggtaacccccagcggtccttgaacaagtctgcttttcattcactagagctctatttggtttataatcatcctcactacaaagactgcacacacggaagctctcagtgaagattagctgcttagcactcggcacagtaaccgatgctcaaccccagtgattccaaagatttcctgactggagtccccagggtttgtccgatagccaggtcttaccccatgggaattcttgttcactctagatcgggacctggaaaacccaggactcaaggttctaccaaagtagccttgccatgagggatgtttggagaatggtgtattaaactgaatactcccagtgacctgcagagaaaagtttgatcgtaccacattcattcagttaagggcagtgagactcagagacattgaatgatctaattaatttgtcacacagcccacaagtagcagagttgagtttcaaacctgggtcagcataattttcatagctcctgtagagagtaggtgaaagcaactgcctgtatgcctcaagattcggagatactagaaaaaagcaaggggaaatagagagtgaaaactattttttttaagtgatgtgatagcaagatgattcagagggtaaaggcatttgctgccaaacctggaatcctcatggtcggaggtacgaaccaactgtgagggctaaagttaagtttaaattaccaagcctaagaaatcttgggctggagagatggctcatcaattaagagcattgactgctcttcctgaaggtcctgagttcaaatcccagcagccacacgatacttcacaaaccatctgtaatgagatcagatgccctcttctggtgtgtctgaagtcagctacagtgtacttacatataataaaataaatacatctaaaaaagcaaaacagctgggtgtggtggcgcacgcctttaatcccagcacttgggaggcagaggcaggtagatttctgagttcgaggccagcttggtctacagagtgagttccaggacagccagggctacacagagaaaccctgtctcgaaaaaaaaacaaaaaacaaacaagcaaaacaagcaaacaaaaaacctagccagcacagacagagtcacttcaggagctgatgatttgctgtttgcttatcaaaactttcttcaaaatagtcattatccactcaaggtcacctagccagaaaggtacatgtgtcctacgttctcagggctagcgtggcttacggttgaacacagcaagattcgtcttgactaatttcacactttccctcaaggactcaagctctcagacccaacacagtcctctctctcatctctgcaactctctctgcttccaaaccagtgacacagtattcccattatccctggggacagatgtctcataacaaacatgttctaaaactcaagtacgaaactcaagaatgagcctcttgctgattgcagagatgctgctgtctgtttccaagcatcaacagtcgtgtctggggctttaaaaatcaggtgaggctgcatagcgcaagatgctaaactcttgggctgtcatgggcttgggctgtcatgggccagtgccaggaggtttatgtggccttggacaagctacctcttactgcccatctctagaaggctcaggaggtcagggcatactttctgctagggatggtgcaagagaaagttatggatgacattgggtaatagggaagcatggggtcttggatttaaatacaagtttgacttgcgattgctattcttagttgtcaacatgactacatatggaattaactaaaataaaaaatgagggcacaccaatgaggaatttttgcttactttgaagtaggaagatccacttcaaatccagatcttgaaggggacgataacgatacacatctttaacctgggccatactttctgttggaagtctgtatacggtcatggaagaaagctgcttttgctctttgcctgcttgctctcaccttgttagcaagtccatctcccccttggcatgagatcctgcttcttcaggattccagtgtacactgaagaccagccaaggcatccagccccatggactgggcaacttctagattcttggactttcaattcacagcccaccattgttggattagctggactggagcctgtaagtcattgcaataaatcccctttgtatatatagagagattcattctataagttttgttactttagagacccttgactaatacagtcttccatagagacaggatatgcctcatcctttgtatccggagagcaagagaaaggccattgatcacctaagtgggttgattccctggtggggaattggaaggcggatacttattggtgtttgaagaaaatataatctgggatcatcaataagacacaggtacagggaagggtaggatgggggtaggggcttgaggtggggacagaaggcgtgaggaagttgttgtgggtggtgggaaagcaagcacaaggcagccaacgactgagtgtggctttaacgtggtagattaaggagctgggactgaagctgagtgggcaaagttcttatctaacatgcacagtgtttgggttccttccctgatattgtaagaactgggcatggtggtgcacacccgtaatcatagcgcttgggagatggagacagaaggatcagaagttcaaggtcatcttcagctgcatactatgttcaatgctgggctgggatacatgagaccctgtctcaaaacaaacaaacaaacaaacaaacaaacaatagccccctaaagtagactctttggagagttatgagggtacagtttaaattctaagctggttaaggaggtgattcgaaattgtcaggaatgaagaaggagagggccagcagaggagctacaggccagaggtggggatatccagggtggagaagggagcctcaatggaggtgaggggtgttttcctagcacttcagaggtagagacaaagacatcaagaattcaaggttagccttagcttcagccagttcctagccaacctgggctacaagagagcttttctcaagaagtgtttagccctatcccatctctccttccatgtttcccccacatccacctgtgtctcccctttgaggtgaacagctttgctcccttccatggtagcttcctacctcagcacaagcccagaaatggactcagttgaccaccgatcaaaagttctcaggtcacgagccaaagtaaatattttgtcattttaagtaactcatctcccccagatatttgtcacagtgacagaagtaacatagacaccaaggtaggagaggggagaaatgaggcattcatggaaaaatgagaaggatccccaagtccaggtataggagcccatgaagtacgacagcccccctggtggctgcttcacttgaagactgccagggaacagggtcacaaggaaagaccttgtcagacaaagctgacaaaggtacgatggagaaggcctgccttctgctaacccatgagctacaaggagtgtactagttactttcctcattgttctaacagccaatgggaacggctaaggaaggaaggcttgtttgactctcagtttgagggtatgggttggtgggtagtcatggcaacaggagagtaatgttgctggtagcaatgggtccacagtcaggaagcagagaggacaactctggtgtttagcctactttcttctttttattcagttcagggcctagggcatagaatggggccattcacattcagggtaggtcttttgacttaatgtggggagaagatgaagtcaggtcagttgccaggctgtgactcatggcacctagagctttgatggcgattctaaattctatcaaaatgataatcaaaattaaccatcatatttggttcctaaaagttgaagtgtaagggtaaaaaaaaaaaaaacccttctgggcagagcaggtgaggtgtgtcctactaacgctgaagacccaagttctgttcccaagacccacatggggagaaacagcttcagccaattgttttctaacctccacatgtgcacctcggcgtgtttgcatcccaaaacacaccacatgtacactaaatacatacactaaatacatacatacatacatacatacatacatacatacataaatgtcataaaacaggaaaacagcctttgttcttttctgcaatttcaacacggttcaactatgggcaggaaacgtactacaccctcccattcccatgggacaattgtttacagattgctggcagatttgtgttctgtttgtcttttctgaatctctggagcctgttggcccctcatttggagccctctcaaatctccctgtgcctcctgattctctgttctaactgggtactgggatggtctttctcctgtcaccctggatccatccactctcctagaccaattccagagggaagtcctgtgttggaaccccaggtacaggctctcccaaacacgggcacgtgtcaggtgtctcctctcctggcttcccttcagcagacattccagacctcatcaccagaagtcggaagtcaaggagaaaatcaggaggcacccacagcagcccagctgtgaacaggtatttgtgagacttaaaacgaatggcaccttttgtcactcaaacacatggctgcgccttggatattcagtaagttccactgttctctacacgtcccaggccaaagtaggctgttggagccaattaccacttgcatcagggaaccttgcccgggattggacagtttttgctttagacagggaatgaaaataaggacaagatcgctccaaggtaagattgagaagaggtttattgtagccatgagggatagaactgccagccgcatctggaggagaattcgaagctgagagaagggaagaagaagcccagagagaggtttagggtagggggcggggtgagaagtgcggggaggagccacaggtgtggagtgagacttgtcctaggtttctttgggccatgacagatggttagctcctggtgctgggacagatatctgagaggagtgacataaaggcacattcactctgactcatggtttcacaggcagtcgggccagctggatccctgtgtctaggcctctgaagtaacatgccatggtggaaaggcag

SEQ ID NO: 1494 - DNA, 863 bp, Mus musculus
gggttcggggtttattgattgaattccgctggcgcaggatcctctgcagaaagagagagcgcgagagatggagatggacaaacggatttatttagagctgcggaacaggacgccctctgatgtgaaagagctggtcctggataactgtaagtcaattgaaggcaaaatcgaaggcctcacggatgagtttgaagaactggaattcctaagtacaatcaacgtaggcctcacctccatttccaacttaccaaagttaaacaaactcaagaagcttgaattaagcgaaaacagaatctcaggggacctggaagtattggcagagaaatgtccgaaccttaagcatctaaatttaagtggcaacaaaataaaagatctcagcacaatagagccgctgaagaagttagagaatctcaagagcctagacctgtttaactgtgaggtgaccaacctgaatgcctaccgagaaaacgtgttcaagctcctgccccaggtcatgtacctcgatggctatgacagagacaacaaggaggcccctgactctgatgttgagggctacgtggaggatgacgacgaggaagatgaggatgaggaggagtatgatgaatacgcccagctagtggaagatgaagaggaagaggatgaggaggaagaaggggaggaagaggatgtgagtggagaggaggaggaggatgaggaaggttacaatgacggggaagtggatgacgaggaagacgaagaagaagctggtgaagaagaagggagtcagaagcgaaaacgagaaccggacgatgagggcgaagaggatgactaaggaagaacctgtttggggaaattcctattgtgatttgactgtttttacccca

SEQ ID NO: 1495 - DNA, 744 bp, Mus musculus
atggagatggacaaacggatttatttagagctgcggaacaggacgccctctgatgtgaaagagctggtcctggataactgtaagtcaattgaaggcaaaatcgaaggcctcacggatgagtttgaagaactggaattcctaagtacaatcaacgtaggcctcacctccatttccaacttaccaaagttaaacaaactcaagaagcttgaattaagcgaaaacagaatctcaggggacctggaagtattggcagagaaatgtccgaaccttaagcatctaaatttaagtggcaacaaaataaaagatctcagcacaatagagccgctgaagaagttagagaatctcaagagcctagacctgtttaactgtgaggtgaccaacctgaatgcctaccgagaaaacgtgttcaagctcctgccccaggtcatgtacctcgatggctatgacagagacaacaaggaggcccctgactctgatgttgagggctacgtggaggatgacgacgaggaagatgaggatgaggaggagtatgatgaatacgcccagctagtggaagatgaagaggaagaggatgaggaggaagaaggggaggaagaggatgtgagtggagaggaggaggaggatgaggaaggttacaatgacggggaagtggatgacgaggaagacgaagaagaagctggtgaagaagaagggagtcagaagcgaaaacgagaaccggacgatgagggcgaagaggatgactaa

SEQ ID NO: 1496 - DNA, 744 bp, Homo sapiens; identical to SEQ ID NO: 1495

SEQ ID NO: 1497 - DNA, 925 bp, Homo sapiens
  misc_feature (910)..(910): "n" at position 910  can be any base
gattccgggtgcgccgcgggtgctgggggctcgagaacgagcggagctggttgagccttcaaagtcctaaaacgcgcggccgtgggttcggggtttattgattgaattccgccggcgcgggagcctctgcagagagagagcgcgagagatggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatgactaagtggaataaccnattttgaaaaattcc

SEQ ID NO: 1498 - DNA, 746 bp, Homo sapiens
atggagatgggcagacggattcatttagagctgcggaacaggacgccctctgatgtgaaagaacttgtcctggacaacagtcggtcgaatgaaggcaaactcgaaggcctcacagatgaatttgaagaactggaattcttaagtacaatcaacgtaggcctcacctcaatcgcaaacttaccaaagttaaacaaacttaagaagcttgaactaagcgataacagagtctcagggggcctggaagtattggcagaaaagtgtccgaacctcacgcatctaaatttaagtggcaacaaaattaaagacctcagcacaatagagccactgaaaaagttagaaaacctcaagagcttagaccttttcaattgcgaggtaaccaacctgaacgactaccgagaaaatgtgttcaagctcctcccgcaactcacatatctcgacggctatgaccgggacgacaaggaggcccctgactcggatgctgagggctacgtggagggcctggatgatgaggaggaggatgaggatgaggaggagtatgatgaagatgctcaggtagtggaagacgaggaggacgaggatgaggaggaggaaggtgaagaggaggacgtgagtggagaggaggaggaggatgaagaaggttataacgatggagaggtagatgacgaggaagatgaagaagagcttggtgaagaagaaaggggtcagaagcgaaaacgagaacctgaagatgagggagaagatgatga

SEQ ID NO: 1499 - DNA, 96599 bp, Mus musculus
  misc_feature (4408)..(4427): "n" at positions 4408 thru 4427  can be any base
  misc_feature (39512)..(39633): "n" at positions 39512 thru 39633  can be any base
  misc_feature (53333)..(53661): "n" at positions 53333 thru 53661  can be any base
  misc_feature (61962)..(62538): "n" at positions 61962 thru 62538  can be any base
  misc_feature (64905)..(64941): "n" at positions 64905 thru 64941  can be any base
  misc_feature (83686)..(83705): "n" at positions 83686 thru 83705  can be any base
taattaagtagataaaaaatctcacctgggaccattcttttagtagcattaaaaaaaagatctattttgttggagagtatttaaaacaagacccacgtgaagtatgagaagcagtagcagacgcagcatcctttattaggtcctcgtggctgggtaaggaataccagtgcacaccagctcagggctgacataggattgctcatagctattttagttgtattcatgtcatcttaaatacagtttattaacattgtactattccattacaccattaatttatcttcagagatatttatagtatcaatttaaaagctgtaaaacttcatggaaagtagcttatactatagggcttcaacaaacaagcttgccattttgaacagggactcacaggaactggacttcttacaaggtttggagtttcttgctgttgttctggttgatagaattatgaaccttataaactcagtactttttagttaacctaaatacataaatctatttggattcatcttatgaaaagagatatgtcattagatatatgatcattatatgcttcagtgattcatgggccttgttacatacatgctttgtaatgtatgaattatttagtaagaaaaatcacaataattttgttgttactcaaaaatttatgggttggcagaaacaattatgcagcccggaagctggcgtgttaaggtaacatcattaactcatgtggtatgagtttttagcagccgtttgacataacctttactgctgctgctagaacagatcagtaattttgtataacaatctgcctgtgaacagaatgctgaattggctatccacaaagtgattcattttactttatttccatattagtacataatttaaatcctacctaaaaagtgtctacccaaaccctaaagaataaaaacatgcaaaataatgaatgcttcccaagtacacaaaagtgcaaaatcacatttaataagagcaaccatttctatttttaaaatgttagatgcttaagaattggatgaaaataatttatgagagtagattatccttaaagccttttttacacattgtattacagccactactaagagataaagaacaaaattttattttggaaggcagcaatgccacaaatgcaataccaaaggtcatgattttgaactttgaaatttacaaaatgaagtagccaagaatttggaagtctgaatataaacttaggctagctcaactttagactatttgccttgaatgtgtaaggttccacattcaatcttagcaacaaccacagtacacacactaattagtatcactaattaaaacatttatttttattttctatgtagtgttttgcatatatatgtctttgtatcacatgtatacctggtgcccacagaaaccaaaaaaggatatcaaatcccctagaacttgagttacagacaaccttgagccactatgtaggtgccagaaatttaaccaacatctgaaagaacagcctgtgctctttaatcgctgagccatctctctagtcccagaatgtcactaactttaaataatatttaaaattcgacaatcattcatgcaccaaattaatactcaataccagcaaagctgaagaccaattttagtacatttgatttgccaacagactctagtagtcctgagtctacacagagaagtcagactgcagaagactctctgcacacgacagactgagagtcacgtgttggcagtttttgttggcaacatttatcatagaatggatgctgtaaattgaatgaatacatgattgtaaattgcaaaggcagcatgtttgcctttaatagcatcaagacaaggactctttaatggaaggcatttggatctgtcttgcaagaagagcaataaagaggactagagagatggctcagtagttgtgagtactgacttctcttccagaggtcctgagttcaattcccagaaaccacatattggctcacaaccatctgtaaccatattaaagtatacttaatacattaaataaagaagagcaataaagtttgacatgtctcaagtgtaatgaatcaagtatgctttctgaaaaaaaaataagagtttggaatccttttgccatatcctcttaaggcatttcaaaagttgtattttattttctcacacatgggaactgctattgtaaagtcaaatttaggtaatgcacagaagtggaacagaagtactcgaatcagctagactcattctttttattttacatttgtattatcatcatcaccaccaccaccatcactaacaccaccatcatcattgaagcatgggatgcaggcattgagcaagaatgataccactgagctatatcccattcagccttactcttttaaaacaaaactaatattttgattgcgttgtcaaatgagcaatcatctctcagaaggaagccaggcttctgttggttttcagaggctacatgacaatttcttatgaaggcagggaagaactcttgagtaggacagcagattatgatggtgattgggaagtctccatgcctctgtctgattccccgtgactatattcagtttggtgatttatatacatataatataaaaatcctattttagtggacatggcttaaattatttcccagccattaccagttggataacagagtagtttcagctttctgagctttagtatctttgctatacaataaggagactatctaacagaaagcatttaatcattacaaggaccttatacattctaagtcacttaatcaaaccactctatgatgtaagcattgtgcactgtatttcttcttgttatttagttagcatcagctcatctttcacctgtggaagttttacccaaggccagacaaggttcctgagtctacattcttggtcacgtcattccacttgtcctatgatacacaagataattctgtcaggtgataactgagaagtcacataaatgagacttcattacttcctctgcatataggggaaattcagaagtgcttagcagtgagtcagagtcatgctagagtttgttttccagagactctagcctattctacttaaggggaaatacactttggagaaattaaatctggtgcattttgaatgaaagaagccttcgtcttagattatctgaactctccagttctgatcccgtgcctggtgcatgctgctgccccatgagcacctgtcatcgccgacccccctcgccggtatgattgttaccactgcttattttcattcctatcaaaatagataagaacacacttgcctatcatagttttggagactgctcatttttttcatatcttcatattcttcttaaataaacaaacaaacagcaatcagtataaagaaaatgcttgcttgcggtagggagatggctcaatggttaagtgcttacagtacaagcttaaagaccagagttctgattccagtactcacctaaatgctgggtgggagtggcagcccatctgtaattctagtctcagaggcagagataagggattcccaaagcaagctgattagcaagactaaccttatcagccagctttgggttccattgagagactcatcgatgactaaggcagaaacatagagggtgattccatagcaacctcaagtcttctcgggccttcagatatcccacagcctcctaaaagcaagacctacagaatgggaaggacccatgtagataacgtagacatcaagggtaagaggattccaagcagagaggcagtagagagaaccctggagtgtgatgtctggcatgttcaagaagcatgtgggacaatgacttgtgtgtgtgtgagaaggaagaggagacatggggttcaagagttcagaagtgtgtaggctctgggagatggcccagtctcactaagttctgatcccagtactcattaaaagccttgtgcctggaattcaagctctgggaaggtgtagagagaaggaaccctggggctccctgtccaggaagcctagctgaacaggtgagttccaggtttgatgagagacccagtctcaaaaaataaggtgtcaagaaatttaggaagacacttgatgctaaattctggctttcacatgtgtgtctgtgtgtgtgcttaagtatacacgtgtgtgtgcacacaaacacaaatacatccataggccctcagaagaggatgcagaggataataaagctcagtggtaggctccatgctcagtatgcaggatgcctgcaaactatgccaagaaccaaataaatggatgaatagttcagcaggagtaggggtcaaaggagaaagagtgggggttttgcctgctcgaggtgagaagctatcagtaaagctggacagaaaataacaagttactattgttcagtgaaaagaaagtattttcaggagtggtaaggatgaaannnnnnnnnnnnnnnnnnnncacaccttaaatcccagcactcccgaggaagaggcagacggatctctgtgagattgaggccagcctggtctacagagcaaattccaggacagtcagggctatatagagataccctgtctaaaagaatgagatgggggcggggggaggaaaagggagagggagggggagaggtagagggagagggagagggagcagggagagggagagaaaattatgggcatggattctggttaaggatttgagattgaggttaagataataagagagaaaagaaaatctctctgaacttataaaagcaaaataaaattcctcattaaatgactttaaagcaagagtcaaaactataaaaaccttagcaccaaacttgggtagaatctctctcttcacacaagtgcgtgagggtgcgcacacacacacacacacacacacacacacacacacacacacacatgcacacaaaaccacaggagattgtcttagccacaggcagctacaagataaaagtacagaaagggaaaaaactttagtgacatggagaacttggaggccttaagcaaagtgggtatgtttctgccgtgctgtggctatggtttgtatctccgtcactgcaaaggttgggaattaaaggcttagtcttcaggtagccatacctcatgagagctggtggactctttaaatggtgagcacttacagaagctctgagagtcattaggcccgtgcttctagaaagaattgttgaacatggcctctttggtctctggctttgagttactgtctcttcttggtacacaagtacaatcccttcattgtgtcagaacccagctgatgtcagcaccatgtccttgaacctccagtgctatgtgctaaataactatcatctttataaagttagcctggtcctactgctgaaaggggacaagcatatgaacttccatctctaactaagaattcctctccaatagacacccacttgcaaaggaaaaattagttttccaatggagtctcagtgactttataaatcacacttaaaagcaggctccattcccagaagtagacacccaacacaaaattaactcaatgttatttttatagacttttaatctcatatttctttgtttgggcttatgttttcttttgtttttcaaggtagcatttctctgtataacagtcctgactgtcctggaacttggagatctacctgcctcagcctccaggtactgggattaaaagcatgtgctaacttctttgggcattatcatctttctggtcttatttatgtgttatggtttctgattttgtgtttttatgggtttagctcttgtgtgcctctgcatttcttgtgtttactgttattttatttttgttttttttaaatctggcttgtttgcattttttgtttgcctgcttgttttctaaaaagagagaaaaagaaggagtacaatgagtggtggggataatctggggggagttgggagcagagaaaccatgatcacaatatataataaaaaagagtaataaaaatacataaagttagcatgtcttaggaatttcattacagtaacaaaaaagtctaatgaaatatctgaaagagttaaaattagtctggaacattagtgttgttgatgatgatagttgtggtggtggtggcaattattacttattattgaagatggtaggaatttgggttcaggaatcaccacacaatccatacaaacacagatcttagttaagcaaaaatagtttattgaatgcacaccctaatactggtcagaccagggacatagttcagaattatctgaactatgagaacagataactttttttttgtcagcttataaaggaaaaaacccacaaaagttcatatgcaggtgcaggcgtgactcaggatatcttagactgaacagttcatattgacccttgatttgatgggttctacgtaaagctttatggaatttcttaagatatcaaacctcatacagaagattcagagcatacagaacaaaacagggtatgtggtcagcatgtccttgagccaagtcacttttctgtgtcaatgactggcaggcatgttaaagcagcaatacaaaatagctggaggacatggatcagaatggccacagacagctattcgggatggggtggggtggggtggtcagaccatatcagtaggggtcaaatccagggcctaacgtgtgataagcatactgtgttccactgaggtacccagtcctggaatagaagttcttacatgcacagtcatagcagcagcattattcacaacagtcaaaagatggaagtaatctgagattccattggcaaatgaatgaatgaagattacatatccaaaggacttatctttaacccagcaaatgaaggatctttagtacaaaattaccacagagatgaactttgaaggcattactctaagtgaaataaactaggcacaaaagataaatattgtctaactccaattttataaggttttaaaagtatttcaagttcaaaatcagaaaactaatgctagtgagaggaagggggagggaagtcattatttaatggggaggggatttcacttttgtaagtgaaaagttctagaaattgattgtgtgacaatacaaacgaacttaaacagtgccgaagtatatacctaaaaagggaaaatctgatcttatgtgtgttttatcacaattaacgtacattaaaaaccagtcgatatctgtctcagggtttctatgctatgaagagacagcacgaccataacaactcttatttaaaaaaatatttaattgggctggcttacaggttcagaggactagtccattgtcatcatagggacaagcatgaaggcatgcagccgacactgtgttggagaggagctgagagttctgcatccagatgtgcaggcagcagaaagggagagcaacattgggcctggcttggacttctgaaaccctaaagctcacccccattaacacacttcctccaacaaggccacacctcccaagagtgtcactccctatgagtttatgggggccattttcattcaaactgcataacacctaattttcagaaacaccttcttttcagttaaggttacacacaagtaaggatttaccagggcagtcagcagcatctccttcagtgtttccttcccatattccctctgggcccatttctccttgcttttaccaccatctgatatattttattcatttttgtgtttcttccatcagaatttagagagaaactttctatcatagtcatttagaagcaggtcctctgtgctaatcattgtctcattctccttttattattttgttttttgggtttttgttttgttttgttttgtttttttgagacaggatttttgtgtgtagccctggctgtcctggaactctctctatagactatagaccaggctaacctcgaactcacagagatttgcctgagtctgcctcatggtgctgggattaaaggcatttgccaccacaactggttcatgtgtcagttttcaatgataagcaacttataagtaggggggaggaggtatatattttgcctcataagttcacagattttaggccatgatctctaggcctgtggttaggcagacttccacacatcagcgagtgtgtgggaaaaggcaggaagtaaaggtgttttcttcatggctgacaagaaacagaagaaggaagaagggcactggtcccaataacgtcgtataatatgcccccaagaacctatcttactctcactgacccaacattagattctatcgtctcctggcagtgccactgacggacaagcaaggcttgagcatatgggggacatttccaatccaaactttaaccccctttaagtaggaaagaaacaagcataaaccttctactacaattaaagtactttatggctaccaaactacctcagtcagaacttgtgtggctacttatgtctactgttaaaaagaaaatactatgtgcaaaaactttaagatcataaacatatatccctttaatttggacggtggtgtttatattacttaacaaagaggtacttttgaatgttaatagttctgtgaaactctgctcaaataataaagtcttaagatttcatgctatgtaaaggctacaaaaagttgaaatgtgattatatttgctctttagatatttgggaagctgagagactgccattcatatatttaaaaaagtgcttcagaatatacatgcaaatttggcaaatggtgttggttttccctatggtactatgaatttttaaaaagacgttttaacaaatcataggttaatagaaaatctctagttttgtagttaattttccttaataatagaaataaagtttagattaagaagtacatggcaaaatagtgaatttttctttagcactgaagagcagttacaaaggggtagttccaacagtacctggagaatcggtctacgtgaattcctacctaagctattaaggaataataactaaaagatggtcatttatctcctacaatggcctttcaaatgcaacaggaaaaaagcccaagtagaggaaattatgccacaaattttggtattacattgaaaatgatcaacatttaattgttcctcctcttacattaatcacatatctgtttattccggggaaagtggacactggtcccaccaccccacgcactatgtttatgcataatcagccccaaaaggtagagataatagcataatttaattacaaataaagggcctacctacacgttgccatttgtaagcaattcttttgtatagacacatagatcaacaggattatgcactttaaaatgtgaggtaacaaggcatttaaaaataaccaaggtttacggctactgccctgctatcactgactgcataaacactgcaatttagctgaaaatatatggaacagacgggatatttttgcaacggttgaataagatattatgatgccagaaatacagctgtccccaggcagttaagcgctctccattgagtttctttactgttgcttttgagtaggagattgcttggtactgtaggtcactggttagggtaaaggacctcactgaaaaattcatgcacactttgctaacgtgggagaaaaaatagtggtattttggaactgttaattggaagaaggggcataaaaacatgcttttttttttttttttctttttttaataaaaaggtcttgcctggctcttgccgatttaatgtaacaaacccgcggatagtaaaaggtatataacttgacaagctggtgctgccgtcttgtccttcaccgccttttctgcatgatcaaaccttaaattgttttacggacagcccccagccgtagatccgtgtcttcctgggttttctaggctcctttaccactacctgaagagatggaagtcagccagtcctagcacgagatccctgctccgccccagctgccctcttccaacatggcgccccaggaggcgggtcccacatgtcggctccccgggttccggcgccatcgcgttttggttccggagtaacagcggtctaacggccgccttcctcctcctctcgccgccacctccgctgccgggacgcgggcctcagtcggacgatcctgcacgcgccgcgccctccggttccggctgcggtccgggacccgccccttgaccccgcggccctgggcccccctgcctggttggagggcaggcgccaccggtgcacctccgaaacagccccgacccagcccgcggcgcccggccaccgtccccttgcccaccgagacactcaggacggcaggaccctggccactgtacctgccttaaaccaggccgttgctccgctgtctcctcttactcacaaggactacagaatgcttgtgggttctgttttgtccacttttgtaactccaggaccttccgctctctactaattcctcttggccggtcccccaacagtgcatcctctcctagggacactccacacgacctgggcctggttttgggcctgcaagctccctcctgatcgctcctcttcacttctccccatcttcttgctccctatttatcgcctgccttctgtctatcgttccccttgtcacttcttggggctcctcctaagtaggggcaggtcggtacccctcgccccaggatgtgagaccctttaacctgtaatgctgtggctggcccttggccccttctgtgccatggagaaccaggtgctggtgattcggatcaagattccaaatagtggcgcggtggactggaccgtgcactccgggccgcagttactcttcagggatgttctggtgagtggtgactttagtggccaaatcccagcgttggggattatggatctggataggcagcatcttgaccattggtggcctgagctggcctctggtggggtcaacttacctgttttaaccacagtctcggttaattgcactcactgaaaactggtaaatgtgcagcgccctgggaaattgatgtatccgactgaacccctgccctcaggaagctcacagtctggactgtgacttacacaccagtgcagacaactgggatgtaaagagttttaaaactgtttcttatatttttctcaagtatttggaaaggattcctgccctcattctagccctgtcactgctgagtttcctgaacttgtgacctgctgggaaagggacaccagggcaatcttagtttacaatggttaagcaaaccttagatgccactgaatgggagacctagacttaactatcaatatggaaaggatgctgcctgttagaactacagcacatcattccgtgacaaacacagctcaatttcagagatgttgagtgttcagggaaaatttacatcttagaatcaacagtgcattgccttgggatgcttagaatatatttcacacaaaattatgaaggttaatgtaggctggcccttgagtccatatataatatatactataaaacattatgtatgtgtgtgtttgtcctgaatagagagtaaaaggaccttccgaggacttgctcctgaggttgagagtcagtgccaaaactatagcttccttacttagtatatgagtatatgtgtgtgcagatgtgtgtgcgtgcatgtggagatcagagatcagcctcaggtgtgctcaggtgccatccaccttgttgttttgggatagggttggctggccagcaagccctgggcattcgcctgtttcagcattcccaatgttaagattacaagcactcatgccaccaagcctgggccacctgtcaagcacccacttcctaggttttttgtttatttgtttgtttttgtttattttttatttttattttttaacatgggtctagagattagtctcaggccctcatgtttgcataggaaacactttgccagctgagccatctccctggcccccaaatttacttttgtttcctgtagtgtccccatatacttcagtccacgtgcatctttctagtcagttgacattaacagggtgacatatatgtatgtccacagtaactcagcaggagaatttggtgtacggggaagaatgttttaacaggcagatgtgccgtctgacttacagggactataagagaacactgagtggtgtcatttactgccttgggttgataaaaaatgaaatggtggtatctataatttcattttgaaagctagatgctcgtaccaccaaggccatgcttgggtctaagccaagcatgtggcaccttaggtgagctagcagcctccagtctttgaccccgaatggcatcccttctctgcagctggtgctcttcacaatatgcacagtgctagtctcctttcctcataaggccccacagtcctccttgctgtcctcaggctcatcttgattatcctggcacctatgtcctctcttgccacatcttcttgagcatcctgtgtcccaggtgtacagagctactgtcagtactcccaggtacccaggctgtgcctccactttgccttctttgtctggctctcacccacccttccctgccatgcctcactctccctgtgtcagtgtttgccaggtggctgccatggtagtcctatgtccatccctgtggcaaagcatgcattcaggatgatgtgcttgtctattctagaatgtaaacatctggaggagagaaagagctctgtttctgttgcgtcatagcatctgagacttgaggaggggccaatgggtgcttgctgtgtgagcctgaacttgggtacagtccgtggaacctatggtagaaccaactcctgaatgctgtcttctgatttccacacacatggccatggcatgtatgcatccgtgtttactgtttatacacctgcatatataataagtgaaaaaaaaagaaaagaatgtatatcttaaggaccagctgtgtgcaattttaagctgtgcagatcactggcttcttttttggagccatgttggtgtctgccatgttgctcagtctgctctcaagttagctattttaagagggaaccctgggactgctctcctcctgcctttgcttcctaaagctgggtgagcaccgagttctcagtccggcagttggaacttcacggccaggtgtgccactacctcggccagttactgtatgcctgagcctcagtttccttatttctagtcagggacacctgcaccacgtcgtgtgaagattaaacacatagaaagtgctctataagtgttgacatataatgtaagggacaggacctggccttctgcttcctgagtacccacaggagatgtccagcgtggggcctccaggaagcatcgcactatcatcactaaggctcagaaccgcgtgtcgggacagtttgctcataagatccgctggagcacatttgtcatgaagagccggaaaagaatttagaacttggttctgtctggttgctgtttcctggcaagtctgacagggggccacccaaggtccttgtgatctgttctccgatttcacgtcatctcttccatcaagagtaaacaaaaccctaaagaaaccagcatctctgacttggaaccttgagctttaagtctgtggaacttggatgcgtcccttgtctgacccaagccccctctcacactttcctgttttcagatgaggaagcgtaagtagctctggaaggggaggggcctcctagagccttggagctagttggcttacctaacacaaaagccagagggggtttcagccactgagtccagagggattgagtatctgagagcagagtcagagttgaagatccagttgctccttctccacatggctgggagaccttgtgtaggctacttagcttgtcccctctgggcttgcctgtgctctgtatctccaggacctaaatgcagtatgaaggaagccaaaaccaagtgcagagacactgactgggctctctgtattccttcagcctcctttctcttcatccttggagacggtctaggacagttctaggacttgtgaatagaattggattgattagtgtgaggtagaggactaattagtgacatttctatccaagtggaaccagtgactctttcttctgagcgttccttgttgtgacaagattcctaacaaaagccacttagggaagaaaggtttgattttcactcacagtttgaaggttgagcaggaggcagctggtcacattgtctctgcagtcaggacgcatagactacgaaggctgctcagctcctgtccatgaaatggtgctacccatatttaaggtgtgccttctgcctcagttaacatggtgtagaagctcccatacagacatgcccagaggtttgtgccataagtgattgtcagtcctatccagttgacagtaaccgttagcaatcacagtgaacactgcttgccactgagatcttgtatttggctctttttgttactggagtgtttccaggtgccatcttatctcagagaccagattacaggccggctgaagtctagagccaagtcctgacctgtgcagacttataagctcctggcctgctacagaggaggtttgacttctccactgttatgtagttttctgtcttactgagaagaagaaaggaaacaaatacaaaattagctcttaaaggaaactggaattttaccatttatcattaaatataccctgctttaaaatggccagtagagcggctgaggaggcaggcagtccttgtcctctggccaggttcagactttcctctggattgcctgtgtacttaattctgtattcagtttatacatctagctccctgttaagaaacgcgtgctacctgagttaaaggccagcctgatctacagagtgagttccaggacagccaggcctacgcagagaaaccctgtctcgaaaaaccaaaaaaaaaaaaaaaaaaaaaaagaaatgtgtggtacctgtgaatgtgtagaaagacatttctaactctaaatttttgtttcttagcttcctcacaaagtaggtatgtcatctgctaagactagaatcagagaaaacgttttttctggctgatgtgtaagggttgttgttctcccccatcaaatttcttttgcacggatttattttttaaaagaaagaaaaaaaaaagacgctccatatgacgattatgcagattggcaccgcagtaaacactcctaagaactgcctttagaaggaggttgtagcctccactctgtaagtgctctgctttggaagggctgcaggctccctgctgaggctctgtcagctggctgcctggtgccagttcccgcacagcctggtctgcgccatcgctcctggagaggaaagaggtctgcaagtcttttactgtgggactgggcatgatggaggactcttctcccagaacttaggtgttctgggcctcttcccatcagctgttctgaagactaattttttttttttttagtattttcaacattagagactcatttacatattgatattatatacaccttccagggccccctccccccaaatcaacttatatcccagcactattaaatacgtttccattgcttaggaggaaaggttgataagaactgtcttatcgtccttagctgcttatcatcgttgtagcttgtttgctaaagccactgctatgagagcaaggtaccacacttactgagtgtctacaacgggctgtgccaggtcttaggcttttgtttatcacaccatttgacttccacattatcctttcagtgtcactgcatccatgttttgaaaataatcagaatgaggctcagggtggtcaagtaaatatttttcccaggttgtacatctaatagtaaagatccaaagctaagtccctcccccacacatgccacctcccagcctccggtacatgaaactctgtgtgtgtgtgtgtgtgtgtgtgtgtgcgcgcgcgcgcgcgattgtatagtgatgtgcactgttgagttgagaataaaagactgtcttcaatacagtatgaagtttttctaatcccctttctccttggaatagagatttaaactttctgggctaagtgtgattgcaagctcatgtttctgtggtttatgccagcatttcagaaatccttccaagttccgctgtttcctgttggacgtgccacatgttggcaataaagaagatggctaattgtgcttctttattctttctttgtttaggatgtgataggccaggttctgcctgaagcgacgacgacagcgtttgaatgtgagtccggctcgcgtactctccggttctttctctctgcagtgatatttcacatgctttatgggttgtattactttcagaactgacaaaaccaggttatttatgatcatcatacggcacatttaaatatttataaattaatgcaagtttaatgatgatactgaaccgagtaatattttcttatttaatcatatcttgggtgtgcatatctctacaatatagctttaattaccaacatgacctttatctgctcttctcattgttataacagtgcagggcaaaatgagccgtgtaaactacctgtagaccgatgatcgttgattaagaggttttaatcctttagtgctttaggacatcgcagtagaataaagctctcttgagcagcgggtggagtgagtctgtttcagtggggtttggctgcccccatgctagatgacaagggcacttctatcctgactccttccgctctccattgaactggcctagaacagggctaggacgagctagtgttttgacgcagtccaggtcattgcaggaggagtcttggtgctggtttagaagtagcagaaggcctcaggtattgagaaggtaaagtcaacgtctggaattgtggtcttgcccgttttgaaaatgggaccatgggccaaggtgattgcttagtggagaaaatgcttgttatgccattgtgagaacctgagtttcagttcccagagcccatgtagaagctgagcataggagcacacatttgtcacccagtgctcctgtagcaagatatgagatggagacaggagagtccttgtgggatcaggtagccctaatgtagacagcaaacaactaaaagaccctgtctcaaacaagacagaaggtgatgactaatagctgagatagctgaggctggggtcagacctccacacacatgttgagggatgcacacccacactcacccataggaacatgcctgtgcacgctcacacacatacatacacatcatgcacatgcacatgcacacatggacatgtgtgccactgtccaacatggaaataatagtgatttttttccccaggtgacagtgcttttgttcttatcttaaagatgattactggtaaagtgtacgataataatggcagtacagtgccatgtccttgtcacttagtgacaggtaagctgtgcacaatggcagtacagtgccttgtccttgtcacttagtgacaggtaagctgtgtggcacttttgattctgcagatctctcaaggaagctgtccagcagaaacactgaacacccttgatgaagtgtaattcacttgttgaagtgttgcatggtaggattatttttaggtagtaagaaactaaatgtaagcaaaatgcctctgtacgtggactgataaatagtaatgtgtccctgttttgaaggatatagcagcacctaaaatgaacaagtttggagtctatgtattgatatggaaagggaccagcattgatttttgaatggacagtgtatatgggataatcccatctcatcgagtctagccctccttatctacctcatatgtttatagggggacaggatctacagagggcccattgcagtgctttctgccctgggaagtacacatgggccctgggggactggatttgaataggtacacttttcattttatgtatgtgtccattgctggaatagtgttcagtattctgaacttgcttttaaaagctacagtgagtaggactattaattactatttcattaatggcactagaatctccatgctgttgaggaatatatatgtgtgtgtgtgcatgtgagtgcatgctataagctctatttagatttctttcagtagctacagggagttggggtttctggaatagtctgagagtgagtgtttggtattcatactgctgccgggtgagttagtccattttctttagcctttacaagattcccatgaggtgctttgaaggactgctgttgttgcttcagcctaaggaagggcatctctcagaactgagcaacttgctcagatgcatgtaagtgagacctctggagtagattccagaaagtgttttctcaaccactgtgccgggctgttctcagagtcacccagttgaagtgcgtcctggctggctttccttaagcatggcaaggagaagtttacttttccactattttaatctctctctctctctctctgtctctctctctctgtctctctctgtctctgtctctctctgtctctctctctctctgtgggtgcatgtatatgtgcatgtgtgcatgtacttatgtgctcccatcccccactcgggcatgtgtggacagcatttccgtgtcagttctctccttccacactgggtcccagggatccagcgcaggccatcaggcttgcccccacaggcctggcttcgtactgtctaccccgctccaccagcttcccagtccagcgttcataatagtagtactcattgtcctgtcaccgatggtgtgctctgagccagccagtgtgctagatcttttccgttgattcttgctggagcttaataatttttgtagtgactctgcaaagtaggaaaattagacctttgaggaaactggaactcgaagacctgaaatgattgctcacggtgattgctaggaagtggcagagcccagaatcaaaaacaacacacacagtctttgtaagaacatggaagcctctgaaggataaacagaaaaaaatgttcagacttcgaggtttcattctttgatgccgtgttcttgtgtgttctccagcaaggatagcaatgctgtgcctggctgtgtgcagactggctttgctcacctgttatgtcaggcttctctccctttctctcttcctccctctttctgcccttcctcctttccctcccccatctttctgccaagtgctacctaggactgtaggtatttgccctgacatccaactatggaccagctctaggtaaaatagcaagagcaacaacaacaaaatatacacagagagacaaaaataatgacagccattggttgtttgtggctggcttatcctaaccctcggctagcttttctcatgactatttttgagtagtttgattgtctgacccaaaaatctgaaccactaagtggaaccaatatgcaagaaatagtgaagatttggtttgtaggccaatttgctgggaagtctgaagcattttggtggtttgtggatgagtaaccctcaaataaataaaactttatgaaaggaccatttaacactgcagcatgtatccaaccctgactccttacattggagagatggtgtgataattatagagcagcaagaggcagtgcagagctcaaagctgcagcttttcatagatgtaggaagagttagggattgggagctgggagaggttgctgactgactgacaggttgcctgggccagctcttacagggcttgtttctcagcactgttctcagaggggtggactagaagcctccagttacctttgcctcccttactgggccagtcatgtcctttgttcctctgttagcactagttctggagcaaaaccactgtcccttgtggctatattcaaataagaattgtgaaaggtcatgaattagagctaagtggatgttgttctgagctttaggattatctgtgctattgcctggaccttggatgtatttggttatgatggagatgttgggccccaattcaagttgccacacatatgagagggaagagtttacagttgctatttctctctggttttgccttctggcctggagtttccaagggagttagggctgcatgggataggagggagggccctctgggccacagtcagcataggggctggtggtcctaagcccctttctttctcattacccttgcaggttcttctcccacataactagagcacaaatgagtagtatttagttaattttaagtttctcattgtgtgtgtgtgtgtgtgtgtgtgtgtgtgtgtgcatgtgtgcacacgtgtgtgtggaggtcagaggataacttgcaggagtcagttctctccttctatagtctgggttccagggatcaaattcaggtcctcaggcttgatggcaagtgctgccacccactgagccacccagccagcttgctaacccagaagtacttactagcacctactggggtgttgtttgtttgtttggctggtttttaagtagcttaggaacaaagtaaaaagttcccatttgctggtttactgttattaatttcctgagttccttacacactgctgccgctgcctgccccaccctcattggcatacattagacttcttgcaggcattagtgtgctcatgtcaacttcggccttcagctgttgcttaaattatttaatatactagatgggcatgtaaatttttaccagcttttttatctatatattttatgtatttgagtattttgtctacatatccatctgcacgccagatgatggcatcaagttccattataggcagttacaagtcaccatagagtgctgcaaattgaacttaggacccatgggagaccagccagtgctcttaactgctgagacatctctccagccaccagcatttttttttttaagatagggtttttctgtcctagaacttactttgtagaccaggctagccttgaacccacaaagatctgcctacctttgcctcccaagtgctgggattaaaggtatatgccatcactgcccagtgaccctccagcttttttaaaaccagaaaaaaatcggacgtcaacagtagtgactcagattgtttcacactgaggaagctggtgtataatttggatttctaggcatttgaaatcactgtggtaaagagaacctgctgctttgaacgttagtggccatccacgagctttccgtgcagatgggcctcatccacagcctgtcagaaagccctttctccccaccctcaccatctctctaggcgtgagcacatttctctcctgttaatgcggtgggtgcaaagctactgcctttcctcgttatatattttggaagagtgatagtttctttttatctttttatctgcatttactgtctggactattttctgtcacctttgcccacacgtctcttaggctgccttctttctacttgattgcagcgctttccaaagtaagagcattggtccatagagcaagcattggttcattgtacttacaagggtttttgtctagtttgttgttcttttcagcttgttttttgcgctctctctctctctctctctctctctctctctctctcatacagaaggctaaagttttatgtgggcagacttaccatatttccctttatttctgattttgtcatgcttaaaaagatcttccccatcccagggtgcggaaaaacatttacttgcattgcttttctttctgttttaataggagtgtgcacatgcatgctatttatttaatatgcttatttgtggatatcatcaggttttgcttttttttttttttttaataaaaagcatgagttttccaagattagaaggagttgactttactcttaccatctttagcatgtgttggagacagccggatgggggttcagttttatttttcttgtgaatagatagttgatttcatgccaattattgaatactttgtcttttctcagatgtgagactacattctgtaaccataaaaaatcctgtatgctgcatgtgtaggcctaaggatgctgtgggagcttggcacttacgaaggcccagagatccctgctgagtctctcagttccattagcagattaatgagcgctccaacacaccaggtgataaacatcagcagggcccacagatgcgtttcctgggcgtgcctattacgtgcacactgttccctgtatttttcttgagactagtaactattcgcctgatgttgtgggacagggaagtctcatgggccacttgaaggatgagctggaaggccatctagacaaatgctgcctcgtgctcagaacgccatgcatttccgcaattccatactacctccatatatttaggcctgaagccatcccacatcttcatccttgtcaaactgtgtatcacaatttgacttagaaaacatggttagaagataaatgtgtctttcctcagccccaactatttaatttttgaaaaagtttatttatgtattttgagcatagtgctcatggagaccaggagaggacatcaaatccctgggagcttgagttatagacagttataatcagcccatcgtggatgctgggaacggagcttagatcccgtggaaggtagcaagtgttcttaaccgctgagccatttctctacccttctaactcagaagggtttgtatccacttcttattgattaagtattctcagttgttttaagactttttgggaagtttattttgtgatctagatgggaatcttttttaaaaatttgcctacatgtgtatatgtatgtacatcacattcgtgcccatggagaccagaagagggcatcagatgccctggaaccagagttacagatggttgtgagcctctgtgtgggtgcttggaactgaatctgggtcctctgcctgagcaatgagttctctaaattgctgagccatcgcttcaaccttcttgcttaggaacctttatcttattttatttttttgagctcttgattttttttttttgtcatgctttaataagattactaccgggaagatctctgtgcagccttcatgccgcatgtctatagagccttattcctatggactcccaatactatgagtattctatgaaatacccatagtgtatataaaggtgtccaataatatgtaggtccctctattacataaagcatttacaaaaaaattgtatatttaagtcttcagttgtaaaaaaaaaaaaaaaagaacaaaagaaaaaatctccttttgcctagtaaaacaccccctttctgcatagtaaactatcaataatgtaatttcttgctactctgtaattattgatcacttagaacatgagttctttgtttaaatattgttattgtctgaatttcataaagtatctaaatttaagtactctgccacaaatgccccctggagagaagtcaaaatgaacacattgatgccaggcatgtcaaaatttacaatattgggacggtagataaatttatcagctaaggtgggacacatttggacatctaggctggccttaggtacagaggaagacaaaaaaaaaaaacaaaacaaaacaaaaaacaaacaaacaagaaacctctcacaggctccttctttctgtcttcccagacagcctgtctccctgtctgaatgtcctggccttgttacctaggaacctctaagtaaacataccatgtccttattttaagttggacatatatgagctctcatagggagactgcaattatgggagttgtaagctttcagagtgtagaaaacagccatagctgagtgttggaaccgtgcctgtatgagatgcttggtgtctgagcgtcccagtgatactggaaagaaaagaagtttcagtttcttaaattattatattattatatagaaaggccattatttataagcagactaggtagattataattcatgataaatgtacattgagtctaaaaaatattgaacacataaaagttaattgtgcaaactcactgaacctgtcttcacatagagccaacatgtggtctgttctcaaaagctcagcttggataggtgggagtggtgcgcactgtgtctcagcggttcagcggggtgtggtcagaagattaattgagccatgagttgatctcacttgggttgtacagtgacactctagcttttaaggtgggggacaatgacaaaacttggagtatctgtagcttgttaggccaccattaccctcaactatagtaggacagcagctgcctaggtccctgtcccagcctcctcttgtgcatgcagccagggtggtcctcctggaagatgaaatcttaaaatcagaaagcccctgtggcttccatcttactcacgagtgagtgaggggcagctccttcaaaggctgcagccatgctccgtgctgaccccttcttgttgtcacttcttggactccttctttccctctttgcactcttctcttccgctttctcttccattgtcttcctttgtgtcagttgttctttcttcctacaatctctttcccaaatatgatctgtgttgtgtattctcactcagggtgtgtgtgtgtatcatgtgtcatgggcactgcttggtttttgctttcatcttccctgtgcccagatatcacacctgcacatagtaggcacttgttttgtaagaagaagaagaaggaaacaaagaagcagggaagcattggaatactgggggtgaaggtggggtggagtgggagggcaggcaaggaggcaagctcatgaatataaaggtatgtccataggaactatggcctagatcagtaggctccacctctgagaactgctctgaacttgacatcttttctggtaatttcctgctgatgtctttctaacctttacaaccatgtttccatttctttcctgctgttactgtagttctatttgactcccacctggcacagaaggagtgtgacaaatgacacataatatattgcctttacttttctgtcactctttgtggaaagccctcctgagctcctgttgctgcagtaggtgctgtggattccccagtctctgctgtgtacacactgggccattctgagcacccctacccaaggtgcttcttctctctggggcctttatatgcctcctctaggtttccctttcagattgcatgtggcttcagataaaaatcatgaacaacatatggcctgttatgattctctttctcaaactctgccattttgtatatttgtgacacactgcagattttgtaaagattgcttcataatatttgtttgccatctgccgtactctatttggtatcttgctaggatttttgcctccattttaagtgacattaacaaaatccagccagtgcatagacattcctgttctccccttgcctccctaatgtgctggaaaatcatattactatgctccaggcaactagaggagtctgggactgtcattgtgaaccagtgtgtcagatctctgagcaccccctccccccggttatatccagtaatgttattttggtcagatggcaaagaacctcgtgtatcaggttatttttctactttccgccctcctctgtgctacctccttctggagctctgttccagccctttatgcctttagaagtcttggttcccttttagtaagctcttatgatttattactcttatgaattattacttatgatttagtgagtgtagtttttaaaccatcagtacagtttgaaaggcaaatagccagggtgtttgccggagctgtttgaacaggtctaacttttgggttagtagtgttccaggtcactgtctactgagctgctggtagtgtgtctgctttcctgctttccctcgcttcccaggcttgccatttaactggttttggaaagaggtgtgtcctctctttaaacactggggtgagtgtttgtggctgagcctgccatcctagggtcagggacaggttcaatttcactctttggccagcatcacctgaattctcatgagtgtgcttatttttatgtggttatttttctaacccagcttcccttttgacaagaacagggagtcttcgttgaagcagttaagcacggaaattagagggtaaagcagtcccctgagaaaccaagacggccatcaaatagggtctcctgttaggctataagagctattagtcaccatgtcacataagcttgattcttatcaccaggcttaattggaatgctccttttagttggtctgagatctccctcttggagtcggagctcattctgtggatggtgtcagcatctctcccaacccttcttgtcggcttaaggagcatggcttggtcctgtctgttttcatggggtgctcagtgaggagctgctccgctagctgacttccctaggaaaaatctcaagcttacctagaaaccagaatcccagaacccttgtttgaagtagtcttaggcacctaaggctgggtgtgagaactcagagattctctaccccattacatctcctgctccaccatccacttctctctatcaatacttccttatcttactttacagagataattatatgaatggtgtttatggaatttatactctcttatcagaagccatacaaagctcttcacctgcttattattaaactctgagcactcttttgttctattcaaagactgccttcctgaggttacatgtatatgcatgtgttgaaatctgaatatgagctgtccctttgtactcattatctgcacagttagttctggtgcagaaatgagatttgccaaaagctccttcatttttgacaaaatttgagcccagttgattgattatatgtatattcatgcatgtgtgtgcagatgcacatgtatgagtgtaactgtggaggccataggttgacttcacatgtcttttgtttttctctatattttattctttaagactccttctcttactaaatctggagcttggctagactgactggccagcaatgtccaggaattccccctcccccgctcccacgtcttcacctccccagcaaagtgattctatttgcttgatcttcatttttgctttacctacggagtcatcttcccagcaatctttcacttggctttaaagcagaaatatgaagtgccttcgtctgtggtagtccatagtcttagacgcttttatactacctttttttttcttgtctactgaatttcaaagacttccaacttagccttgaatatgttagcttctaagatctgtatggaaagacctttcttttgtttctgatagcatggtgtttctgtctagtttgtctttagaaagtctattttaaaaaccagagtcaggaaaagcagctctttttgtgcagaactctcctggaggtgctgggatttaggaatgtgcccgtttgcacaccagtgtagtgctcctgactcttggctgtggttttcagtagggttcttgaccagtaggggctctgctcagctgtgtggcagagacttgcagatgctgactccctccgtgggcctggggaattctgctgcatgaggcttagggaagaaggcactttgagagctgctggcttcagctacccagggaagtgctgctttccctgcttctgtcaggttgctgctggctactgagaacagaaaggagccaggagttctgcttagtaatagactaactggggaaaagccgactcatcccatggcccccatggctttgttaccaaacaggaggacatcttcaggatgtcttcagttggacaggaggacacgcctgttggtatgcagcagaagattatgagcattgaaacaaatctctctgttctttcagagctgtgcaaacatattctcttatgatgagatgtcctacttgcctggtttggaataggtacttctagtcaaggccgtaactatatgctgcgaacagaaatataatggtagcaagtatttggattctgagcatccttcccagggtctacccaccccttctagattgttacctgagcaggctgtggtcaccacacaagtgttttaggcatttttctttgaactatgtaattagagcttccatatcagctgccaaatgttcctgcctctgttaaaattttgttattatattttattcattcattcatttattcattcatttattcattcagtttgtgtgcttgtctgcctatgggcatgcatatgctgcagcatatgtggaggccggaggacagcttctgagcattgaccttctcctccacagtgtgggttctagggattgaactcaggtagtcaggcttggaagcaagtacttttatccactgagccatcctggttaccaatgtgtcctactcttgacagatgtttttctttagagggatgaagtatcaagacagttaggaataaccagaagtcattctgagtctagcctaggaaaagatgtgagtggtgactcggccaacaattctattttaggttaaaattgagatctgctctcaagaggtctctctttaggttcttaaaagcagcttttaaaactaagagaattactgcaatgagcacattacttctagatgtggcctccttgctgcttactcagatgtgcacattctggttatgggtcctgcagcctcaagtcttaaaactgttacattattccagaataacatgcatcaccatctgaggcttacaggtcggagcagtggggcaaacgaaagtcttcggagggagctttgcaagttagggcaaaagatgggagcccaccatgtctcctgtaaagcagcaataatcctggtgtccacattgcagggttgcagtgtggttcttaaggtggtattgcacatgaagcacaagtcagagcaccatctgggctgccgtggttagtaagtgagagacatttcctcctgcttcagtgatgcgttaggttgcctgggagagaggaggaatagagaacagggaatccggtgctgcctgagacataaatatctgatggtagagcagggcctctcttctctcaaaagctgacgtgtcagaatccagttaaatgcacttgacttacatatatgtctagaataatagggaaatattttgatttttcacctttcttataaaagaaaattttagttctttctttagcaagggctccaactccttttttagcctaggtgagccccgcaatcatgtgcacacacccctcaatacacagtggacagtaaccgtgtatacacatccctcatacacacagtggacaataatagtgtgcacacacccctcacatacacagtggacagtaaccgtgtgcacacacccctcacatacacagtggacagtaaccgtgtgcatacacccctcacataacacagtggacagtaaccgtgtgcacacacccctcacatacacagtggacggtaaccgtgtgcacacacccctcacatacacagtggacggtaaccgggtgcacacacccctcacataacacagtggatggtaaccgtgtgcacacaccccctcacatacacagtggacggtaaccgtgtgcacacacccctcacatgcacagtggatggtaaccgtgtgcacacaccccctcacatgcacagtggacggtaaccatgtgcacacacccctcacatacacagtggacagtaaagtaaatcttcaacaaaaaaaaaaagagaattcgagtcttactgctttcatcatattcatttttaaacagatgaagatgaagatggtgataggattacagtaagaagcgatgaagagatgaaggcaatgctgtcctacgtaagtgtgctgcatatgagggctgtttcaaaaaatgcctttgtgtgtgtgtgtgtgcgcgcgcgtgcgtgcgcacgtgcttgctcgcatagttcagatgacatctcgcaggagttgtttctctcctgccaccatgtgagttgtggggatgcagctcaggcgtcaggcctggtggtacgtgctcctagctggtgagccatctcatcagctagcaaacaaggactgtttttaaagactgttaatgtaattgaggatgctgtttcttgggcacagtggagatagaaatggaaccacagttgccacagcatttttatgtgtaacagataaggttttcaaagatttccttatgtgaaagttaggggcattattttcaaaagacacttactgatcatatcatgaacattaagaataatgcatcttaatgacttttgcattaggtatggtgcagactaaatggactatcaatttcctgtattttttatgcagtacttaaagtaacggctcattaaaaatgaacccctgggctctaaaaaatttttcaaaatctacttttgactggagatgtctttcacccttccagacttcagctataacatagctgcaggcttgtggatgcaggatttaaagatgtactcctggttgttttatgcacttcttgcaccttaaaatgaactcacccacagtgatctgagtgtgtgtgttgggagcttgctttggtatctcaacgttcactgaaattttgaattaacaacttgtcccgagactaaaataggtgacagaaacggtacatttcaaatgcttcagaaccaattgagaaaccttcataaacaaccaaagacatatagcttccctgagccccagtttgagctttcctcccaagttttattttaccttagtaatctgattggaaaaccttttctgtgttctggtggcaagcaccactctagaggggagccacagctctgctgtgggtccctggcctaaggcagatggtttaaccttcagtatcacagttgcctcatctgtcagtgtgtggtgggtaatagcacatgtccttcctattgctcggggttgtgtaatgatcaaatggatgatagatgtgaaacgctgtcacatgcaaagtattgttacagtggacacgatggacaaggccagacatctgcttttctcagagactctaattgtagccaacagttagggtgtatgttttggagagcccttaacttcaaccaggatattgtttcatcgtaatgaaaactgtaaactgtctgtgtgggtttccgccaatagttttaatttagggtaggaggaaagagaacaagagggatggcatgattaacagagcattgcattcctaccagcccagagtaggaaaagtcaatttcccattgacttcccattaacttatgtgggagtctttgtgtactgagaatttagagctgagatcatcggtacgtggaaggcagagcgggattgtctttgccagggcagcattgctattgatggattggctaactctcccgagagcgtgactcctttgtttttagagaacgcatgcacacagacacagacgggttctggttttctaacctaggtctttggcgttcagtggacccccatataagcagagtggacttcccagaagaccttacaaactgtgcctggtgaaagagttctgagtgtgaccctcgtgatactgctcacctttccatttctgagtgacagatgtgtaaactcagagtttgaaagacttttttaaattgacttttacttatttgtgtgtctgtgtataggggtggcaagtgtgtgtgtacatattatgtgagtgagtgcaggtgtgagtgcacatggaagtcagaggatgaccttgggtgtcagtctttactgtctgcctgtttgagtcgaggcctctttgatgtcagccactgcatgagccaggctagctggcttttgggcttctgagcagtctgctgtctctgacctccatcctccatgctggtggagctctgggaatatgggcacagcgaccacacctagcttcacatggattctggagaagtcctcatcctttcatggcagcagcttccccactgggccgtctcctcggcccttaaatagtgactcactctatggtagatacaagcccgagattaaacctggatgctcatatttcctaagcatgtgccccattgctgagccaccctttgtcccctcatctctgtttggtaaatggttgagagacatgcccaaggccttaaagctatattgaaagttcagaactggaggccgtgaagacagatggctcagtagggaagctcctgctcctgccaaggacctgaatttggttctcatcactactttgggtggctcacaattgcctataactatagtccaaggagatttgacccctccttctggtctgtgggtacccacatgcacaaacccccacacagacatgcgcataactgaaagtaaattttaaaaagaaagaaaatatgtttggcctttaatctcactgttttcctggttgccactggaaactcctgctgggaactgtggaaagagcatcatagaattcgaatgatttgtttatgcaatatcttacttgtgctctctgcaccatacattcctaataaattattcttgtttgtttgttttgtttttttgagacagtgtagccttggctgtcctgggacttgctctgtagaccaggctagccttgagatctgcctgcctctgcctcttgactcatgggatgaaagctgtgagccaccactgaccccagctttatgcatgttttttaattgtagtacttagtcaattttagttgtagaaacatgttagtcatgaccttgttgtcatacagcataaccttgtaagacatgtccttaaacatagtccctgagatttttttgaaagatacctcttggtctgaaaataacacagttgcataattggctatccttttggtctgtccccattcttttgttttgttttgttgttttttcgagacagggtttctctgtgtagccctggctgtcctggaactcactttgtagaccaggctggccttgaactcagaaatccgcctgcctgtgcctcccaagtgctgggattaaaggcgtgcaccaccaccgcccggcatctgtctccattcttatgactggaagttcttctgggcccagctctgtcatagagaaccgtgtggatcaaactccacagtcgtgttcatcactagtcttcaggagcacccatcgaatactaggattttgcattggtatttatttattgatattttaaatatcttattaaattttcttttcctttctttctttttttttttaatacaaaccaattgcagttggtttccactccctccctccacttctcccagtccctcccttccctcccagatccactgttcctccatttccctttcggaaaagaacaagcctcccagggagagcagctaagcacagcatacgaatatacagtaagataggtacaaaccttcacatcaaggctgggtgagtgaggcaatccagtaggaggaaaagcatctcaaaagcagatgaaaaagtcagagacagccccgcccccactgttaggagtgccaaagaaaacaccaggctaacaaccataacatctctgcagaagacctaggtcagactcatgcagtctctgtgaggccctaggagctctgcttggttgattctgtggtctgtgttctactggtgttcttgacacctctggttcctacagttcttttccctcttcctctgggtttccctgagctccaaggggaggggctcgatggagatttttagcattaagtacttacataaaaaaaattggagcaatcttatactagaaaacatacctgaaagctctagaagaaaaaaaagtacgggcactgtggtggtttgaatatgcttggctcagggagtggcagtatttggaggtgtggtcttgttggagtaggtgtggccttggaggaagtgtgtcactgtgggggtggactttgaagctcttataagagttgctttgggaaggagttacagagacaaagtttggagctgagatgaaaggatggaccatgtagagactgccatatccagggatccaccccataatcagcatccaaacgctgacaccattgcatacactagcaagattttatcgaaaggacccagatgtagctgtctcttgtgagactatgccggggcctagcaaacacagaagtggatgctcacagtcagctaatggatggatcacagggctcccaatggaggagctagagaaagaacccaaggagctaaagggatctgcaaccctataggtggaacaacattatgaactaaccagtaccccggagctcttgactctagctgcatatgtatcaaaagatggcctagtcggccatcactgcaaagagaggcccattggacacgcaaactttatatgccccagtacaggggaacgccagggccaaaaagggggactgggtgggtaggggagtgggggtgggtgggtatgggggacttttggtatagcattggaaatgtaaatgagctaaatacctaataaaaaatgggaaaaaaaaagagttgctttggttgtggtatctcttcgcagcagtaaaaccctaactaagacacacacccaagataagagagaagatggcaggaaataatcagacttggggctgggatcaataaaataaaaacaaagagaaaattacaaagaataagtgaaacaaagagttgtttctttgagaaaatcaaaaggatagacaaaccgttattcaaactaaaagggagagagaatagctaagttaacaaaatcagacacaaaaaagaggacatgatagatagatatccaggaagtccaaagaatcaggatgccatactttcaaacctttacttttcagaattggaaaagctaaaagaaatggataattttctcggtatttttaaaattcaaattgaagtgctgggtgtggtagctcatgcctttaatcctagcacgcaggggggagatgtctgtgagtttgatgctagcctggtctatgtagtgagttctagtccagctcaagctacacagtgagacctgttcttgaaaataaacaaataattaaaaaataaattcaacttggctctgaaaaggatttgttgcagagtgtggcggcatagggacatcccgctagagttctgctgcagttttatggtaataacaaggtacagcagcttcggctttcctagggaactgggtaaaattgtagtcactgtgaggcatctgaaggagctgaagtggagatgcttcacctctgtcctttaatcattttcttctactgatgacaaaatgaagagagccaaaactgtgacattggtgtcaaagcttgctgaatcatccccctccccccaaattggatgcaaggattttctggctttaggccaacacaaacctaagtttttaccagtaatttaaatagatttttgtattagacctgaaaatgttggctttttaattgaaaacttatcaattatttaaatcactagcagctcgaggctgttaattttatgagtgctgtaataatggcatacagtggtttttgatacatgtgaggcagtgagggtgcgtcctggcagctggctgtgtgtcgctaactaaccagcaacatgctgaaggctgccgtcgcacatcaggaccatttcctataagttatttagaagttgtattcttttctccattcgatatatttttaagagataatgagaagaaaacaaagctataataaattgtcttttaagaaaatgtaaagtaatttggtctccaaggagatatttaatgtattgagagacttcagcagccaagtgttattacagcagcatggtgatagctctctgcattttgttatgagtttgtgttaatcaacaatctgtttttatagcgtagtttcttgtaagttattctactagaatattccacttctgggatcatggcttctcctctgacactattgtatctttttaattcctccataaagtatttttttaattagaatttgaaatgctttattagaaaagcatacaacctacatattctgaaaactaaatacctgatcattgcgaattatttaaaggcccctgttaaatattcccttaatgtagtttaaattttgttgtttttcttattttcccatcttattttttagagagattaaaaataggtgggtgttgttctcctgtagtctgttgtattgcagtgtggcagtgccatggagtctttggtgaagggcttgtaacgctaacctcttcctttgggtggcctttcactgagaatacaacagcccactgtaccgctgtgaaggattgatatttagttctgctcagtcctgtgtctagcaaaggacgtctgtgcatcagattcccacactcctcctaggcttgtgtgagtggagcagagcactgacaagataagtcttcctttctcccattctctctctcttattccccacattgccagaagcgtacaggacgagctttgttgtagtgttcccattattgcagagacctttgtttccatggagtgtaagtattccctttggtatacttgaccactgtgtaccttgttagacagtgggtaccgtcagggggagcactctttgacctttggagcaccatgtaaattgggctataattatatttaccgtggtcttcataacttggagactgcctctaaaatcgtgttaacttgagtagagcaggagggcacctcagaggtctcgtgtgtgccttcctttcacaggtaaacacatgagcctttgacctcggcttcagaaatgtgttaggggcacagagttggaccaaggaggcctggacagagactccctggccgccatctgtttcaagtgtgtgttgtgttctggtagctagtaagttttactgagaaaattttgtacatactacttttttttttcttgattatttttaactacattgtttatgcagattatggtcttctgaaaattgaaatttcttggccaatttttatcacaaaatatgctgtccatttgggtattttacatataacaagtaaaccaaaagtaattttgttttctcatcctattcaagatacacacacacacacacacacacacacacacacacacattggtgagaaaataagaagaataaaacttattttcagagctagatcatcttactttttctttctgtattatcaaggacattttgggggagggggtctcttgaaatagagatgaaaatgctgtggcttcttctttttgcctaccttgtggcatagctggggcatgcccggcatcaaaaggggatttgtatgcagctttggaagaaagggaaacacagtaggctcagcctccaaaactctggatctccgctacagcttgagtccccagcattttgacattggtattgtttgttcatacttgatctctgtggagaatgtaaggagcgtatttataagggaatgtcccatttggcctgctgtctccatggccgggtagtcttgttatatcgaggtggacggcctaagtagcagtttagacccacctcttcagagaggaaagcagaagtttgaggtggcaagtgagagattagtgtggacactgcccacgctcatctcgacgagactcaggcttctgctgagaacacttgaacatattggacccattgctttgctaatggaattttctactaccagggcacactgcattagctaagctgaatctcacctgctgttggcttctcacacttctattaagaccatctggaacttcctaaagtcctttataattttgctagccaaaacaaatggtatcattactaaatgtggtcaacttgctattatgttccaaaacattactaggtacgtgtgcgcagtggcattagcctggaagcggacttagagttgttctctgttggtcttttcacagaaaacctgtggttttctttctccttatcatctcagaccatgaccacctatggacccttgtcatagagtaagttaggaacagtctccttgacgcagagctgtgagttgttagggaaccaggggacctggcattcttttaccagaggttcacaccaggctacatagcacctatcatttcaggaactctaaggattccctaaaggtctttgtctgttggaaggcgtgtgaagaagagatcgaggaaatcgccctgaataccgaagaaggccatctagcttttgtccgtgaggaagttaggaacaaggttcagggagactgcttaatgatgactccccgacctgatggctccccatttccttcctgtaagcaactgcttggtgtttgcataggtgttatgtgtaggcaccatccagtagttcatgaaggatatggaaatccaagggtttcattcttttaccagaggttcacaccaggctacatacatagcacatatcatctcaggaattccaaggattccataaagcccacagagagcccaagtggctaaacctgctgtgaaagaataaatagttgaggcctggctcctgccctcaatgagcttctggaagaacacaccacagtcttgtgtgcacctcttactcagggtgttattgtaatgctgtagggatgaggacaagggagggctgctgacacctccggggagacagagctaacccggctctgtagtgggccgagcagttgagcagccttattcagagctttctgtgtcgcctgctgtcagaaacattgtttttctgggttcagttgcttaatggtaagaggttcatagtgctgtgcctttttttttccctaagtactttatagaaggtttcctacgtacctttttttttttttaattttgatcttcctagtgactttatggtgagtgaggcaggtaatctccccattattacaattgactatttggacacaagcctgtgtgcctttccttaggtcacaactagtaaacatggctgcagccaaggcttacttgttctgtgattcactcactcattcacctactcagctagattccaagagccaggatattctgggtgataccacactgaccaaggagcatgcaggaggtgtgcacggtgatgtgcaatccaggtcctcccctcctctcaagacacaaatacttaccttccatgctgctgggcagcagcggagagaaacccagattaggactgtaaagccaacccttaccaggcagaatgacaagtgataaatgctggggcatagggtgcctgtgaatacggaaaagcactgaatccatctttgaggaaggacagtggaggcttctggaagaacttggtgtcctggtggggtggacagagcccgtgggactgggaagggtgttctgggcagaggagcggtgcatttaaagctttagaggcctggggaattcgggagaagctgcttgagattcagcctgtagggataacaggagaaggagggtgtgtgggagaagagttctaacacacagacatagtgtgggctgtttcagaccaaagacagaggtggctgcaggtgtaaaagggcaggagatcttgtagaggtcagatgtgtgaacccaggtgggcaatatggaaagggaggtggccagggccagtccaagccatctgttagagcacagcatggcttggtaaactcaggtggcagaaaaccagactagagtccaagggagggtagagaggcaggaaatgcagtttttgattgtagcatgggaggaggctctggtcaaccaactagatatgctccaaatctgagagagacatctaggctggaaataaagctttgtgactcggcaggctccagttagtctccatgactcctctggtgatggagacctggggaagtggggcaggggatacacagtgaaagggagggtgaataaggagccataggggccttacctccattaagggctcattctcaggaactagaatgaggctcgctgaggatgggggtgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcagagggctttgtgcccttttctcagccagggaagatggctgagctcacacactgtgggagcaatgaatgcagaagccagggctttctgctagctcagcagtctgcttggtgattctgtctgtttagttaaaggtttggcggatatgctacccacctactttttaattcttaaatagtaagcacgtgtttcatgttttaagcattgaactagaataaaacttttttttttattgttcactaataacctatgcttattggtaagccatttgtctcacctattaagcagttgattagggtagatgtatgggaaattagaaaaatgtatgaggtattcagtattgagtccaacatgtacaggcatttgtggggctgagggttgtcccccttcatagagaatctaaggcttgtaatattaaactgtgttgttttgaactcaggttgttgattttcttttttaatatcatagatttccattaaaatttgagttattgattgaattatgctgttataattagaattgggttcataacaaatagggacactgcttgataaacttgcaaacaaaggaagcaattgtacttgttgtcctttgctgaatctggccttcctttggagattaattatatttttggataactacactaaactctgccacattcttattaaaactgttaagggttttaaagaacatctcagagagactctgaaaccgatccaagcctggtgctagagattccattagctatcgtaaaactgattaatcttttacctggttagcatattgattattgctgcaattactgcttgtaatggattatgggagggacagctgaagcaagcgcactaactgctgcctgtgggattcgtttaggcacctgttctatagtttctgtatgtaatctgcgctttacatgcgagagtgcacctaaggtaggaagtgccaggctaagtgttgctgattgctgagccttgggaggtgatgggctgtgtggatttgagcgtatgaagtccttcactcatgctgctgctgctgctgctgctgctgctgtttagcctgggatttcacagtaacctgggtgataaggcaaacattctcactctcctttggaagccacgatgcctgaggagattgggtgactttctgagggctgtgcacagtagtgattggtagaatcagggtccagccccattttagtcagtacacacttcacaaacacctactgtgtgtagatcgtatgttgaagtaaaaatagctaacatgtggtagatgaccacattgtgacttttctgttcaactcatgttagctgtcttggtgtctgaggtctaggcttctctgttaggacttgctttttttcttttgttttggtcaagccagagtcttgtctctgccatcactgatgattttattactatttagaacaaaatgggagagaataaatgaggagaaggatgcaaagacagagggccagacttcattaaaaccagtggtttagttgtggtctttgctatttctctgtgaggcttacagcactcctctggctggaatccatcttacatcccagcagagtgagatacagcaaggcaaggcagcattaccccactggtgccatgggtcaggagacagccagtgtgaggttcccagggatgggccctccaggcctcgagcgcctttatcattcacctgggcagcaacagacctagcagcttggcagcctcgtagcctggtgagagtgctctgtgccaatgtcctgcacatgccccgcgtttttcccttgcctgtagggagtgctacataggcagcagcggcccacaagctcacagtgggttcacaccatgggcttggttgctacccagttctgtgtgtttgtccatctctagcctaatatgtcagcaggggaaaggcacttgagtttgagagagctgtaagaaagtaaaagtaaagccgaattaactgtttgagagaaaagtcttaatcagcacagtgtgtatcactgcagagggactctgttaatcatagtacggagagctgggtatacactgcctaaatttttcacagtggttacaaacatatatgcagttttccagttgatttggcacagtgctaagatgaaagtgaaagccttttttatttattttggggggtaaataaataaagctggaaaacaggtcaatttcatgcatgcaaggttttatagtaggggaaaggcactgcacctgtcctgaccctcacactcgaggttatttgttctcagacttgaccccgagcacccgtttcagacaattctataattagtttgttagataaagcataaggatatttttttcctgatttctaggaccatagcaaagtagaaacctactgtacatagcagttaattaaagaaaagcagtaactatgggcatggccacagtgctgtcttgtatcagtataaaaaggcagggatttctttgacagccactgattggaaagttgcttgcagccttccagaagcaagggtacatgctgtggatcaataaccggcaaatttcccattaaaaagaatacctgagcaatgttccaaatagccactggcatcttaattttccgcagaaacctcaagtacttgtgtgcctgccgaggacaagtcattttcggacaatttttccagactacttgttaacagttattgctgtcccgaaaggttgacagccgacatgattgatatttcacttacctgtcgtcaccgtgtgagtaatggcaagtgcactgtacttccttgcttttcgggagcagcctctgtggccctagtgtattccaacatgatttgcacatttttccgctgtgcgtatttaagtttttaggtccttagaaagagagaattgccttcctttacagtttgaaagccattgcaggagggctgtgtgcatcttggtcatcagccagctgtccctcctgcccctgccaccacggtcaccttcaccttccttgtttgcagtgcagaacagaaggccttggctttctcagcttctgatcttcacagtgatgcagaatattcagacctttgcatattttggaggaaaaagattgattctaaaataaccttaatgtatataacaccaataaaaagattccagtttttaaaatttatttttattttatgttcattgctattttgtcaggtcccctggaagtagaattacagatggttgttagctgccatgcgggtgctgggaattgaacagagtcatcttgaagagcatcctttggaaaagcagtcagtgctcttaaccacaaagtcagttctccagccccaagatagaagggttttttagaatgttagtaaaaatcaaatttcaggaatttcctgaaaatgtcgtagttaagtggtatgtgcatatttaaatataaaaacagcaaaaatgagaaatggggagagagtgtcctgcttttgataagcccttaaagcacaaagtcagggcgggagagatggctcagtggttaagaacactgactgcctttccagggaactggggtttgattcccagcacccacacagtggctcacaaccatctgtaattccagatctttttctggtctctgcaggtaccaggcatgctagtggtggatatatgcaggcatacacataaatacccatacacataaacaaataaaaaaacaattttaagcctagtcagtggttttcattgtaggtatttttcttcatgaacattattttcttgtttgttcagcttaaagaagtataaaaaggtacagaagccatctccacatataggcagataggtggagcaggcagtgttccaggaaacagtgtgcttagtattttgggcttattttatgagggacagtgagctgttgttttactcaagaccttatgctttatgtgcctagaattttacagtaagctttgatccatcttaaagtgtgcctaaagccaaattacgaatcagaaggagacttgttaggagactgcttttacatgggagttctgctgtccttggttgagtactatgttgttcactgggcccagcagtctcttcaacttcagtcctattagctctgtgctttatacacaaatgtgtgtgtttgattgactgacatgtgaattcaagccaaatattgagcctattcattttgctttacaaatttcagaggaaaagcacaagaagcaatttgagtaatttctataaaatgcttttttatgatttaaaatatatatcattttaaagtatgttaaatactaacatggggtcttagttaatactgttagtcttaaagataaatggtggtatggacgataaccccctactagacttccaaatcttgaatacattcactgtagcaattttgatgtgcaactagagacactgtgtactcaaggctgatgtgtgcataccagccatttacaagagtaccatgaattaaacagcccgtaagtgtctgtcccagtgtccatacattactgagtaatctctttctattatctctttgcagtattattccacagtaatggaacagcaagtaaatggccagctaatagagccgctgcagatatttccaagaggtaatgttgaacaaattctaatcaacagtgattatttcagcaaactgtttgatcaccagctatgctttccaaaggtttaaatgcacatagcatgatgtttagctcataatctgaaaaaaacaaaagaagtattcattatcatgggggattgcaagctacattatagttatagcagataaaatatctaatctactagagtaaattaaactaactagattgtttttttttttttgaagtgcatacttacattcgcttaaagaactctttgggagtccccatgattctaaagcaaggcagatggctggctttagttctggacttatgacttgtggctcataatgatggtgaaggctgctgttgagatgagagctgttagcttgtgtggaggctgtgagaaatggggctcagggacagggctttgggcagagcttgatatttgtcttgggatgggggaggtttttaaaaactaatggggccctcttcttcagtggcagttgatttacatgagggcgagactaagtgaatccctcctttagggtgggcagtaccagccctgtacgggctgtgattgttccttgtgtaaatatcctctcaaaatttgaacagtagtgaagagtgacttagttataccaaagtaagtttttaaccattatttttgccccacttgaaatccatgttttctaactaattgaacagaccaggaaatcctctaagtaactcttctagaaatagcttaattgaaataattaaaagttaaactcacttcgttaactaatactgtacagataatcatggtatgagttttccaattaaacattctagactttcattacctgtaactcagaagtttgaatggctcaattaaccactgggctctattgtagggatggtctcaaaggcagttggcttggccagctagggaggagatccgggttcaagtgcaatctacttctttgggcatttgcgtgggcagtagaaccagggggattatttcattattagtaagaacttaatggagggcaaagtaaaaggataaaactgtgctacttaagatcagtggtcattcaaaagaaaggtatgattaatcgcgttctgtggcgcttgactgaacaggcaaacagagaggctgccgtgcttttgtagctgtctcctgacagtgacccagattatttccttgttttctctgtgactttagagttggagcaaacttaaaaattatttccttcacaaagaatagtgttttaccagctgaaaatctctatccattgcttctgagctctgttatggcaatcccagagaatctagtcaccaggctggagggcttttctttatactaaacagtttccttctctccacaggaactcttctcagttcagttccctgtcactgtccaggcagtcttgtcagcaaggctgttcctgtgctaaaccccctgatggtggcagccattctgagacctcagctctccttcctgtccctcccagcagttccacagttaggtttttctcctcccgttgtatgggctcttaagaagcctgagagctataaagcaactaagcatttagtatactgcgagtgagaaggtgacttaaattacagtttgtttcttgggaaaggcatataacgtcaagttctagtgggtgtgtaaagggagtttgaggggttttgtgcggtggtgctcaacctgtagctcacaacccgtttggtggtctaaacaacccttttacaagggctgtcttagttatgttatgattcacaacagtggtaaaattacagttatgatgtagcaatgaaaataattttatggttggggatcactacaacatgaaggactatattagagggtcgtagcattaggaaggctgaggaccactggtttagtttaatgctataaagacacagctatgacatgctgtgatcacttcatccctggcataactaacccatgtggcttaatatgcattgaatgtagtctctccaggccacattgagaatttcaaaatggtagtccatcccccttctcggtgctgtgactcagatcttttgggctcttttcgattgtcttgtttggtacctgactacctcactacagatgtagatgcccccatgtgatgaaatacatatttgttcaggttatattttataatattttaatacggactagagactcttgggaagaaggagtctcagttgaggaatcacctgtctccattagactgtcaggttttgacttctgattgatgtctatagtgccagccctgggtatactatcctggactgtattaagaaaggtagctgcccatgagtctggaagcaagccagtgaacagccctctatggcctctacttttgttcctgcttccaggtttctgccttggcttccctagatgatggactgtaacctgtaagctagaaaaaaccctttcctccccaaggcgtttttttggtcgtggtgtttatcacaacagcagatgtgcatacttggacagtgtagttagaatgtgggcatggtaaaaggttccctgggtcttcctgattggtgagaggctctcaagccctagaagggtctgtgcctaggccccatgtttaaaagaatctttaggctgagcaagttgttgggtctggagacaaagattttactctgatcacatatcctcctcatttcaaggagcactgttgccttgaatagcattccagtcttagttcatggccaagtcttccctgtggctcagagctgtgttaaatattaataagtatgaaaattggttagcattatagtaagtgccttcttaacttcaggatctatgaggttgctggggttttgaatgcgacatggctgtttagatttctagtcacaaaggtttgatgggcagttgagaagcaagcagtgctgaggttagagaagacagctggaggccttctcagaccttggctcacccccatttgcctgcacaggttaccgcagaggcagtcgtctgagagaatactgaggcttccagggctgggcgtcagaagaaggcagccgttgttttgttaatctgtattttaaggaaagaagatttggaatcttaatatattaagtatcctatacgcttaaaatataaaaacatttattcatgtttatgtatttttggaatattaatgtaataaattcatttaaaatatatattcattttattttctgtgtatgtgtatgcctgtgtaccatgagtgtgtgggaactggagaaggtcagaagagatgtttgatcccctagaactagggttagaaatggttgtcagtcaccatgtgggtattgggaacagaacctgggtcctctggaagagcagccagtgttcataaccactgagctgtctctccagccctaataatataataaattcaaatttacttgaagctcccaagtgaaagtgaaacccataccttgtaattataatgcatgtcttcttaagcagcttgatttctgttgtcaagaaacaaaaagaaaacaaaatcaaattcatccttctctagacagagttgacagccccttaacagcctgctgtaggacactctagtatttgggcagaattggtgtagaacagggatagggagctcgtgtttgaaacgtgattacgaagcacctgctggactagaaatatctcactgtagcccacggtggtgctgggaaatccctgtcagttttcctagtcctctgttaccctcagagctaagtattcatggacatgaagattttctggaaacctcattaaattatatatctgtttaaatagtccagttgcttatggctttacaagacttgaatatacgcagacttgcatattccatcttggagttcccagcagtctttttggcattcaagaaccctttctccacccctccatgccttcaaagcaacaaaagcagaagcctgctgtttagcacgccctttgactgccttgtgcagttctgtagcgagggaagactgcagacatctgagccacgagaggaatctcatcattctagctcggctaatgttttggtgtgttttaagcagaaattggaattcatatgaagtggtgtcagaaagctctgtgcatttataaacactcactcctgcacgttaaaaacccagttcataattcccaccttgggtctgggggccacttttcaatcatttctctctgctaattttggtgtcaccctcatttctttttaaacgattcattttgagcaaatttgtaaatggccctgatgtgttctacaatttagtcaattactgtttcagcctgcaagcctcctggggaacggaacatacatggcctgaaggtacgaatttcaataattgtttcagtaaagttagatggatttgtaatgctgtgttccacttattgaaatgtcaaataaaactgcactttctcaagctctgacaagcaatctttctcctcttcccccgccccccattttcgagtggtggaggtggaagggccacatctgtatttgcttacaatgtgtatgtacgtggatcctggcctttggtgctgtattttttcaatgacttggagttgttttgttggtcagtttctccaggatgatcctggggtctgttgtccattaagattgatttgagtgagagcacagccttccttgtggtgattaattaagctcgtaagcatattgcacacaggctgcccttcctcttctctccacatatttatgcttggaaaacatgtctagttaatgtctcctcattgttctgcatgttttaaattctgaatttctgctcaaagcttcacatctgaaagaaaaggtggctattttattaggctcgagtgttttataattaattacttgaacctcattttctagtgaatgggatgcagttgtagagcctgaaggggtggcatcctgagggttgctactaataccagataagagcttactgtgcttgcatgggcagcctgcctttatgtcactgtagatagcaacctgaggtcggtctctctctctctctctctctctctctctctctcctccctatttaagtatttgaataatgccagggatatcagattatgcaatctccagattgtacacttctgtagcatgtatactgaatatactccagcagtgggtctgtctagcaacatgctaattaaccttcatagtgagatgagcattgtgtgctgaattataggctaattagaactgtgtcctcagaacacgagactgacccaacttctctcttcacttataggtgaatacacgggctgggccatctcaacacaccagccctgtggtctcagattcgcttccaagcaataggtaaggacaaacaagggacgtgtgctctgctgtgctcctctgtccaggtggctgtgggctgggaagacgctggtgcaacacacttgtctcttctgtaagataaaaagaataggcagctgtaaagaaaacttgagtagctagatagctcttgctacatattgactgcagagaaagaagacttaatatagaaagatgaaattagagacacatgagatggttcagttaataaagatgaaattagagatatgtgagatagttcagttaataaagcgcctgcgggcaagtgtgagggcctgagtttggatccccagcacccatctaaaatccagatgtggcaccgcatgttcgtgactgcttctggggaggtagagacaggcagatcccaggagctcactggtcagtcacctagctgaatccatgagctacaagtgcagtaagagggcctatcacaaaatgtaagactgtgactcattaaggaagatctcatacatgaacctctggcttccacatgtgcatagatatgtgtacacactccctacaaacacacatataccacacacacccatgcaaaatagataaataagtaataaagattcaaagatgaaattgacatgtgaaatagttaattctgttctaagcagtttttcccgagtctccaaattatttatatagcctgtttcaagtcttgatccagttacaaactgtgtgattcttattaagtgtttcctgcttgcccatcttttgacagtgttattatctgctggcatctttaccagacagagtcaggggaagagtcaaatggtgacatttaactagaccagcagtgctgctcattaatggcatcttgcattgtccaggagattaaaacgactgtatcaagaagatcgcttttgtcacttcatgctagcgtcaccccactctgggacagatcttaagcctttcatagtcttcttttatcccccaacttaactgctacaatatggcaatgcgcaggtgttcagttagcctgcctgtagacattcctcaccttgtgatgctgggaggtgcttgctctgtattgcagtcacagtgcggctggaaagctgacagaaccacaagagcttcttccatcctgcactgaagggccctggctttggggcttcagtcagtgtgtgcacagcctttaacagggtgaggtgcagcttaggcttctgctttcccttcacatccttctgtcttcctctgtgcagtcttgggtctttacctgtgggtttctggtttgactctggcttacagttttggaggttgagagtccatcttgcctggcccaggcagtggtgaggataccttgtcagtcactcgcctcatggtggggacatgtgcaagagtgagtgcacctaataccggagccacagactctggtcctatgctcctgctctcttctttattgtctttaattgaaacattttatatgtatgagtgtttgtgtgtatgtattagtatgtaacatgtgtataccactgccccaagaagccagaagtggtcggagctcctggaactggagttactcagatggcgatgagcctccatctgagagctggagaccaaaacaggttctctgtaagaggagcaagtactcttaaccactaagccaggtcttgcttgtattttttttctttaatttttgagactcttgctatctagctcaggtggaaatcaaacatagcagtccccctgcatcatccccccaagtgctaggattactggtgtgtgccaccacactttctctacaattccaggtgacctaaggtccttccactaggttcctcccccaaggctgcttccctggatactttactgtggtatcagtatctacccaggagccttcctgctgagaacacaggctctaaaaggcatctcattaacagttggttccatcttaaagtacagttagctagctagtcaccagcatgtcctttgcctggtcttgtgggggaggtgtttgcttctccacagagggctttggacctgccagattctggtttgcatgcactgtctccatactgcctggacatgtgagccgcggtcttgcagactagaggcgtataaatagaggactgcatgctcacagagttcctggcaggcagaacggttcactggggccactgatcccagaaaagatgatgtgcacacagatggccaatgagccctgggaagtcaagctttcccctggtattttagattacacttttcaacagaattgaaaagatttctctctctctctctctctctctctctctctctctctctctctctctctctctcttctctctctctctctctctctccttccttccttccttcctttctttttcttttgttttttttgtttttgtttttttttttgttgttgttttttgtttttcaagacagggtttctctgtgtagccctggctgtcctggaactcactctgtagaccaggctggcctcaaactcagagatccgcctgcctctgcctcccgagtgctgggattaaaggcgtgcaccaccaccacctggctgaaaagatttcaaatcatagaagcagtgttactttccctacaagtgaggattagcttggtgtaaaaattgtcatgtctcttcatggagtacagtaagattcttggatcagatggaactttaccacctgattatctcacgtttcatcttggtctcttcactacgggatatggcagcctcctagcttgtaaggatagtggttcctgtaatggaagaatgttaattgaaaaagtcctatgggtgttttaatgttaccctgcattggccatgttctgtgccccaggttgaaagctaatcagcagatatttgttgagtatctcttactcattagttgctgtcctaggagtatgacgtgtcaatagtgtcgtgagggaagcagatacatgcagagagaacagtagtcaggaacatgtttctgtttgaactgaatactcaccgctggctccttggggaacgtgattgcttccatgtagacctgatgcacaaggaggaccaagttacatcacaatacagacatctcagctaaaggtgaatgtttgtgtacatgtttgtaagtaggttgatttggcaggagcacaaggataggtgaggggtaggacaggggtgtaggagttggggagagcaactcaagtgctggaagggaaggatgcagatgggagcaggtcatgtggggcttggaaggcccatcagtgcctaccgttcttgtcctggcctggagaccagagagggctcgggcagcacagggcaagcaaagcccagtgttggtagaaactgtctgtggggagcagaaagagggcaaacacaacctaccctgcccttcttttatccttggcccccgttctttgccaaacagacatctgggttcttcccaacaaccctaggcgagggatgtacttcctgggtcaaggctacccttagttttcatcacatacatcttaagaggttcttcctttctgagctgggatttgtcactcttccacacccacttgtaaagattgggttttgcaccaaaaatgggactgttccttcttcaagttagctcttccttgtcatcttctctctcatcctaacagcagcctgtaccttcccaggagcgctacatttgcccacttgcagcatccctttggctgcacaggtgctccagagaatctccacagtctcctgtcagtctcctctaccttagctgggacatccttactaattgtattagtctcccttcactataatggaatacctgaaatagtgacatagcccattttgttaagataaaaagtttagttaacttttggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgggaacttctgagtgttcttatgccctcaggatgaagtgagacccccgcctcccacaggtctcgagtggtagagtttgccttaggtgaccgcacactgcagccttgctggtgagcacgtggtccctctcactactgagcctgtgcatctctctgctgctgcctcgttcttttcttcctcaccttctctctcaatctggctaaccttaactatcttcacggaccaaattgccttcttctttaccaaccaccccccatgctatagtaggtaccccgtgtggactcctgtatcttgccctgcttcttttgtctgtagcagggagctcattggagcacaattatctcggtgtcaggcagtgactgcagtgtacccactgcaagcccgggcatgaggtgtggtacgccatgcttgctggggtgagtgagtgactgtgtgtatacttatatccacattcggatttctctcagccttctttcaacttactctgcatttatgacatcatttctagtccccttacctcgtatttctttttagtttccgagacagcatcttgcactgtagaccagacatacccagaattcacctttcaatctatgttcaccttgaaaccagaggagtttttctgcctcaatcttcagagtgttaggattgtagatgtgaacaaccatgtccaactctaccttaacagaaactgtgggtgctgtgcctgtgcaccatgtgcatgcagtgcctctggagcccagaagagggcatcagatgccttgaactggagttacaggtggtcatgagcctctttgtgggtgttgggaatggaacctagatgctctgtaagaacagccagtgctctcaacccctgggccatttctctagcccatggccctctctttttattcttttatgctttggataaaagctggatgacgctttttggtttttcatgccaagacttgaaactaagaccccacccgtgttaaacatgcgctctacctccgagtgctgctctcccttccctttaaactagatttgcaaggctggatgctggcatgtcagtgggatcagtttcctcctgttactttcagtgtataagtcattctttggcatgggggaatgaccatttgttagactgagcttattaacccacatggtgttcctaggtcataattactgattcaagccccactgctgaggtctttctaaacagcttggctttctccttctgtaaaatgaggatgattaagctctctgtccgtccactggtagcataagattgatgaagctctgttaaggaatcatattttgtttcttggatgaaagacattttgtaaaggccatgaatcaaagtgttattatttaagcttatgacataatggactatctgtggagagaccacagtggaagctctggttggttgcttgtgtctttacagtaagcagaattatcaaatcgggagtcatttatggaaatacaaagacttaactatttctcagactgtgtgtgtgtgtgtgtgtgtgtgtattaatctgaatttagacaggatctgtgtcctttctctgtaagttaggaataataagcatacatgaaggagtgtagttcttgtggaggcacctcacgaggctacagtgtctgccattgctcagcattcttcaaatgagctgcatgaccaagttagtaattggacaggttctgagacagctgttcacgttttggtatgcactacatctttagttccagtctacaaaattcttgactgttcccctgggctgatcagcctctggagaacgttatcagcctagaatccttaggtgaaggcatagtttagacagttttaaaaagtgtgggaactgaggctcagtagtctgtgttggaccacagcagaattgtaaggagtatttagagagaatgattatcagaaagctagcttgagtctaagatcatattgaagatgccatgtggaatgccagtgtggttcagattaggtcctgagctccgttcctacttgacatattttgctctttatgtcttctcatgttaccactacacctgccacagagtaacagtagccaccatttcttgaacacttagcacttggttgttcgggagcaaggaaggaatagagcatgatagaatgaggtgaggtctgtgttctggagcttccagtctctggtgagagtgtaggggaggaaagagccacactggcaatgagcagatggggagtttatctggcagagagagcatagagtggacagttaaggatagagatggccagcttcacatttcaaagactaggagttggggaggtactgttcttttaaaggttgtttatctatctatctatctatctatctatctatctatctatctatctatctatctatctatacgtccctctattcatccacctatctaccttcctatctgtctatttttggaaggtgtgtccttccgtccatccatccatccatccgcttgtgttctagtgctttaactgcttgtgtgatgtccgtgcaccgtgtacatgcagtgcctacagaggccagaagagggactcagattcccctagaactgatgtttctaatagatgtgaaccaccatgtgggttctgggaacaaaacctgggtcctttgaaagagtatctagtgctcttaatcgctgatccatctttccagcctgtgagatggtattttatatcccttgctactcagtctggtggctgtggaggcttaacctcttgtaagtaaagcttgagaacttcggagctctttcttaagcattttcactaaacaggactaagctatctgcagaaatgtttgcataatgtattatcttctgctattgtaacaaattcctgagctaataaagaagaaaggcttattttggttcacagtatagagtttcagtccacagtttggtctcactgacttctgcctggtgcaacgacagcatttcacagtggcaccatgtgatggaagaagctggtcacttcctggtgagagaggcagagaaaggtaaaatcaaagcaggtagatatttcacagtctctgtggagagcacgccccccacaaacgtaaacatcctactaggctgcactgctcgaagttagtactgtggtcagggcctgtgggattcactctaactaggtagcacatagtcatatatgttccgataacattttaataattactatgtaataatggaagctgagtctcctagggaagcaaaagaaagagagggcagccttggtttattatttgactaataaaactatgcctgtagtgtacatgcagcgctgtttggtaatgtgtcacttgtctggttacctataatacagatatgctgcctattttatagaaagagtaattgactttccaagaggagaggtaatgggtcccaggtcccatagctgctgacaatggttactgtatgtttgtttccaggaagttaagtgcataactcttatctgtagtaagagaccagagcgtaacctgtctatcataagatgtttgaagtgctgtcatctttgctgcctgagaatattcttgaaaaagcatccagtgttttgtgcatcacaagtgtaaagtcacataaagtcattgtggaggtgcttccgcccctctccgtagtctgcttcctaactctggagactccttgggcttctggcctccatggatcctttggcattctaccagttacttaacaacaacaacaaaaccttcttagaaaaggcatgttttagtctggagtattattattattattaattgttagacaagttctcatatagccaggctggcctccaactcctgatgtagctaaggatgaccttgaactgcttgctgtccctcttgttcctcgggattacccatgtgtgccaccacactttacctggaactgaggatcaaccccggggcctggatgtgtgctcagcaagcagtctgccacctaagccacatcctcaccccttggtctggaatttgcagtagtattgagaggtgttggtgaccttgccactgacagtgtcatttctttgcagcttgaagaagtcctcagctgaactgagaaagatactggccaacggccaggtaggtattgttgcatactaaactccagagtagcactgttgctgtctgtccaaagtgtagccatagtgttgaatgatgaagagtctgcacatttcttcttgtcataaatgaatgcctaagcttaatttgattggcagaacaatctgcagcacgtttttcaacctgagctaatgggttccactcccagcagattgaggcgctgtgcacacagccacactgccatttcagtttaaagaagccaatcagcttggaacaagtcgtcatcccgtcggtggctgacagggccctgggtttggaagtgactgtttctttcattatctctgggggcgaaggagaaaactgtgactttccagccttagcttctcttttgtccagagaccagccttggcttttatggggactgaagccagatcggtcagaccgtgacacatgtgtccctgggcttcagggaaccttggtttgacttgtttattgggccatctgaaactgaatgacccaacccagccagggaaggacaaagaggcctgcgagccactgatttttcactaattttgattcaagtaaatggacacttctgaaatagtatagtacttttaaacattcactggtgaatgaagctacctacaggggctgcagttcctcagtagcaacataaatgcgttttcatgtttgttacagtgaagccctttgatagccttccaggcagcggctgtccattgcgatcaagcctgcctattaggctctattgactgagacatctgtgtcactgcaaataaaagactcttattgattttcttaactgctgttcacttccgtccgtgtttcgaaggctgagatcttaattatctcagatgcttattcagtgccttcgcatgctgacctctccaagcctcgttggcatttcatgaatcaaagacttgtagtgcagcatgtcaagaggacaaagaggggtcctcacgcgtgtcctttaatagcacctgtaacattgcacctaatagacgtgcgccctaaaacaggactcgcggaagaacttctggaagcatggcacacaatcttttgaagagttacaaaaaattgagttgatctggttctgacagtctgtcagtcagtgtgtgtgagctctagttcttaaatgttccacgtacagtggaagagaatctggcatggtgttgattgtgtgtctaattctggtagtctcaaattctgcgataggctgtgcttgctagggatcaaacccagctcctccaacattttgagccggtgctatatcgtcagcctccaactgttagatagcatttaccgacacctgttaccttgaagcaccaaaggtgtgcttaggctgaggtctggctggctcccctgtgcctggttcacactggcagcagtgtgaacaaaagctgggacactgagccaggccgtgtgcagacacatgttcagcctgcttgcattctagttactaattacagtttatggacaagtcacttgggtttctcagctgtaaaatatatttcaaaatagacataaattaagaagttttaactacattattcaacctaggcagtggagaataagtagcctgtcatacagtcttctttcctaaatgaaaaacacttcatgttcactgtgcgcacgcatgcacacaagcacgcacgcaccacatcagcattctgaaatagagccccacaaatatcagagtagtgttatgagggtctctgtagtggagattggcacagcaatggttttgacacttaactattgtttattgctttctcttggggatgtgctaaccccatagtaaacaatgtgacagattttttttctttttaaaagaaagcttatcttgtgtttacttttgctcaaaaataaatcagtaaaataaataaataaataaataaagatgagagacaaggaagggtattgctccctcttaagctttcagaacacctgcttgtcctcggccctcccttggtgctgtggagtaactaagcaagggtgagattgcattgcagtgaagtaccgagggtggcgtgggcatcagtaaatctcacggatgaacactgacaccgtttgctatggaaggtgtaagtcacatttaacgatacttgaacacttgaatgtagttttattttagtggtttaactctcaagcattaataatgatttgccttcccactagcctccacttagatttcataaggaattcatattaatcattaacagaaagggacatgattcttcaagataatcaaatattgacaggttagaaatagctttctgcctgggttcattgatataggttatgtgatataaatatttatttcttttctgtcactcagagtaaatgccaccaattgattcagcattgatagagtgtcaacagttcataagaaacatttgactggcttgtgttttccgattagtctctgctctataaagtgggatttactaaatctccccaattgtctgctcatggagtgtgacgccttctgaaaccattattgcttcgatttgtgaagcaaacgtctcatgctaggactcagttctgtcaggcttttacatataagataggattcattgagcatttttattttaatgatttataagcgatgcatacttattctctttaacacagacagacaataaacaaagaacatattctttgctagtccataattaaattccatttggctgtctccattaatttcattaatatgttaaatcaagaaccacttaaaagttttcctttagtctttggtacagagctgttcttttcttggtagtgctctttggtgggagattccagttctcccgcttaataaataaatcaaaagctatttgggccctgtctttctgagacctctgactcagactcactgcagtatttttagagtatgttttccccgctcagagtccagtgtggcggcgctgtctgtctaatgttgggcctgggtttcaaattgccttggaaagaacccagagggtcaattcagagaattttataaaagagccagtagtcactccacagacctatggcttttacctcagtgtctctaaagtggtttctcttcaggttaacactctgagaagtcatactggccagtccctttcctaccacaccttcgttgtgtctagaccttcagatgcctttagaaaactcctgggagtaacctgggagggtaggaatctgctgtaaaaactatctttaaaaacccagtcagccccagcatagtgcactcttctccattgtgaagcctgaggcagaaatgaagctccaagtgagtcagaactgcagagtccctctttctgtccagacacagccaggcctcagtgctggctgctggccctgctgctttctcggccctgctgctttctcagccctgcttctcttttaagcagaatggaggagtcaccagtcattcctgtttgtggctatgtagtgactgtgactcctgggctcgctcttcctcttccctcatgtctgttattttactactgctttgcattttacagttaaaaccaagaaaatcaattataattaaaaactagcatcttcttcgagttaataaaaaccaatctcacatctgtacagtttgaaaaccatgtgaggtatgtgtgaagagaaatgcatgcatgtacatgcatggcattgtgcatacacatagaagtcaaagatcggctgaactgtccccctctattgctgaccactttattttttgagacagggtctctccctgaaccgaaggtttgctgttttggttagtttgcttgctagcaaactctgaagatgatctccctttgcctcctggccctgagggcacaggtgtgtacctcggtgccccactttatatggatgctgaagatatgaacacaagtccacatgcttacatggcaggcgttttgccaaccagccatttctctagtacttgagctacacgttttgtttttaaattttccttccttagaaataaatgaaatttcctttgaaaattgcctttcggtcagtggtttgcctgtctctgcacaatgactgttggcagtcaatgtccccacactgcaccagagacagagtgttgatgttgaactagagtactgattgacaagttataaagtgacttgggttcaatggcctaaaatgctatagaactaagcttttatgatacttggtcctaactaccctagtcacatgaatccctctgtaggcttaggaatcctgcctccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcagaaatccacctgcctctgcctcctgagtgcggggattaaaggcgtgcaccacccatgcccggtggtattatttatttgggtattactatatagccttggatagcctctaagtcattatgtagacaaggctggcctcaaactcacagtgatccccctgccttttcctccctactcctagtactaaaggagtgccccgccatgcctggcagttttatttatctgactttgtgggtatggctgcatgtctgtatgtacaccatttgcatgcagtccctacagagaccagaaaagagagcatcaggttcttctggacctggaggaacaggtgatcatgggcctcccagtgtgggttttaggaatagaacccatgtcctctgtaagagcagcaagtgttcttaaccactgagccatctctccagccattggtgttttatatttaatattataaaaagaaaaaagaaaaaaaaagaaataccatcaattcattttctgggcaaagacttgtataccttgaaacagcatacatcgtttcatatggatgtcgtcttttaaagaaacacactcttagagcctgtaattcagaaccacctctgtgtttatggtcttgcatagtcttcctcattgtctgggggattccttagtttcatcttaatctttagcactcactcatatacacatgcagcatcaggcttcgcctcccttgacttcccacccacctccctcatgagcctctaagcccctcccctataatatgaccccatttccctaatgaggctgacatgcatgatactggccactcctcttttgtgagtactgctgtgattataaatggtcagagacacccataccttgtcctttgcctatggggaggacctgatcacaactgttagcccagaggctctgtgttataggcctacttcccaactgcccttttatctcagtgctgcaaattcagaatttgtggacttgaccaggtggaattcctctctcctagagatttacttcaagccacagtgagaatgtatcttgttaggcaagttaatggcgcaaattagtttgttggaggcatgtttagattacctagaggaatgctctcagggaattggcttggtggcgggctgtacctgccagtagacactgctgtttatgaacccttcatcaatcagagtgaagcaagcagcaggcctgctggcatagcatctcagctcacttcctgggctgctgttgctaatgctgttggaaaaggtgccatttaagtccagagtaatgtggctttctttccttcatgccacatcttttctacagggtaaaatatcattttattatattagtagtttaaaggtcacggagaacaaagttttcctcaaatagtgaagcagttggcaattgttctgacttgtctgccagcatttttccactgaccttaaatattgcaattagctgattgtaaattgcatcaatcaggtagtacaacaattaaatctggtgctgaattgacccttacacaggagtctgtcgatactcttttaggaactggcaaaatggcttggcaaggaagctgtcgcttttgcttgcaccacacacttaattatcacagtcctctgaagcttcaactgcagaaatgcatagaagaaaactatttcccttgataaatgtagctcttgctttattcagttggtgggagtttagaacagagcagatatttaaagctttaccataataatggtccaaaagcaaactattattttccaagtgatattgaattaaggactccatccattttctgcccaatgcaaggtagtgcaattccctagaaattgatttttttcagggcttcctttccctgagccttagatatgtggaaaagaatacctttattaaacctacttggtgaataaagttggcagttaatttttatgcaactgtaccagtgcctaaagaattactgaatatatcaaatggagtcagattagccttaaaatcatttgataaatgattatttagggagtaccttaaagacttaaaaacattactttgtgggtgcttacacaacttacctgccagatacaattacaaagaagagtggtgttgttggtataagttttgtagaattagaaaacatgatgtcttgtacattaagttacaggagtagcattagttgatattacacacatgctcagtgtgttctctgtaggcctgtgatctgtcatttaccagcataatatgacttctattcagcttttgctatgcactaatttatcctttgcaaagaaaagctctttctactctaaaaaaattataaacattatttagttagtttgttcaatgttaattatagggtcaccagaggagtttttggggannnnnnnnnnnnnnnnnnnnnnnnnnnnnnnnnnnnncacacacagacacacacacacagacacacacacacagacacacacacacagacacacacacacacacacacacacacacacacacacacacacacacacacacacacacacgttagttctgcgccatgctggagaccgctctcctatcagtatctctgacctgacccttctgagctatgttatatcattccattttgacaccttttatcaaactttaatgaaatgacccaggcaaacaaattgtcattaaactttccatcactttgtcccttggtatcgtcttttataaattggacagcaaatgttgtattgatcctctcgttcttgcagctgaacttggaatgacccagcctgcttgttgtttatggcccagagttgctttccttgacatttccatccgcagcatgacaccctttttgtttttctttctttcctgtggagatgaatgaacaagacatacggtatcgagacacccttggtcatggcaacggaggcacagtctacaagtgagtagtcattctgtctaaacttgctgtttacttcgccaagtggtggggacccagggccctcatagcagaggtttacatagcaccaccgcttaggttttatttccacatttgacactggaattctgcaagacagcttcaattttctcgggaattgcctgaaaatgcatttatattgcctttttaatatttctgagtctgcatctctcctgggtgggtggtggctagtccccattagcaggtgtgcctgaagtttaacgtgtgctcgcctttgctctttaaccatcactgattattagttttggaagcttgttctcaccttgtgctggtccctcgcctgctcacagttatgcccagtggatgccaaactttataagtgccattgctgtgccctgtgctgacactgttattaaaacgcttcttcctgttgtgcttcctgccctctcgtgtccccccacccccaacccgagagagtccctacacacactgatgaatatgttaagtgagaaagctctcccaaattccagttgcggcgatcttaccctaaaggactgttcattttcatattaaaaaatgctaagcataaaaaacagctctctcgacagggaagtccctctcacggcagtgcaaagtttaaactacataatgtaatatgtggcacttaatagtctgcagtggtgtatgaaaaatattccactaggaattaacaaatccatcctctgtaagaaagccctcagggtaacagagctttcttccacacacgccagccccacactgcactgggctgtgctttgaccgtagctactgtaatattaaaaataattggggttataaaagaattaatttgtattctgattggatcctcgtaagcccagcacatccttgtgtactgatgctgccttggcatggaactggacatgggatgaagaagtccataagtcgtctgatctagctatctcctcagcctcagtccccaggcgcagcccggctgcgagtcctccccagaacataggtctttgagaactgaagcgggcctccacatcacgtgcacaccctcaatcccaacactcaggagccagaggcaggtgggggtttgtgagttccaggccagcctggtctatataacaagttcctggaaagccagagatgcagtgaaaccctgcctcaccatcaacaaaaacataacaaacaaaccaacaaaacactctttagttatgttggtcagtcctcaggatgctgggtcaagttgattgtctgaggtcagtgtaaacttaatgatgtgttaatggccagcatatgcaacagtgtgtggccatgactcaaaaaaaaataaaataaaataaaaacaataaaacaaaagcaaaagaaaagaatgtatgctcatcttttagattatttttcctatagacagtttaataagataaattgttggtctgaaattaagtcctgccacaattagaatcagagacaaatttgctttggggctagaattgaacctaggtccgagggttcctggaagctgtatcttcagtacagatgttaagaatttaatcatctaaaaaaaattaatcatctgtataattgttataggaaaataaaaaagaagggactctacagggatgtctaagtaacctgcccacctccccaaaggacactttcaatgtgagattacactactgttgttacaaaaatactttaatcatgatgaaatataaaacgtattatcataaccattttctataatttttttaagacagggcttcactgtgtagccctggctgacctgtatcttgttactcagaccaggccagcctggaactcacagagacccacctgcctcatcctctgagtgctgcgattaagaagagcgtgccccacatgcctggctttgtaagcaatttaatgtgtggtatagtggcttttagtgcacttctattcagcaggtgccggcagcccctctgctatctgtagaactctcctactcaatattctgccaaccctcttacgctacaaaactggactagcaatcctcttattgggacaggcatgtccaaggaatatttcaaataccacagacccttttagctgcatgccactctcagcttctcctaagggttcacttagccaccatcgtctgcacttaccgtgactgtcactgagactgccactgttactgttgggacagcatttgcttctggaaagtgagggcagtgtcttgaaggtaaactactttaattagtagatttctcataagaaacttcagggatcctattgcctacacagttctgttatgtgtattttttgttttgaaactgaatctgaccacattggccatggttctaaattccctggtccaagcaagccttttgccttagcttcctgactgtagatgtgtatcactgcagttggttcatatctagttcttaaggagagtgtgaagtggtccatggttgtgcctcacttctgggttttagtgtgcaatgttcttgtaaccctggctttcagtcctccacagagcagagctacagtcatcaagagctgagagtccactttcctgaagtctttaaggaacactgtgcaatgtgctgtggttgggtttctcttacaccaagtttacttttatagtgtttactataaaaattgtgagggttttttttttttttcagaaaaaaaaatgattatgttaggggctatgctacataaactagatgaagaaaatattggaaaatccactcattggtaacaaaactgcctaatgggtctatttaatttttttccattggaagtataataaagctactaagtgcttatcagaagcccagtgtttcggtcttttcgcttcgcttgctgggacattgtaaatctcaagtgatgtggtgcctcacggagctgcagtgtatctcatttaatagttggcacattttcatcttttcagtctggatactttgctcaactggcagtatgtaaactggctgacatctggacctggtggtagtgtggattccgtgccctgtcctgtctgagccattctctgtgttttcctaagcaggtggttttagttggtatttttttgtattactaatttgaatcataaaagaaattgagatttgaagtatagcctaagtgtagcaagaaaacaagtttgggaaaagaatatgggtttgttttcattactcccttaccccaaggcctgtctctgagaaacagtgtttttacagaaaagacagactttatttcctgattcataatgtacttcaaaaattctgtggctatagcaggcagtatgtgctgtagttaagtatgccccatgtgaatcgacaatctgtatatagtttcctacctcagcctttccctttgtagagtggggaaaataatagtacctatcttttcagattgctgcacatttaaatgagatgatccacagaatgccgagcccttggcttgcaccttccatggtggctgctggtaatgatagtactgacagtggacactacttaaaccctcattttctgcccttgggtggccatggggaaacagctataaaactaatctcagaatcatctttggactcagttagcttagagaggtcttcactatgctgcatgttatattttctctaattaatcctacaaataaaacattattatatcatattctgacactgtgcttttctgaatgcttcacagtatttgccgtgtatcacagtttgttttcaggttgtcccagagtggcttatatagtgtgcacctgttgtgccaatggaagtgagccaagccagagctccagcagcggatccttgtctttcttttttcccttctgtgcttttccctaggcagcactgtttctcaaggtcacaccttgtctcttgtgttcctctgtgtcctagcatcctaggagcagcgttatgaactgagtggctaaagtaagaatgagggcaggagcggcgggggctttcaatcaagttctgtaattgcccccttccctgtctctccagcttcagaggttgcttaatacattcagaacatttgcctagaagggggttcccagaccaaggatatctatgcaatgagtagttctcttgtaggtggtaagactttgatgacatagcatctcctgacctagccaactggtccctgtccccttcctttggatggtgtgtgatgttgaaacctgagtggttagcaggcacagtggctctggacacaccctctgctcccagggccactcagggcctgctttggatggagctgctgagcccaggcttcagaagtgcaggatgcacagtcttggggtcacactgggctgcctgttagctaacagttgcccaagtcaccagaggctcatcatttctgggtttttgtttgtctgttttctaatgcaagctctttaggctaagtcttagattgatcatgagttccagtctttaggtattagacatcagtagtgaattttctattccagctccttcctggggcccagcgtatgggtaaactttttagtgatacaataggtagcatatattccacccagatggtgtttaaaggattgaatatttatcattgtttaagatttttacctagagaaaataagaagaagagtaattctcaaagggttggtttctgctgtttcatttattttaagtggtgttcatgaagccctgggctgggaacagtccttgagggaggaacaaagatcatatgagtttcaaagtcttcttttgcccctgtgatatgactataaaaccaactaaaataaatacgtgcttagaagctgggattctaatagatcattatagtaatgtggtttctttattgaaaaacagaatctctgatgggcagttacataaaatacataagttacctaatttaaatgctgtttagtaggcaaaatacttcaaaaccagaggattcctgaaaacatagcagaactggccttgatggtgagagcgcagtcagtgctgagggcactgtcctgatgggcagcaggcatagacacgagtggtctgtggtgacatcgtagtcatctagagtagtggttctccaccggtgggtcgcgaccccttctggaggccgaatgatcctttcacagagtcagtataatttcatatatcagttatcctacatatcagataacatgattcctaacagtagcaaaattacagataggaagtagcaacaaatataattttgtggttgggtatcaccacaacatgaggaactgtgttaagggtcacagcgttaggaagcttgagaaccagtgctgtagagtgtaagttggaggtatctttcccagtatatgcacaatctattatgtctgtataacgctaaaattgcctgcatgcatccattgttgagtgaggcattgaggttcactctgggcgaattgactattactgaaattatttatttagaaccacgtgacaccccagaagctttgacttccactctcgccagccagcctgcacatgtcagacgaaagcagtgaccctgctctttcatattccccccaacctgtatctcgtatattaaaagtagtttttaaatggtcttgatattgacctgagaggcagggggcttgtttgatttatcttgaccttaaatttccaatgaaatgaagagcgttttctttgcagccaagatcatattttaaacaagcaacaagacatcctcctaatgtaaaattaaatacttacatatggctgggttgcgttatggtatcacttggcaagcagggatattaatgttttcagaaaaatcaatgagtatttgtcaaataaaattaattatgtatgtgtcccctcttccctggcagcccttacggttctgggtttgtttcctgcagtcgtgtgcactgtgctgctgagatgctgaagatcagccctgtacctgggcttctcactctatgccttcccaccgtggccccagccctccctctgtacatgcgcccatatccattatggcaatgatagattattggcatctcaccaacatgacagggtgtcacaggtcgctgagcagagactttcagactgtgtttccactcgaattaactattattgaaatagtttattgagattgaagtattgatcttttcccccctctaaatgtagcttaagggaaggaagaggaggcagtggtgtttttgaaagacactaaatttcatttttaaaaatctcatttatttagccttttctttttcctgttttatagcccctatagttttattgcttggaaaagggtatcttggctttatttttatgacagtataattatacttcagaaatgcacttgattactatgggtaacaaaattgttctactatattggtttggccaatattgctatacaaacaacttttcagtcaattgagcctggtaaaaatcaatacattatggtaatatttcaagtaagaagttgctgaatctaaatgttttaacacattctctttcagggaaaaataattctgagatagcaagactttttgtaatattttatgttaatgaaatgctttgtttatggagaaatttaagtccccagcgagggtgtttatgcgcaggtgcaagctttacgttagcagcatccattagcagacttgggagggatgctgctccataggctgcatcaggtgaaatctgactgtgaatccatcctgtagcttaccctcttggcattcttgaggggatttttttctgccattaacttgacaaagacttgagttcaaaggacaaatgtgggcaggtaatacaggcctggcagtgtgcctctgtagactttcatttgttgacctgcaagttcttagcatgcatggtgtcaagtgccccatgtcctaagagccatgagtcctgtccacaggtgacacaggatctcaggctagactgtgtactctgtgtgggcctccagctgtggggtcatgagagacagaccaggaacagcctcatgaaggatctgaaacttggtagagttggcttttactcagtgtagagaaagtaaatggctccatagaagtgactgttgctgcacctggacagtttgctgtgttctaggctaatcgcttgtctccagtatctctctgagttctattctctccctgatgctctgccatcatgtggtcctttctgcaagctatttgtgtctgggtcatcttatagcagtcctcctcacagtgcttggcatggtgccttgtctatacgaatcaccaagagctttcaaaaccaccctgcagaagcagagccttcacacagtggtaatacaaggtggtgaccatggccgggtgctctaggaccacctattgtaagtagagagataaggccattgcccggaactgctgagaaaaagaactatccctcagacctgaatataagctgactgcatagatccctcctgagtctgagagagctaataaagggcctttaagtgtagtactagcaaccataaatatcttatgccagatccatttggttttgctgttaaattttaccctgggttatgtattcatttattcagggaactagcagttactgcctgtcactgtgtgctaagactattgtaaatacatgcagtcaactagcagacaggacagtcacaaagggtccttgaagaagtaggtgccaaagtaggatgatactcgaccatgcagttgttatgaagaatggacaagtgtgccagagaaagatttaactgaggaaatgttagttgagctgagacctgcagatagtcatgagaaaatcagggcgaagaatcttccagaaaaaaggggccactcaaaccaaagctctgcaatgggcacagagatatcacacctaggccagtgtgattggaacagagaactctctgggagagtggacagatggacaggaactggtcacagcaggtctgtagacctggtgaagaggccgtcatggttccctgctattttacaaacgaggaagagcaaggaggggtaaagtggcatgcccgaggctaagagcacaactcaaggtggctcaccctgggcccatgcctggggtgctgcttcccaagccagttccactctgtgccatttattctctgaattttaaattattaatgcaaatgctttattaatgtaaaatagaaactaatgtacgtcaatggtgaactctgtccagtggttaattttagaagctctttagtttcttggcccacagttacgacagcatgactagctgctggtctaccctttgggtctctttatttatccaaaggcatagaatttagtattgaatccctagattaattatttggttgtacaaatggaggtggcacatttcttgactcctaagacatactaaaattttaagtctattttgcagtagttgacatgttagaaaattatagtctctttgttggcatatcgcacaagtaaatatttgtaaactacagccgtctagggcctttacttaaattgcttttttggaaaataattcactggaaagtcccaaaggcatttactgtgtataactttgggccaccttttccctttcttgtgtttggctattttaatgtaagagaccatgttcctgttacatttctgcttttctggctctgttaaacatcttaacatgggattggaggaatagttactaaagtaggcaggtagcagtagagtctgggttataaatattaagcttaaagtgattttgtttgtttgtttgtttgttttagtattaatttgctttttcggtgcaacttagtataatatcctcctgaccataaaatgtccacggcttgcatgacagccaagtatttggtgtttcactcggagcagagtgcatggttttgttttgtgaattcacataataaaatgaaaacagtgttctgacaaaattagaacttgcttctgggcacaatcaatatagcactttaaccagcttttgtatttaggaaatacaaacatgttcactctcaaataccctgactctgttctagcccgtggccacagagagggtagggtgctcagtgagaaaacggaaaggcttgattaaaccataattaagttttgaaacggttagctaagaactctgaataagatatggttttagatgatttcaacaacaaaaagtatagcaaatgaaaccttatggtgtggtcgcaaatgaagcacaatctcagaatgactaccacaacatgtgcaccgagctaaatttgtatacaccacttatttcttcccttttaactttttaaaaaagataattcttagtgaacgtttgcggagcaaggcatctggggtaactgactgaaagggccaatcagaagtgtctcaacagcttatgaagcacaagcgaaacagtccaagggcctcctaccagcctctgtgcccccagggcccacagttagttacaggactttattgtacttcaccaggatgttggaagtggctgagcactgtaaggctccatcctcatttgattgcagacaagctgcaaccctgaggatgcagagcaactcacctctcaaactcagaccttgttattatttcttagtctcttccaagtgcctttccatttaggagcctcaaataagcagagtaggctgaagggtttgtgccagccttttcacggggcaagcactggagttagttattgctatttttttttttttgacttgggctcatgtttcatactgatggcctatgccaagtagacactgtctgccatcctgcctccttcctggaaaactgagctctttgaaggagcagatggagccagtgtcagacctgttgatgttgacctctgacccctagtcatttcatatggttccttgctaattttatctatagtgggtttttgtggttgtgacttggtgagtatttaatctttctctggaatgatgttagtgttttgggttttctgatctttatgaggcagtttgtccatccccaccacatcaccctttccctccttccacatatctggctttgaaaatgtgtgtggccaagttatgctgtgctttcttaaatggattagagactatgaccttcctttgactgatctctgaggactctgtagagcaaaatgttacctagttcttcaaagagaacattctcacgcaatttatatgttgttagaagtcactaaatatacaataaaaaatatgccatgttctcgaaggacggcaacacagagcccgtgctggggggtgggggagcaccctcatcccttcttgcttgtttgaaggtagtataggtctggtggtagtttgtgttcctttttatattaaagtaacaagtttctcctggtttattttgacctggtcatgatgtgtccattccacaaagtctgttatgcacaaaagtgcacaaaatgaagataaagtgcctcgctccagcctgacaaaagccattcctttgcagagtggtagctgcagtggaagtaaataaatgaatggacagcaatcacagcctagttgatggaactgttcaattaaagcacaggcatttacatggtgtaatttccctaaattgccaatgagcccctttagacacaaccagtgttcaaattgatttcagcattgattttggctgaagctgataaatttctgcttgttagttaaagtaattttgcagaagactttgtactgcggtattgaagtgttcatttagctgatggttaaaagaggagttatttacagaggcctgtactgttgttctgagatgggacaattccccaatcatcttttacttttaattttttaggcttcagtataccaatcaataggtgattgaaactgattaaaacttatccaaccagctgcctatggcagtttaattagaagccggttgattcttaaattaaacgtcttgttttcatcgcattgccatcttccagaagagtgagggctaaccgtgctgaaaacctaaaactgggcttcattaagatagctcatgagtgtgaagctgcccgagaatagctcctcgggcaatccaaaacacacacgggctttcggagagcaatgagggatggttttggttttaggtaagatgtagtccgtagtgtggtacagacaaagggccatctgtttgtgacatgtcaccgcacaacagtgggtgctggggctcaggtttaatacacagtaggcttgaaggggccatcagaatagtcagtgagtctctggctctgacacctcagatggagtatttgctattcagttttgaggtctcaagtaaaataactgtggcagggtagtaaacaaggaccttcacattcgcccatgttgacttcccgcaattgtgagcagggttgcaggacggattttagccatcccccacttccctcgcttccccacactcattttatctagtataagacagttcttgggtttgtaatgaaagcgggttgatatttctgtcataagggacatattgcatctggcactacagggaagggaataaatggctcacttttcagaggtgcatttactctttgacccactagggtactatttagtgttctagaagaggtaatttagtaaattgcaccccagtggcctggaaaagttaatgcaaccctgaaaagtgagccattcgatcgatttctcctattgctttttaaaaatcagcaccaaccatatccagggtgcccgggcgactgttggaaaagtgctctagaagcagccagttcacactcatgtagagcttggtctggcttcagagggcccagatccacttcctactctggtgtttatcaaacagaaatgtgaagcttccattcttgactccttgaccgtagactgactgacgaagacacctccctgacagattttcatgcaatagcaaatagcctctctgtataaaaatatttcctaaccaggtttctctctcgtgctccccactcccagctcctagtgccagcagacctggctgctctcagccttggtcagggaagcttagtttccaagtggacagcagataatggagagatgcatgactgaccagagtcctaagaatgagagactggccgagtgctcagcccagacttggactcctatctctcagaacatgggaggagcgacatgaagtgctggcttctgggcctggcatggccattgtgatcgtcactcacagcagctgtggtcactagcacctgatcaagccagcaaaacctctggcctgaatggggcagggtaggcggtctccaggcatactgaggggctactggcaggagcgtgctgctccttctttttggaggatgtattcaccaataggctttagtggtcggcactgcacccaggcacataaaggcagcaaagttaactggactttgtgggttatttaaaacaaaggacatgaagattaaaggtgggaaatgggagtacatatggtcatactcatatatatgtatgatgttctcaaaacaaggaaaacttgaaagattcttaacacacatgttataaaccatacacagctgatggtttggactctgtaaggaactttgagtcgcttctaacccatactcaaggcatgtccaggagagaggtcccgagctggttaaccctcagctgttcctgtttctcccacttgtattgctcagccactcaacctccttctgggcgtgttgtttctcgcctccctgctttgttcattgccttctctcagaacctttgatcgagagttcactgtgacgggagcttccgctatctcaaaggtatttaggccatatattaaaagacattactctagttaatgtggaaagtgttaaaggctggaaggagctgcttcaacttacagaagaaatatggacgcctaaccacattaacttcacaggaggtatgagaggaagagggggcatctcagccaactaaacagaggagccaacatgaagctgtttcccctttctatgactgggtctttttaacccagccaagttgcccgtgtcttagattgggttgatttatgaggcctatatttggtctggtacataagcagctgcagggtgttgcttaactcctttgacagtcggcagtcaggcttctgtagtggacttctaggcagaaggaaggtcggcctggcccatgatttgaagcttctctacagctgcctttgactttggattttgtgttgtaacagccagcacttggctaatgtgtttatctattatggaaggcaacgactgtcagcgtgcatttccctgacagttggattccttttctctccttgtgaatggctgtggctatttcagtgtgtgacagaactcctcaaacttctccagctgactgttactcccctcttccaaagataagatccaagcattaaggcaacattttcattggctgttcccacgagctgttttgcatatggttgcgggagatgtcattgcaattcaaagatgacttaagagagtacacttaataattgactctgaattggctgcttcttaactttctgtgctgctaagaataaagagtttcctaaataaactggattactaaggaatgcactggtttgtcttcctccaatcaaccgttctgtcaattctcctatgttttctctctgagcttaacttctggcatccagccctgagctagtgtgtgtcctgggaggcgctgggactgaggaaaggaaggcagatattcaggatacgcattgcctgaagaacagagaatctgctttattgttctggagagccgcctctgtctctgcagcctgttaacactgcagctggccttgtaatctgtacatatttttaaataagctttttctctttccagtcccccacctgtctgccctctgagacccaggaagcaaaatgagtaccttctcctgcttcctaacgcttccccatttgcttcctgttctctgccaatggccgggggattttcttggtccaggagaaatttccaccaattgatggctatctctaaataattcacaggatgatcctcctgcttttcactaactctgcaggatgctgtgtgagaagcagaactcctgttggtttatgaaagaagcagccccgccctcacagaacagtgacagtacagtcattcaggtgtctcctgtcactgtgacttggtctatgcatgggattactcttgagggctttctccaagacaggaggaaaaaaatcgatgcagaggtgttttcatgctcatttttgttgaatatttgctgattgattgatgtttatagtgtatgtgagtcatgctcaaatacaacgtgttgttatcaggttgtgggtcaccctgtcttaaacttcctctggtcaccagaggagctagatgctctccagaataaatcatctttgcgtatgagttaaagtaactttattggacttacgttcagaaactcacatgcaggaagtgctgtagaactcagatgtctgctttaattgtgtgagcctgcatgggattgagaaacgcatgttcggcttggggctatttattttgtaactagaaatcagctgggacaactcacatttttgtgattcttgtagaatgtgaaattttaagcataaataatttcagtaaacactgtaagatgggtgcgatgcgcacttgcatggcaggccagatgcaggactgtgaacacaggttgcttctccttctgtcctgggggatgcaggacttttcaacattttgttttcaaacttttcttctcctcacttaaagattattggagaattttaaaaaatatcttttatttgtgtgaatgttttgcctgaatgtgtctctgtgtaccacaagtatgcctggtgtctaaagaggccagaagagggtaccaaattccctgaaactggagttacaggcaattttgagtgtcgggaactgaacctgggtcctctggaagagcaggctgtgcttgcagcctctgggccatctctcctgtctgtggtgattattcttaaggtcgatgattctcattggaacttagatgaaggtcagcccacacattgcttcccttctaagctgcactggactctaaagtctgaaagaacaagcaatagaatcattcacactggtccccaagtattgcctttgtggtcagtcacatttcctgtctacttactaagtccttggcattaggagagacatgacaccagcattcatgggctctagggtctgttgtgagcttaccagaagaaccttctcatgtccttggctactattttcccctccctggcctcagtttagataggaagctgatcacctctcacccctacctctgtacctctcagctcaagtcacccttactccttgctggggacatttctcagctaaccctcagtttcaagctcctcatccagcagctactatgctttcttgaagtcagctttctgtttctatctgtaccttctacaatttggagtaaaggccggagacctgagtgtggcctaagtgacatgacagaactcggcttcccactgcccctttggctcatgtctctcacttaacctgctgttcattgtttcacacacatttccaccctgggccttcacacttgctccactgcttggacaaatgatgtatgaagatgtgagtgaggggtgtctggaattaaggcttttatattgtttagagggggatagaaaacagttaactttatactttgctaagtccactctgatttaaaaaaaaaaaaaaaaaaaaaaaaaaaggtctacctgacaagaatgcagtaggcagagtgaaggagaaaggtaaaaacaaatgaagaaagtgtgggagaaatcccaaatatatcagtagttacaacaaactcaaagaaagattgatgctcaatagatgaattagattgaggttttaaaagtataactgtttgctaatttagaagaaccacaaaaccacaatgatatactaaagtttaaagaaaaagccgggaaacgacatcggacaaaagcagtagtgccaacaaaaccttctctcttaaaagcttgtacattgatgtataacaaacttaaaagaaaaataattagtacgcataaggagggactcctatatgatgctgtaagaaaaacagactgacttagcaacaataagccaatatgtaattaataacataattttaaaatacatggagcaaaatcttatacagttacccagaacatttgataaacccacacagtgggagaatgtctcaacaatcaacaattgatcaatcagataaaattagtctttgaaagatttttaaattttttttattcatgcttattttattcgtgtttaagtgtgactgcttgtctatacaagtactacatgaatgcagttgcctgaggaggccggaagagtgtgtcatcccctggagctggagtggcatgaggttgcaatccacccagtgagggtgctgggaaccgaacccaggacctctggcagagcagggagcactcacccactgaatcctcctgccagcctcatatggaagatcttaacatcacaggcagagtgtgcacctttctacctcaaaagacctggcttaaaagtggatcttcccacttctaatgatttaattaagaaaaaaaataatccctcacaggtttctcatattcaaacattggcatctggctattattccttgtgccatcccagatgtctatgctgtgtgttcagttttgcaggggactagtccccaaaggccaagtggagcacacagggagaagagctaagaaacgcctcatacaaatgcttcctcccgtctctctttggaacaggtaattactgtggcaacaacaaactaatttgaagcgttagctgttaattaaaacattgcagaggtgtgtagttgtcttttggtgtaaccagagcctccattcagcctccattaatcactttacagttaatgtgctgaggaaggtcaagacaattgagaaagaaagtaaacaaactctttctccaggtaggatgctgttcacagagttgaggagttggcttggcttgggctgcttctgcctttgtcatccatttctccctgatgattaaatgtgaaatcggctctgtccccagactgtaaacccagccacaaggcatctttattgcttgaaatgggacccaaacttttcatgggtgaattagcctgcgtcataattaaatcatcaactctcccttttaattcacttggaaatgggagacctttcttttgggaaagagatcagctttcttgacaagctaattaagttgccaaactgcccagtgaggtatatgtatgttgggctctctgctaatcatgcttttattgctgcagctggtctcagaagtccatgtgtcacttatgttcaaagtatgacactgcccttcccacggcttccaatcatttgtctttatactttagtccttgtctcatgttctaatactcagggtttcaaacagttgaaataggaagtatctatggtctactggttgaaataatgttattatttaatcttatccattgaattatttatatttgcatggaaagggcatctaaattcttcacatatattttaaagaacacattccaacaacttctaaagccactggaggaaattggtctctaccagtgtgctgcaaagtttgaatatatcacaaaacaaactatgacctgatgtgtagctttccattaatgtagcttttaataaaagtcatatttacatagatggtaaataataatttcttgtaaaaaccaggataatatatgggctccatttgtaaaatgttgtatccttttatacgaagcctgaaagatttcatttattttttaaaagtgtgtgtgtgtttatttgtgtgtatatatgtatgtatgtaggtgtgtgtatgtgtgtatatatatgtatgtatgtgaatatatgtgtgtgtgtatgttcgtctattcgcccagttttgattgtagattcataactaaaccatttctataaatcagttgatttcaaaacatttgttggtgctagatatggtgtgcatatctccagtcttgttaatatttcttaacctaggttatgacctatttcagtgtagctgggtgtcttaattacttttctaatgctgtggaaagggccaaggcagctttaaaaagaaagtgattttaggcaattaaagtttatgatggtggagcaaaggtatggtggtaggagagcttacttacattctgatctacaagttgggaatagagcaagagagacactgggaatccttaaagccagcccccagtgacacacttcttccaacaaggccatgtcttctaatccttcccaaatagtttcaccaactaaaaacattgaaacatgttagcctaaaggcaggctttgggggaggaggggnnnnnnnnnnnnnnnnnnnntgttgggggaattctcattcaaacaccactcggtgcctaattctctaaggaaaagatgagccacatgctaaaacctcattggtgtatgtcttacatccgtcaatgttttattatagtaaagccgtagtcagagctcatcctggattggtgattattgatgaaatacagtaatatgatttctctttctgtgtaccttaagaaaagcaaaacccttccttttgctgcacatacacaactatagacacacatacagtgatataacagaggatctagggtcagaaaacctgatctagtttgaaggtttagttctgccgctgtgtagttgggcatcgagcaaactgcttaaattcctcatgctgcagagctgtctttaaaggaggataataatagcagtgtgaggtggggttttttttgtttgttttttttgttgttgttttttgttttttgagacaggatatctctgtgtagccctggctgtcctgggactcactctgtagaccaggctggccttgaacttagaaatctgcctgcctctgccttccaagtgctaggatgaaaggcatgtgccaccactgcccagctagcagtgtgacttttgagcagtattttaagattcataatcacttgataaaccttgtttagctccacagaaatagacattgctagcatgggccatttgccttgaaggtctatccccctttgggccagaagtgtttgggttcacaatatgtccttagccactctctaggttatctaatgacagcaagtaactttgtgtctttttctttttcctatagagcacatcatgtcccaagtgggaaaattttagctgtaaaggtaagcattgggtatattttatgcaagtttgtatgtgtgagtctgtgtgtgagtgtgggtgggtggtccatgccgcatatatacatggaaatcagcggaaagtgctgggtggcctgttttttcactctctaccttattcccatgagacacagagtttcttactgagtctggagctaggctgatcctccagtctcctcctcccacagtgctggacttagcgaagcaggcagccatggctggtattggagatgtgtgcatcaggtgctgctgcctgccgggccatctcctcagctctgtgttgtaagattcttggtgctcactgattttctttctcctctcaactatgtcactggtgcacaaccacactttgcagcagtaggctatttgctgaaacgtggccagaccctcttgcagtctggcagtgatctactttacagacacgtgctctgctcctgcctgccagctagtgacttcttgtcatgcctctgggcctttagtaatggaaggttttagtttttgaatagctgctgtgtgccaggtatcacactacatgttttgaacagtcatatttaatccttaaaactatgaggtaattctcaccaattttagatttgaaggaagagggactcctgggggctgatttgtgcaaggtcatttggaagaggcaaggttaggatgttcaccttacctgataaagctaatgtctaccagtgctttgtagcttgtgtacagtgactgctgttcaaccctctcttgtccactcagcctcacagttcatctctgagatgcctttgtaacgccatctacagtgagaaattggtttctttccctaatgtttcagtttgtatttctgtgccttatattttaaagaaattaagaatttgcataatggttgttctttttttattgaagttaaactagaaccgaggctcaaatcttcggaattctagtgcgttccatggtttctttctgatctcagaccgaggccagcaactccatcgtatatggcatcatgaggtctactcttaataacagatagcctgtatgaggaggtctagcagagttctctgaggatgcaaattatatccacacaggtgcagcttgggaggcaccattgggatcctcataggcctcacgttttgtacaggaggaagtgggtccagagagatcctagagtgctcactgtaggactaagctgtattccagtcttccctctgtgaacccaccttgatccatgttctgtgtctctcttgagctccctttgataagagatcacccactaagtgagcagtgttttcctgtctgcccagttatttgttcctttcatgccagaagtcttagattatgatagtgttgatatatttaaaaacactcaaatcttcagttatgccaagagagagagtgtgtgtcactacaaatgaatcatagcccttggccttgcaaatagaacataaaattttcataattccatacattttaagttgtgcttaggataggctaatattaagattcttagccatgattatttaactgggtgtggcaaaggaccagcagctctttctggaaaagagttaaagtttacttgataaaaatagctgttagatttttactacatgagaactggtggggtttacaaataagccattctccagactggacctttaaactgggctttctagcaagaactgtattgtgtcttcaaactgagtcaaatggtggctgatttttgtgtatagacttgatcttgataaccaaaacaaaaatcatgtagatcatacaccagtacaatattggcggaaaagtaccatttcttcaaaacagccagaatggtaaattagttattagaattttattatttagtttttaattatttggaaattttctaagtatttttcagttattgacttctatttaattccactgcagtctaagaacatactatatgattggaattattttaaattaatttggctcaaatatggtctttgttggtgaaattttcctgtgcccataaaataatatataatccaaagatatgaaagtgtggtgtaaaactttgttagataaaattggcttttagtttttatatctttcatatctgattttttttctacatgttccatcaattaccaaacaggaatgttaaaatctccaacacttagaccttggtctggttgttttttttacatttctgtcactctctgtcatcgtttttgaagatgtactgttagttttggtaaggtttttatcatttggaagaattggcctctttatagtaatgtggtgactattttgttcacaacagtctgtgctctgaaatccatagtggttcattattaatctagctacagcagctagctgtttactaatattggccttttactttgaacctagtatgtctctatattggaaatgagtttcttgtagacagtatatagttgggtcttaatttaaactctagtctgatctttgctttttaatttggctgttggaaccatttacattttatgtgatatgatatggttatatctcttgttctgtgtgttgttttccgtttgttctggttgtgtacccattctccctccactgtttctaaggattgtctagagtttatagcgcccatcattagtctatcatataaaatccttacaataagagctgtgctagtcagtgttctattgctgtgaggagacaccagacccaaagcaactcttatcaaaggaagcatttaattggtggcttgcttacagtttccaaaggtttccaaagttctgaaggaacaagtctccacgatcatcacagactgtggggatctagactgtctgggcttttcttctgaattttgaagatctggtttcattgctggctttttattttccagccaggtgctggctgtcctttgtgttcattgctgctccatgcgtctgccctgacatctcagagttctttctttgttacaggtggtggttatagtttacagtatatggttatgctgggcttggctgtgatgcttttttttattattattattcaatatgcttgaggtttgtttgttgaaaatcttgaatatgtgggattttagccttcatcaaatttggagcactttaacctttcatcagatcatgcttccacatgggaactttgcttgccttgttggcttcacttctcagtctttccctgtcttagttttggatagtacctgttccttccatgtcttcacagatcttttctcctctttggctaatgtgccattcctcctacctactgtggtttttcatttataatgttctttttatccctaaaagtgtaggtaggcttttttgctttaagaacaattttcatgttgttatttgatgtgctcaaccttttttctactttctagagtacatataataattattacaactgtgctgggtagttttatgtcatcttgacagaaagaagcttaagtcatccaagaggagggatcttcaactgataaaatgcatccataaaagtgagctgtgggcaactttgtatggcaatttcttaatttatgattaatggggtacagtccagcccactgtgagtggggccatctctggtctggtggtcttgggttctacaaaaaagtaggctgagcaaatcatgggaagcaagtcagtaaggagcaggcccctctatggcctctgcatcagctcctgcctccaggttccttccctgcttgagttactgtcctgttttcctccagtgatatggaggtgtaagccaaagaagccctttcttccccagattgcttttggtcatggtgttttgtgatagcacagtaaccctgaccaggacagacaagccagccagtagacatacctagtagctgtcatgtaccttatttctgggttacttccagtgcatttttttcctcttcattttgggttgtatttcttttttataggacattgataatatagcatgggtaggtagatttgcattcctatattcttaaagtgttctgagatgttagcaactttgaaacaatccaattttttaaagacttacttttgaactttgcttaaagggccaacctagcagtcagcctgcagtgaatttccccattctgctgaggtgggactcttgctctccaatgatggagggaacacaggccgcggggttagggttgcttcctccggttctctcctcctatcctgggtaacctccagcttctacagtgaatcactctactgtagactctgatgtctgtcacactccctctggtgccctgccagctgacactggcacccttggactcttctgccccaggctctgtcttctcagcataaggagactgagttcagcctgctttctctccctgtacagggaccagaagactctgtttagtcagtgaactgagcagcctaagattggtctttatcaccagtctctagatgtagtgttgctctggctactgcccagtacctggagacctattgagggttgtgtgtgtgtgtgtgtgtgtgtgtgtgtgtgtgtgtgtgtgtgttggtttgttgtcttgtgaattttgtttgttattttgttgagacgggactcaccatgtatccctgatttgtgtataactttctgtgtggactgagctggcttcaaattcatagggatctgcctgcctctgctttgtttcctttcctttttgtaagaccgttggccagcttctgaatggttctctcagtaaagacaagctgcaatttactgatgatttatgctgctgtatattatatatatatatatatgcatatatatatatttattttagacttttgctactgctcctgcttttcatttagcagatgcagaacctgagacagcacagttagacaacttacccaagtttctgcacctagaaagctagagaccagcatgtaaaacctgcctttgctcatctatacccctagattagcttcccaaaagcatagttccctcttaaaaaatattaaaaggcccatgtcacttctgtcctggttgcttctgcactggttactattctcacagctatgagaagatgccctacaggagcagataaagggaggacggttctctttgctccacagttgagtgtctagccatcatggcagcaggagtggaagagagatggaaactgccattctcttccttttctctcttatatttggttcaggaccccagccctggagtgatgatgcctactgtagggtgggtcctgccaactcagttaacccagtctgacgccctcacagatacaccaaaggtttatgtcctgggtgattctggacctgtgagattagcaatcaccatcaagcgtcacatggcccagacaaactaaacacactccacaatgcattagcagtctgctgctgcttctgtagcatgttcttacatttcctggtctctgtgcactttgttctgttttacttgaacttgtcaccttgtctgaacctggtttgttgttggaattttttttttcaacaagttaattcatgtgcacctctctaattagaatgccttcatctgtgtcttcaactgttagaatcttagcagccttcaagggcctgctctttggttctggataagccctgtcgcatgtgttgtatgtgccagtcacctcttgggattctctgcatgtgattcctaaaggcagtcatgtgccatcttgcacatagctgttagtttcatgtccatttcctctaacgtatcaaaatctctttaaaacggagaacagaactgaccactttcttgccttacctacagtgcccaacgctaaatgcagtgtcttaatacataatttactgattgaaaacagttttgttgttgttgtttaattcattcatttatcttttgaagtaacattctgaaaataggtttaacagcatacaaaattcccttaatggcctttgtatggaccgttacttgcccccggaatatttctttgcttcctttgttattttaaagggtgaaatggaaggttaagactcagaagtgcatttgatcttttcctgaccctctcttgacttttgtgtgacttgaagcatgtcacttgaacctctcagtgaccccagttgcctggtgtcacagggggaccgtgcagagcagcaaatcttagtccttgtctgagcagattcacctgcagggccctgctgccagcctagagccaagggggatctcattctgcaaggcagtggtctattggaccacactgaggctgtctgggggccggtttggtgagagccctactcatagctttcccaatttttatacattcccgactgaggcctctttttcacagacaaacaacacattgctgctcttcttttctctgatctgagatacgataagagaactttacaagtttttgtttttaaaaggaagatcattttaggaaaaatagaaatgtgtctataccatgcaatctagaaaattttctgcttcacacagcacatttagaaaattatgctaaccacatgttagatactgtctgataatcacctgcacacttgctagctcggatttgaccagcttttgtttgtttggtataggtagcaagaccattgcaaataagtagagcagaaaacaaacacaaatactgctagccatctagaagcagaacctctctcttccattactgcctctgtaaaatctttccagtagtaaagctcagggaatttactggactccccaggattgttttctgattggaaaagaatccatctagcgggatttcttagctgtgtatgtagcatgcattgagtatcattcctggagtgctttggatttctgcagcttttaaagcagcatttaaatggaccatttgattaatcatttgtatcctggctgtaatcctcccaaatttcctttctgagttgtacatactgtaaaagacaattatgtctccacagattaaataagtgaattaaaacagaatagtggcttaatttgacctgtgattttgttctccttgcctttagtagagcgcatgccactccagcaaataaatgaagtcatccatgacagctcgtgatgaattgccgtatttatactgtatattttaatagtctcacactaatttaaattgagcacagagtaaattataattcagtcacttgactgcttgtatttaacttgacagcgcatccttgcgcgtcctgtccgggagatgtagcagagagagagagagcggtgagaatgcaggcagggacctccatcctggctgaacccttcctcccagagctgcttccagctccttctcttcattccctcttaagcacttggctcagcctgaggagagaagattcaggcagtccacactgtgctggagcttcaaagggaaaaatccacactcgctgtaattttctccctagctttcagaggaagaattggtctggtttatttttagcatttttaaagctcactggcaggaatgcccgggggaagggagtttacctctcacgaaatgccaagctcccagaaaacagagctcgtgcacatgcgctgtgacagcatggagtggtcttcctctctggaatttgtagaaatgacctgatttgcttttcgggggttatggactcccagtgctctggactacagcaagtctcgagagatccaaaccaatcagaccagtgggtgagcctcacgaattcatcagtcctagtcgagttttggttagtgtggcactttggtttgttttggtgtttgcatctttggtttttggtttagtggcagacatcacacgatccatttcccttggataacagcacatctggaatactgcttgtaaggaacactttaatcaggtccatctcagtgactgggtgctgctctgaggctttgtcctgggtgctaaggagtcatggctactcaaaccctgccttgccctggccattctggcagcttttaggagatgctggggcattaaagccagttgtggtaaagatgaataagggtcaagtcagagatgaattctgaggtaggtgtctggaggtggtgaagcattcaagctgggtctaaaaggtcaaaccagctttcataatcagtgactgtggagtggaaggaggaaacatgtgcacggccgctagggtgggccggaaggcagctgtgtaggaaggatgagaggagggttagcaggaactccagagttgcagcttactccacatcatgggaactcaagcaaggttcttgttcaagggacagataaggtctcggaaattgccatcaactccaaagcgttggctagccatgtgcagccttagccttacttcttacttacgtgactgctaccattagaaagagggatattagaatagtcattttctttccttgtggtttacataactcccgttttttgctttattcagtataatgatacatggtccccgtctgagatcggaactgtaactcagcactgtaaggtgtggattgactgctgtagcagtcctgacggttaggctttactcagaagtgtttacaatcaaactctgctacagttcttaaggattcttctccacctattttatgttcttactgccttttacaaatatattttttaaaggttttttaaaacgtggtttcactgaagtacttagtcgttgagccggatggggttctgactctttggtagggtactcttggtacctgcactcgtgagaaggttccagatcagtccccagtgcacacagctgcctaagggaagcggaaagtctttgaattaaactcgagcctgccctgggcaagagcgttaagttcatatacttggacatttctgtgttataaaatccaccttggtggcagatacttaaggaaaaccacaacccgtcaggaggtcctggctaagcgtgggagtcaggtgacgtgaggacctctccagctctcaagtctgtcagcatttataaagaaacattacccacatgggaggaagtaaggtgacagggtttttaaactcccatttcttttatttctgaaaatcccattttaaaatgttcttttatttaccatcccctctgcttatctccgagtgcctgctcacagggctctgctcttttaatgatcttcttctgaaaatagccggtgtggctcaaatagggcacataaattgagtgttataacttaactgacttttaaagccattaatgctgacctctgagacctggctccttccagggttccatcaatcacctctgtaccgcctcctccagcgcagaggcttagcttcagagacagctttttttttttttttttttttttggtgctggggttatggggatgctgcataaagaaagcacggtatttctttagttcttgtatctcacgtgctatgtaacttaaggtagacgaatgtgttgacgctgctgtgtctcttcaggttattctgttagacattacactggagcttcagaagcagatcatgtctgagctggaaatcctttataaggtatttttttcttggtcacttttatctatgtaaatgcacatggtgtcagcatctaggtgttaaactacttttgtcttatttttgttacagtgtgactcatcgtatatcataggattttacggggcatttttcgtagaaaacaggatttcaatttgtacagaattcatggatggtgagttgttccctttaaactacattaaaaatgattttttgaatcgattgacgtaaatgtagtcttgacacagatgtccattccactttggagtgagtggcatgtgttaacaactgccttctttacactggcagttctcttctgttagggttcctgctattagatatttgtagcttgagtgtaataacaagaatgcaagttaatctccttttactaaaaatttgcactcgggtccagtcggcgcgaggtccctgctgcctctgtgcagcctgcctttgctgggaacagatgctctgttcttttaatgtttcagtcaccaaaacagattttcttctaaagaaatctattaacccaatgtcctgtgtctttcagaaagaaataggttcttaattgctagacaagaaattgtttttcaacacagctgtttagccgagctgcgtttggctctgtttggacgtcaggcctgtcctcctctgcttctcattcatggccatcagcagcactcccttgatctgaatattgtgacaggatatagagctctggaaatcctctcactgaaatgtcattgttactctttttttaatgtattgtaaatttggacacgttcccaccttttacaaggtcagtttcagtatctagcctccattaaaatgtagcatatgtgcctttctactttcttaggtacatgcacacacaaaacagacataccatacacatacatacataccacacatgtgcaccactcacacaagaaatataccaccatacatacatacacacactacacatacatacatacatacatacatacatacacaaatgcatacacgtttttacttctttatgtatacacaccatgcagccacatatacacacacaccacacatattctacacaatacactccccacacacatcacacatatacataccatacacatgcatcatctatatacactacacacatgcacactcacacataggcacacctttcaacttctttaggtaaacacatatataccacacacataaacatacacagttacaccatacatatacacacaccataaacacacacaggtacacacacacaaacacatacccttgataaccacataggtagtgtaatggacaccggttaggaagcatgggtttgtaatcccagtacagctcactcttgtgaacgtgcatcctttgagatctgtataacttcagttacattaaaacactttttattaagatagaattaagatactataaaactcacccttttgaagcatacaacttaccattgttgtctaatttcaaaacatttctaaagagaaatccctagccacattaagtgacttaatctcatccccctccctctacccgctggcagtcattggtttcctctctggatgtcatgctgcacatcagtggagtcctgtagtcgacagcctttgtgcctggtggctcatgctcagaacagtttccaagttcatgcgtaaccgcagcagtagcacccaccacccctcacgtcactagcagtagtttattgagtggctatacaacatttgcttgtttttcttcagttgatggtcacttgggaaatttccacttcttccttttacatctaaaagatgtttaattttattgtgtgtatatgaatgcatgcacacataggtgtgcatgtgtgctactgcctgcctggaaggccagaggacagctttaggagttgactctccttccaccaagtgcccccagggatcaattcaggtgatccagttcgctgggagtgaggtgtcaggtgatccagctcgctgggagtgaggtgtcaggtgatccagctcgctgggagtgaggtgtcaggtcctgtggcaactcttaatttttgaggaagtgtcaatctgttctagtctgtcagtgctcaaatcatttgcagttactgtaagtactaaagaaatactgcaacgcaacgagaaaaacaccagtcactctttaaaaaaaaaacagacaatagattggttatgaatttctcaaagaaagacacaatggtcaacagccacatgaaaatacttatcaacagtggttgtcaaggaaacctaaatcaaaaacacatacatattcatacctgagaccacatacacacaaaacaaaatcaaccacataataagtgtagacaaaggcacagagaagttagaatcctcagacaatgttggtgtgaaactgaaatggtgtaaaatagattagaacagcctgacacttcttcacaatttccacagaaccaagtgagtccactgctacagaaacccaagacaactggctagcacatgcacattgtagcctgctgctgtgtttatagcagctcacaagtgaccaagatggctcagtaaatagaggggcttgctctttatagcatctttcttctgccttcttagggtattggtccctgtgccagtttcagtacactacat

SEQ ID NO: 1500 - DNA, 2259 bp, Mus musculus
ccacctccgctgccgggacgcgggcctcagtcggacgatcctgcacgcgccgcgccctccggttccggctgcggtccgggacccgccccttgaccccgcggccctgggcccccctgcctggttggagggcaggcgccaccggtgcacctccgaaacagccccgacccagcccgcggcgcccggccaccgtccccttgcccaccgagacactcaggacggcaggaccctggccactgtacctgccttaaaccaggccgttgctccgctgtctcctcttactcacaaggactacagaatgcttgtgggttctgttttgtccacttttgtaactccaggaccttccgctctctactaattcctcttggccggtcccccaacagtgcatcctctcctagggacactccacacgacctgggcctggttttgggcctgcaagctccctcctgatcgctcctcttcacttctccccatcttcttgctccctatttatcgcctgccttctgtctatcgttccccttgtcacttcttggggctcctcctaagtaggggcaggtcggtaccccttcgccccaggatgtgagaccctttaacctgtaatgctgtggctggcccttggccccttctgtgccatggagaaccaggtgctggtgattcggatcaagattccaaatagtggcgcggtggactggaccgtgcactccgggccgcagttactcttcagggatgttctggatgtgataggccaggttctgcctgaagcgacgacgacagcgtttgaatatgaagatgaagatggtgataggattacagtaagaagcgatgaagagatgaaggcaatgctgtcctactattattccacagtaatggaacagcaagtaaatggccagctaatagagccgctgcagatatttccaagagcctgcaagcctcccggggaacggaacatacatggcctgaaggtgaatacacgggctgggccatctcaacacaccagccctgtggtctcagattcgcttccaagcaatagcttgaagaagtcctcagctgaactgagaaagatactggccaacggccagatgaatgaacaagacatacggtatcgagacacccttggtcatggcaacggaggcacagtctacaaagcacatcatgtcccaagtgggaaaattttagctgtaaaggttattctgttagacattacactggagcttcagaagcagatcatgtctgagctggaaatcctttataagtgtgactcatcgtatatcataggattttacggggcatttttcgtagaaaacaggatttcaatttgtacagaattcatggatggggggtctttggatgtatataggaaaattccagagcacgtccttggaagaattgcagttgcagttgttaaaggccttacctatctgtggagtttaaagattttacacagagatgtgaagccctccaacatgcttgtaaacacaggcggacaggtcaagctgtgtgactttggcgtgagcacacagctggtgaattctatagccaagacgtatgttggaacaaatgcttacatggcaccagaaagaatttcaggagagcagtatgggatccattctgacgtgtggagcttaggaatctctttcatggagcttgctcttgggaggtttccatatcctcagattcagaaaaaccagggatctttaatgcctctccagcttctgcagtgcattgttgatgaggattcgccggtccttccgcttggagagttctcggagccgtttgtacatttcatcactcagtgcatgaggaagcagcccaaggagagaccggcgcctgaggagctgatgggtcacccattcatcgtgcagttcaatgatggaaactccactgtggtgtccatgtgggtgtgccgagctctagaggagaggcggagccagcagggacccccgtgagacctcagcaggacactgaccactgaggaccagtcatcatgacacagcaagccgtgacccctctgtctgctgtactggcccagcctcctgctcgcacctcctgccctacctaggaagccctccagagggccagcctctgctgagcgggggaagtgggcactgactacagcaggtggagatggtgcagggcggggtgatgaggttataaaactatggaacctcctctggccccacccccttatctttccctactgttcattgtaaagggtcaggccctatcagcagcactgatgggaataaaagtattattgctttg

SEQ ID NO: 1501 - DNA, 1347 bp, Mus musculus
atgctgtggctggcccttggccccttctgtgccatggagaaccaggtgctggtgattcggatcaagattccaaatagtggcgcggtggactggaccgtgcactccgggccgcagttactcttcagggatgttctggatgtgataggccaggttctgcctgaagcgacgacgacagcgtttgaatatgaagatgaagatggtgataggattacagtaagaagcgatgaagagatgaaggcaatgctgtcctactattattccacagtaatggaacagcaagtaaatggccagctaatagagccgctgcagatatttccaagagcctgcaagcctcccggggaacggaacatacatggcctgaaggtgaatacacgggctgggccatctcaacacaccagccctgtggtctcagattcgcttccaagcaatagcttgaagaagtcctcagctgaactgagaaagatactggccaacggccagatgaatgaacaagacatacggtatcgagacacccttggtcatggcaacggaggcacagtctacaaagcacatcatgtcccaagtgggaaaattttagctgtaaaggttattctgttagacattacactggagcttcagaagcagatcatgtctgagctggaaatcctttataagtgtgactcatcgtatatcataggattttacggggcatttttcgtagaaaacaggatttcaatttgtacagaattcatggatggggggtctttggatgtatataggaaaattccagagcacgtccttggaagaattgcagttgcagttgttaaaggccttacctatctgtggagtttaaagattttacacagagatgtgaagccctccaacatgcttgtaaacacaggcggacaggtcaagctgtgtgactttggcgtgagcacacagctggtgaattctatagccaagacgtatgttggaacaaatgcttacatggcaccagaaagaatttcaggagagcagtatgggatccattctgacgtgtggagcttaggaatctctttcatggagcttgctcttgggaggtttccatatcctcagattcagaaaaaccagggatctttaatgcctctccagcttctgcagtgcattgttgatgaggattcgccggtccttccgcttggagagttctcggagccgtttgtacatttcatcactcagtgcatgaggaagcagcccaaggagagaccggcgcctgaggagctgatgggtcacccattcatcgtgcagttcaatgatggaaactccactgtggtgtccatgtgggtgtgccgagctctagaggagaggcggagccagcagggacccccgtga

SEQ ID NO: 1502 - DNA, 96587 bp, Homo sapiens
  misc_feature (9475)..(9958): "n" at positions 9475 thru 9958  can be any base
  misc_feature (58300)..(58319): "n" at positions 58300 thru 58319  can be any base
  misc_feature (91094)..(91113): "n" at positions 91094 thru 91113  can be any base
ccattatattattaatttatcttcgatgatatttatagtatcaatttaaaagctgtaaaacttcatgaaaagtagcttaaacaaggattttgataaacaaaagctttcagttttaaaagcaaatcatggaaacaacttcttaaagaagatttgaagtttttgttgttgctgttgatagaattatgaaccttataaactcagtattttttagttaacctaaatacataaatctatttgaattcatcttatgaaaagagatatgtcactagatatatgatcattatatgctttagtgattcatggaccttgttacatccatgctttgtaatgtatgaattatttagcaagaaaaatcacaataattttgttgttactcaaaaatttatgggttagcagaaacaattacgcagcccctgaagctggtatgttaaggtaacatcattaacactacgtagtataatttttttagtacttatttgacataacctttactgcttctgcaagaatatatcagtaattttataacaatctgtctgtaaacagaacattgaatttattaaccacaaagtgattcattttactctattttcatattagttcataatttaaaatcagacttaaaaagttgtctactcaaaccctaacggaagaataaaaatatacaaaataaaaaattaatactctagcaaatagatataaatgtaaaactccacttaaagtggatatttttatttcagaagatatagatgtgtaagaacgagatgaaaatagatacctttgttacctttttacacattgtatcaagacccttgctatgagatgaccaccaaaattttagtttcttatgttttcaaatctctaaatttacaaaatgaaggaagcaagaatttgaaagtttgaataaaaatctagtgtcacttaattttagatcacatttcaaaatcaacagtcatttattcatccaagaaatacttttgccttgacggtgttgaaggcacttgtcaatgttcccttgacagtgtggaaatcctagtaactttccctgccaacaaaatctagcagttctaaatctatttacagagtccattcaagccatactgaaaagactgctgtccacaactgggtgagaaccatgtgttatgaagttttctttccagcacttgtcatataataaaggctcaatgtttaataaatatgtgatgattcaaaattaaaaggaaaacttgcctttgtttttaatagctttttaaaaaacaggatactttaattggagatcatatggattctttacaagaacagcaataagttttgaaatattatctcagatgtaatgaattaactatgtatgctgaaagataagagattgtaatcttgttgaatttccttttgaggtatttcaaatggtgccacctgttttctcatacaataattttgctattttaaaatcaaatttagaatgatgtgtagaagtaaatgaagtgaaacatgaaacagaaagtcctagaatcagttagacttactcttttaaaacagaactagaagtaatgtgttagtaactagaagacaaaaagagtgttttaatcctcagaaaatggaatgggttacctcctgagacagtgagtcttctgttgttggagctgttcagaagctacatgtcaattccttagtgagatgggtagggggcgggtaaaattcttgaatgggaaggggattagattggtgattttttaagtcccctttaactcagaaattttataatcattgctgcatgtctatgtctggttcccaaccatgctatttagtttggtacttaccgcttttccagtatatgtggaatacaaagaaccctgctttgaagagaaaagatatggtttcagttcttgctctaccactgctggtagagtaactttgagaaaacttagagctttctaagtcttaatgtcttcatatatacaataagaaatgtatctaacacttacacagcatttacttgtgccaggtcctcatctaaggacctggcacatatgaactcacttaatcctctcataacgaccccatgaattaggtacggtttttatgtttatttttcagttgtggaaaccaaagggtcttgcccaaggccacgcatggtaagtgttcttcccatctgtctacagagtccacattctcagcctctcctctacacttgtcgtaagatgcacaagataattttgtcagacaatggatgcggaagtgctttgttattatgattaggactacatataaagaaagtaatatagataagtttaaacaacaagaagagagaaaaaataaagtttaagtgatttgtaggaacaccagtctactctactgaaagaaaaacgtgcggccgggcgcagtggctcacgcctgtaatcccaacactttgggaggccgaggtgggcggattacgaggttaggagatcgagaccatcctggctaacacggtgaaaccccgtctctactaaaaaatacaaaaaaattagctgggcatggtggtgacgggcgcctgtagtcccagctacttgggaggctgaggcaggagaatggcgtgaacccgggaggcagagcttgcagtgagcctagatcccgccactgcacgccagcctgggcgacagagcaagactccatctcaaaaaaaaaaaaaagaagaagaagaaagaaaaatgtgttatgtagaaattatgtctaataaaattttaaattaataaattaattcattttagagtatttaaaatccataggcttagcatatagtggtggtccatgaatgacctgtggaactgtaatttctgcctctgtgtgagtgtactttcatttccattcctgccgaaacagaacagggcaactctcctgttacacttttgggagtttgtgttcattttttgtctgtctcttcatagcctttaaaaaaaattaaaagggctgggggcagtggctgactcctgtaatcccagcactttgggaggccgaggcaggcagatcacttgaagtcaggagttccagaccagcctggccaatatggtaaaaacccatctctactaaaaatacaaaaattagccagacgtgatggtgtatgcctgtaatcccagctactcaggaggctgaggcacaagaatcacttgaacctgtgagccggaggttgcagtgagcggagattgtgccactgcattccatcttggatgacagagtgagactccatctcaaaattaatagatatcacgcaacatgagaataattatgttattgtttgttattgctattatacattattttttccaatcaaaatttcaaagacattgctggtgtgtagaagggcaacttttttttttttttgagacagggtgtcactctgtcacccaggctggagtgcagtagtgcaatcatagctcaccgtaaccttgacctcccaggctcaggcagtcctcccacctcaccctcctgagtagctgagactacaggcatgtgccaccatgcctgggtaatttttgttttttttgtagagacagggtttcaccatgttgcccaggctggtctcgaacctctaggcttaagcgattggtctgcctcggcctcccaaagtgctgggattacaggtgtgagtcactgcacctggcctatattcttttaaatcaagattaatcgacatatattggagtgtcatctgcaagggcccatactgggtgctgaaggagacaggtgaatttcctctttttttttttttttttttgagatgtagtctcgctctgttgcccaggctggagtgcagtggcatgatttcggcttactgcaatgtccgcctcccgggttcaagtgattctcatgcctcagcctcccgagtagctgggactacagttgcatgccaccacgcctggcaaattttttgtatttttagtagagatggggttttaccatgttagccaggatggtttcgatctcctgaccttgtgatccacctgccttgccctcccaaagtgctgggattacaggcgtgagccaccatgaccggccaggtgaatttcttaaacataggaggcaatcaatattttaaataaaatgtactgtttaatgggagtctataattgttactgtggcagtcttggtagtggtggtggtggaaaggcaagggggcaagtgattgatgttcaaggcaggcaggggatgcaacatgcaatggaagttgcattcctattactcaacctactctgcgttcaaaactccctgttcagtcagcaaatattattaaagtgcccactacgttccagatactctcttaggtactagggatatggaagtgaataaaacacacaatttcatcccttcatgagtaaaacatgtggtatgttaaatagtgataaatgggcagggtgtagtggttcacgcctgtaatcccagcactttgagagacatgcagatcacttgagcccaggaattcaagaccaacttggccaacatggtgaaaccccgtctctactaagaatacaaaaaaaacaaaaatagctgggcatggtggtgcacgcctgtggtcctagctactcagggagttgaggtaggaggatcgcttgagcccaggtggtggaggttgcattgagctgagatcacaccactgcactccagcctgggtgacagagccagaccctgtctcaaaaacagaaagaaaaaaaaaatagcaataagtgccaggagaaaaacactagggaagaggattaggaattgtgcatgccttcatgcttgtatctatgggtttgaggatggcctgcaatctcaataatgtgccaagggagagcctcagcaagaaggtgacctttgagtcaagacctacagaatgtgaggtaatgacccatgcagatatctaggttaagagcaatccaagcagaggaaatggcaaatgcaaaggccctgaggtgggatgcgggacatgttcaaggcacagtgaggaggaggctggtaggagtgagggagattagtaggaaatgaagtttgagagtttagatgggatgaggggcagaatgtgtagagttttgtaggccaagaaaaggattttggcctttttcctgcacaagataagaagctgtttggagagttttagtcaaacaagtgacttgatctaactgtggcaactgggtagataatactgttggtagtaggggcaagggcgaaaacagaagatgaaagaatagtttggactggggtagtagcagtgaaggtggtgagaaaggctcagattctggattaaggattcgatactgggatcagggtaataagagatgaaagaaaacctctctgaatttataacagcaaaatgtaatttttctccttaaaaaaataaatcacaacaacaaaataaccctattaaaatgggcaaaaaaaaaaaaaaaaagccaggtgcggtggcttatgcctgtaatcccagcactttgggaggccgaggtgggcagatcgcctgaggtcaggagttcgagaccagcttggccaacatggtgaaaccccatctttactaaaaatacaaaaattagctgggtgtggtagtgcacgtctgtagtcccagctactcgagaggctgagggaggagaatcccttgaacctgggaggcggacgttgcagtgagctgagattgtgcctctgtactccagtttgggagatagagcaagactctgtctcaaaaataaataaataaatacacaaaatgggcaaaaaacttcaataggtatttctccaaagaagatatacaaatgagcaacaagaataggtaaagatgttcaacatcactaatcattagagaaatacaaattaaaactacagtaagatatcacattatacccaacaggatagctactataaacaaatatagaaaataaccagtggtggtgaaaacatggagaaattggaactcttatgcacttttggtgagaatgtaaaatggtacagccactctggaaaacagtatggtgattcctcaaaaaattaaacatagaaaatatgatccagcaattccacttttgagtatacatcccaaaaagtcgaaaggagagacaggaacagatatttgtacccccatgttcatatcagcattattcacaatagccaaaaggtggaaacaacttaaatgttcattgatagatgaatggatacacacaatgtgttatatacacacaacagaattttgttcagctttgaaaaggaaggaaatggccaggggtggtggctcatgcctgtaaccccagcactttgggaggccaaggtgggtggatcacctgaggtcaggagttcgagaccaatctggccaacatggtgaaaccctgtctctactaaaaatacaaaaattagccttgtgtggtggtgggcacctgtaatcccagctacttgggaggctgaagtgggagaattgcttgaacccaggaggtggagcctagatcatgccactgcactccagtgttgatgacacagcaagagtacatcttaaaaaaaaaaaaaaagtaaggaaatgctgacacatgttacaacatgatggaccctgaaggcattataccaagtgaaataagccagtcacaaaaaggcagatactggatgattctatttatatgaggtatctagagtagtcaaattcatagaaatagaaagttgattggtggttgccaggggctggagggaaggggaagtgggcagttgtttaatgaatatagagtttcagttttgcaagatgaaaatctggagattggctgtacaacaggatgaatgaatgtatgtaacactactgatctgcacacttcaaaatgagtacaatggtaaattttatgtgtattttatcacaaggaaaaaaatcactagacatctaacttttcagtaatgtgtctattttcagttaaatttgccagttaactgaagccaatataggccagttttcatattccttagtgttatcacactggtgcacttactgttttaccattttcccttctgatttcatttttctgttagcatttactactatctaacatatattttactcatttgtctgtgttccccatcagaatataacttcatgaggggagggattttctattacacttagtgaaaagtaaatccctcaagtaggaacactacaagtaagcacagttttttttttacagtaagtttgcttaatggctagtaaactatctcagccagtacctgagtgactattctgacttgtatcatttaacaagaaaaaaggcctggcgcgctgtctcacgcctgtattcctagcactttgggaggccgagacgggtggatcacttgaggtcaggagttccagaccagcctggccaacatggtgaaacctcgtctctactaaaagtacaacaattagctgggcgtggtggcacatacctatagtcctagttacttgggaggctgaggcaggagaatcgcttgaactgggaggtggaggttgcaatgagccgagactgcgccagtgcactacagtctgggtgacagagtaagactccgtctcaaaataaataaataaaataaaataaaatgaaaaaaagtactaaatgcaaacttcttaagatcacatgcaacttcgatgttaaatactaaatattccttaaatttagacagtattcaatttggtaaagatcagaaagttatattttgtcatttatgatatcaagtggaatgtattatcagtgattatgatgcttctcgcaatgagagttataactttctggaaaaatccttgctcaaatcatcaaagttaagatttcttactacataaaggctatgaagagctgacgtgtaattatattggctctgcaaatattggaacagaaatatgagtttgccattagtgtaagaaaagcttcagaatatgtatgcaaatttggcaaattgagttggttttccccacggtacttcgaataaaagagacattttaacaaatcacaggttcatagaaaatctctagtttcgtggtctattttctaaaataataggaaatgaacttttaataaaagtacatgaggacttttgatgaacggtttatttttcacagaagtgaagtgcaggtgaaaaggggaaattcctagaatatctgaaggatctgactaaatgaatttctacctaagctattgatttacagtaacttaaaatgtgataatttatctcctacaatggcctttcaaattaaatataaaagtaactcagagtaaagtatgcagaaaaaattttggtattgtaactgaaaatgaccaacattaatttttttctctcacattaatcaagcaccttactgttagaagggaaactgacaagcctcctcaaccgagtttatacaaaattcaaccccagaaagtaaagccaattcgtgcaccttcataagaaagaaataaaggacgaacctacacattacaatttgtaaagaaacttctgtagaggcaccatcgttctacaaccttatgcactttaaaatctgaggtaacaaggcatttgaagataaccaaggttggccgggcgcggtggctcacacctgtaatccccccagcactttgggaggctgaggtgggcggatcacgaggtcaggagtttgagaccagcctggccaacatagtgaaacccagtctctactgaaaatacaaaaatgagcgggcacggatggcgcacgcctgtagtcccagttactcggcaggggttgggggctggtgggggtggtagtgctgaggcaggagaatcgcttgaatccgggaggctgaggttgtggtgagtagaggtcgcgccgttgcactccagcctgggcgacggagcgagactccgtctcaaaaaaaaaaaaaaaaaagataaccaaggtttattgctacttccgtgatatcaccatatcaccaactgcgtaagcagtgctatttagttgaaaatacatggactagaccgaatatttctgcaacagtttaataagagacgatgatgcgactactgcagctgtccccaggcaattaaactcttcggcgaatttctttactattgcttttgaacagggaactgtttgctattttagggcactcgtgcggtaaagaacttcactgaaaaatgcaaatatgttttgctaatgtgggagaaagatgatgatcctctgaacctgtgacttggaaggggggataaaaaagaactatttcttgaattctcgccttgctcttgctgattcgatgcacacaaccccacgaacattcagattcatggcttgacaaagtggggataaccgggagctgcagccccgtctttgaagcttttgtaaagacaaacggtctgcaatgttaagccttaaattggcttttggcggactccagccttttacccttcgtttggtagatgttttcacctcgctgtcattaagcagggtcaggaaatggaagggccgtgaccgggtcgccgcgggcgctctgtgggcgatgagggtctcctgagcgagcaagaccagtctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctgcctcctcatacccacacggcggcagagaccttcaccatagcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggtgagtggtaatctcagtgtccggatgccagcaagggggactcagggacttgagtagtcagcaccttgaccactggtgacctgagccagtggcaatggctactgctggcttcctgtggaggcagttttattgcttcaggcacagcattgataaattgcaaccactaaaacctggcaaatgtctaggaccctggggagatagatcaatctgactgaacccctgccctcagagagctcatggcccgggctgggacacacatatagacacaaccacgcaaatgcaaactgctgaatctagaagagaggttttttccccccaagtgtttcggggaatgtccttggacagattccagccttgtttttctactgagttctctgaacttggtgaccagctgagaaagggaaaaaggacaactttaacttaccatgtttgagcacactgtttcattaatttattttgagacagggcctcactctgtcgctcaggctgcagtgctgtggcacgatctcggctcactgcagcctctgcctcctgggctcaagcgattctcctacctcagcctcccaagtagctggcacatgccatcacacctggataatttttgtatcttgtagagacgaggtattgccatgttgcccaggctggtcttgaactcctgcgatttgcttgcctcggccttcccaaagtgctgagattacaggtgtgagttactgtgcccagcctgagcaaacttaaagcatcattgaatgtaagacattttacttagaaaaaaatgctaaccatgacagtatgacacatcatccgttattaaaatgagtccagtttcagagacggtaaaagtaagggaaaatgtgcatcttagaattggtgatattttacattcagatttttcagaatatatttcaaataaaatgatggaattttagagcagagtgtaacactgtaggtggcctgttcagctgatgtttcttttttgcagatagttactgaggagcagtgaggtgaaatggcttttccaaagctgtgagctcctgagtgggagagtcagtaccagaactaaaattttgtttcattgacttagtaggtttctttccctacatgttgcagccgcttctaatctttctggtattcatttgagatagacagggtgccttgtgcccattctacatgcagaataactgaggcatggaagacagaagcggacattccgaaaagcacatcactacctgcaagttaagagtgggcaaggtggcaggatcttgggaagaggaagatttgtgatgtgatttttcattgtcttgggtaacttaatcaaaatttgatttctataacttcattttgagttctagatgttactgactgcccaggccatgcagatttttgggtgccttgaccaggagctttccatattgtgcatcaaatgccatccttctctttgtatccggagttctccacacagtcatgcacatacagatttcccctcatgataaggcccaggctccttcatgtggtcctctgggcacatctggattggcccctgtctgcctggcacctgtgtcatctctcttcacggccccataaacttctgtgcctcacttacataggttgattttcatttctcccaggtgtccaggctgtctgcactctgctcttcaccggtcaattcccacctgtccttccaagccaagttgtgctttttctctgtgtcattcttggttatgtgccccacctctgtgtcgtcacagctttgtgtgggtcccccagcaaagcacatgtttgatcatgattctttgtctcctccactagatggtaaacttctggaggagatagatatgtttgtttttgtttcttcataggaccccaaaatacttgtttaagaagggagcttaaaagaggatgcatgcaattatggttctgtggacagaacactaggtttagagtcaaggaatttgggtttaattgcaagctgtcccactgactaggcaagtcagtctacctctctgagccttagtttccttatttgtaaaacagggaaacttgtaccttcctcaaagacttggaaagattatgtgagattgtgactgtgatgagaaagatgggttttctcttactcatttaaaacaatggaaggttgattattatgtgattatattatttggttatgtgattatttcaagaatagcccagtgtttaagaccacaaactctggagccaggttgtttaacttgcaagttgtactactggggcaagtatcttctgtatctcagtttctttatttgtgaaaaaaaagttggggaggggtgaaagtaatgcctacctcctagagttctgaggactccttgagttgatacatgtaaagcactcagaacaacttagcacatagtaagcgctccattagtgttgttattattgatgggattgttattataagggattggacttgggtcttctgtttcttgagcatctctaagttgtacctggctcaaggctgactggcttaacaggaaacacgagtggccccaccactagagctcagcatgccaggtgtctgcacacttttggctaggtaagcccaggtggagcatgttttgtcagaaaggcctgacgaaggacctgtggcagtgggtgttcagtgctatctcctagtgctccattttagcaaatgttcaagcccagatcatggcagactcctgtgatctgttctccaggtttacttcatctcttcatcaagaaaaggcaagaaccaagagacacgtcagcatctctggcttggaaccttaaactttaaagtcacgtggaacctggaagaatcccctcatctaattcagactcatttcgaatgaagaggcatgaaccccacagggggaaaataccttgctaaagccacccagctaatttttggcagaacctgacacagatgccagaagcaggttgtagtcaccgagtcagccataactgagtgtctcggacctgaagtcagcagttgagggctccagtcactgtgcatcaaatagctgggagaccctgggcaagtcagtcggtctctctgggccttgtcttttgtctgaatcatcagggactggctgaactatggaggctgacctgaccctcaaaggtagagacatttgggtcttctgttttgcagctttctgtgtttctctttttccctggagactgagttcctagttttgggaaaactatacaagaggtctggttagtgtgtgatgagagagaatgcccaaccctctcccctcttctttttgtattctgtggtctccaagctcagatttcccctcatctataagacttctgggccaggagtggtggcttaggcctgtaatgccaacactttgggaggccgaggtgggtagatcgcttaaactcaggagttcgagaccagcctgggcaacatggcaaaaccccatctctacaaaaaatgcaaaaattagtgggggcttggtgacactcacctgtggtcccagctattagggaggctgaggtgggagaatctcttgaacctagaggtcgaggctatagggagctgtgattgcaccactgcactctagcttgggtcacagagcgagaccctatctcaaaaaagaagaaaacacacacacacacacacacacacacacacacacacacacacagatttctgtctaaactgagtctgtgattttttcctttctcctgagttaccaaatactattggctgtttatgtcttttgtttggtgcttatactcttaagtgttttatattactagtctttcaggtttgtctttatctctgtaaccagtttataatcttcctaaagtcaaggatcaagttttattgtcctgtagcctacagctttgtgatctttatgctcgtggcatgttgtagatgctcaatgatgttttggatctgtcagatatttgtctgatttattgaaaggaagaagaaaagtatcaaaaaatggtcatcatcaaaatatgtaaacttcggttttcttttttcttttttttttttttttttgagacagagtctcgctttgttgcccaggctggaatgcagtggcgtgatctcggctcactgcaacctctgcctcccaggttcaggtgattctcctgctttagcctcctgagcagctgggattacagatacacaccacacatccagctaattttgttgtatttttagtagagacagggtttcaccatgttggccaggctggtcttgaactcctgacctcaagtgatccacccacttcggccccccgaagtgctgggattataggtgtgagccactgcgcccatcccggttttcttttgaaaccttctttaggttagttaggtacatgttatattgtcaagagcagaagaaggccgcttggaaataagtcactttagctggaaaatgtatataaaatcatcaaatgtaccctgctttaaaatgactagtagatattactgatgtttaaacttcttacctctttgtcattatgattgccccactttatttgctttaaagaacaaaatggttggttgtgttcacatgattctctcactcaagtttgctttgttctttctcccttttcctcgtatcaggtgaggagcatgtgcagtgccttgtttatgtcgatgggctaaggcatgccattgccactgagcaggttttcagttggttgttagaactctgcactttgatggggtctgctattcctaagtaggaaggagcctaaattaatttgctaacactatagaggtacagttcacatctcaagatcggagtttcctggaaataactggtgataacctagacttagagagttggggatgaagcagttgttttcccctcgtttttttaaacctacactggctagaatgagtgttcaataagtactgctgaaggatgaagtcagtgagtgaatcaccatcctccactgattgtagggtgctggaatttcaaagtttattacgaagtaagctttgtaatactccagttattggtgttttgttttatttatttgacactaatatggcacttgccatgtgctagacactcttctgagtactttacaaatactaactcatttgttaggtacagctaagatctgatattacacatgaggaaagtgaggcacagagagattttgtgcactcagctgtgccagagagctagcatccagctgtagctgtttggctgcaatttcatgttttcaggctttccactggattgcctgtgtgctttattctgtactccctttacagtttcctgtcaataaatactttctaactatgagagtgtagaaataattttttaacactaaaatcttttatagatgcttcctcaaaaagttgatgtttcatttgtgaggactagactcagaaaaaaaaatctcttttggctgtaatgagcaaggactgcctaagatagtcctctttgatcagttttatatgcacagatttatttttgaaaaaaaaaaaaagcactatagaggcaagactattatgcaaattgccactgcagcaaaagcttctaaagaattgcctttagaaggaagttgcagccactctgctaagtgccctgcttggaaaggctgtgggctccctgctgagaaatactgcgagcggctttgtcagccggctgcctggtgccagttctgctgcagcctgggagggacactgtggcagagctcctggagagaaatgaggtttgcaggccattggagttggactggacatgatggagggtcactttccccagagcgtaggtgttctatgcttattcaattaagctgtctcagtatactaattttcatgtgttttcaactttatagatttatttaagcattgatgtcagattatataccctttttagatttttgttgtaggctagattaactttatttcggtgtcattaagtatgttttctgttgcttaagagtaaaggttgataagaactgtttgtgttaaatgtggcataatgggtttatatcgtcatggaaacttgggtgtcgaactcctaccatgatgagtgcgaggcacagtgttgcttgttgtatatcaggaactacatttgttgaatgtcttcaatgtgctaggtctaagtttatgtttattagattaatttttaagctacatctataagtattaccagacccattttggagggtaatcaaattgaagctcagagaggttaggtgatttttttcccagagattcagacctacgtcagtctgactctcaaaacccctctctctttcaactgtagtatattccacagcctcccatagaagaaaccaagtttttgtaaatacatgacggtttatttgtatatagactgttgaactgagaataaaatatgttattaataaaatgtggaaaagtttccttaaatatttttcttcctggaatagagctttaaactctgggtttacgttgctgggctaagtgtgattatgagctaatgtttttatagtttatgctaacgtttcaaaaatctttcccaggttctcatatttcctgtaggatttgccacatgttagcaataaagaagatggctaattgtgtttctttattctttctttgtttaggatgtgataggccaggttctgcctgaagcaacaactacagcatttgaatgtaagtctggcttgtatactttcttgactattcctttctgcagtcattttttaaagggtttatgggtggcattactttagaaactgacaaaaacagattatttatgaccatcatatggtacatttaaatatttataaattgatataagtttaatgatgatactgaactgagtaatattttcttatttaatcatatcttgggtgagcatatttctacaatatagctttaattaccagcatgacctttatctgctcttgctcctgattgtgataatattgcaggacaaaatgaaacgtgtaaactacctgtaggccagtgattattgattaagagattttaatccattgctgctttaaaacatagcaacaaagtagagcttttaccatgagcattacatggaataattctgttttagtggggcttagcagggatgctagatggtgacaggaacacttcaggtctttagtccttcctttttccccacagttggcctggggacagggccagggtgacctggggactagaaaactgttttgtcatgaaccaggtcattgcagaggacatcatggaatgagtcatgctacgatgagatagtcagtagcataagggcccggatgctgagagggatgaagtaagaactgtagttttttttttttaagatgagggctacttttttcttttctttttcttttttctttttttttttgccgcagactctcactgtgttgcccaggctggagggcagtggtgcgatcttagctcactgcaacctctgcctcctgggttcaagcagttctcatgcctcagcctcctgagtagttgagattacaggtgtgcaccaccatgcccaagtaatctttgtatttttagtagagacagggttttgccatgttggccaggctggtcttgaactcctgacctcaagtgatccacccacctcagcctcccaaagtgctgggattataagtgtgagccactgcacctggccagagggtcacttcttaatgtagaaaaatttcagtttttccacaataggatacttttttgtttctgttttttatgaagatggttacttacagagaatacaatgagtacttcctttttggaggataattaggcatttcttatcaacatataaaatgtgcaaaacctttgacttagcagatccactgtcaggaagcagttcaacagaaatagctacacatttgttgaatgcccatcaaacaaagtgttcattgtgagatcatgatgataattattgttatttttagagacaggatcttgccttggtgcctagactggaatgctgtggcatgatagctcactgtaaccttgaactcctgggcttacacaatcctcccacctcagcctcccaagtaactgggactacacgcatgcaccactatgcttggctaatttttaaattttatgtggagatggggtcttgctatgttgtccaggctagtcttgaactccttgcctcaagtgagcctcctgccttgacctccctaagtgttgggattatagatgtcagccactgtgcctggcccactgtgggattatttatttattttggagatagggtctcactcttttgcccaagctggagtgcagtagtgagatcacagcttgctgtagccttgacctcctggctcaggcttgtgggattattttcaatagcaaaaaattagaggtaaactaaatgcctattataatggattaataaattactatttgtctataattcaaagcattcaacagtgactaaaaagaatgagttaggattttttacatttgtacggaaagatatctgtgaaatattgttgaataaacaaataatgcatatagtatgatcccattttgtaaaatatccaaccacgcttccccaactttatgtgtgtattgaaagataggatctgaagagtgcctactacagtactttccagtgacttaccctgtaaagtggacttggggcctgaggcttgggttggtgggggcgggagggggtggatgaatgatcacactttttactttgtatgtttctctattgtttgaacatttttcaacaatcattgcctgtttttaaaagctataatgagtagaactcaatgtaattagtattttattagtcacattgaactctgtactatagaaaaatagtacatctgtctgaaatacatactagtgttgcaagctttattcagactctttgcagtaactccttgcaggttccacgggtttcatggacagtctgatagttaacattcggagtacttactgttgacagatgctttgctaagagcattccatgggttatcttatttcttttaaccatcacaagatccccacgaagtactcgttatttttttgagacagagtattgctctgttgcccaggctggagtgcagtgacatgatgatagctcactgcagccttaaactcctgggctcaagtgatcttcctgcctcagcctcccgagtagctgggactacaggcacccacctccacacctagctaattaaaaaaatttttttgtagaaacggggtcttgctgtgttgctcaggctggtcttgaactcctggcctcaagtgatagtcccatcttggcctttcaaagtgctgggattacaggtgtgagccactgtacccacgaagtacttaaaaggacattattagctctgttttttggttgaggaaaggaaatctttaagcaacttgctgaaagtctctcagctgttaagtggtaaagtggaatttctggagtagtttccagagtgtatattctcaaccactgtactggacttgttttgagagttgtcataattattgaaatcatatattctggttgttcttaagcatggtaaaaagaagtttactttgtactttttacttgcttttcggatccccaaagtggcttgatgtgcctgtgcctgcctcattggcttccagttagggttcataataataataatactgattattttaactatcattcattgatagcttgctctgtgccaggcagtgtactagatgacttgcctaagttgttagtaatctttatactgagtctgtgaaataggaaaattatacctgtgaggaaacgaagcttagaggcctgaaatgattgctgaatgtgattgcttggaacggtgaagcccaggttcaaacacacatctttttgactataaaacttgcactctttatccccaagtgtgtcaaaagcctgttaagtgtaaatatagataaacctctactactccaggtttacgttctgtgatatcatgctctttcttttgccccatcaatggcagcagctctgtgcccatcttcatgtgggccagttttaaatgaaaaacaataaatacaaaacatacccacagacaaaataatgacagttcttagttgttttgtgtttggattatcatgtactttccactatagacttgaaatcctaggctggcttttttcatgattattttgtggtgacttttttttctgaaccagaaatccgaaccaataaatggaatctatgtttaagaaatagttgaggccgggcgtggtggctcacgcctgtaatcccagcactttgggaggccgaggcaggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccatctcaaaaaaaaaaaaaaaaaaaaaaaagaaatagttgagaagatatagcttataaggaattttggaaatatttcagtggcttatgggtataatggaacaacccttgaataaatacaactttaataaaagaaatacttatagtaatacatttttggtttttttgaaatggtctggctctgtcacccaggctggagagtgcagtggtgcgatctcagctcactgcaacctctgcctcccagactcaagcaatcctcccacctcagcctcctgagtagctgggactacaggtgcatgccactacactggctaacttttgtatattttgtagagatgggctttggccatgttgcccaacctggtcttgaactcctgggctcaagcaatccatgctcctcagcctctcaaagtgttgggattacaggtgtgagccaccgcacctggccttatagtaatacatttaatactgaaaatatacctaacactaattgatatcttatataaaagaaatggtgttatagttagtgatatgaattaagcaacaagagatagggtagctgtcaaatgtacctgttttgtataaatgtagagaaaaagagttgagtgagtggaaaagaggggaaaggtcaggtaatgttacagattctccagttctgagaaatggcgtctcttcaatgaaacctccggtgattccagatggcattaatctctctgcacctttactagagcagggaaccccttcaacctgccttctggtgtgtgtgtgcatgttaacttccctcattacattttgagtcacttagtgataggtacgatgttttattccactctttctctcttcttagtaatgagcttgctgccttagaggaacacacttgttgaatgagtggaacgttatgtgtgtccatattcaaatgaaaattataaaatgtatatggtctaaatctaaatgagtaatttgcgtttttggattatttgtgttatagcctgagcatgggatataattggttggtggtggacagttcaggcctccaaatcaaattcccacatttgactgacccaagggggtcaaacctgaggagctgtattctttctgatttctttttctgggtgtggtgtttccaaggggagttagggctggatgaggagagggacatctgtctgcagaactcaccttttgggctgatggtcctaaaccttgttttcttattaaaaggacctcttttaggtccttattctccattacatctagagctcacagttctacaggctgtacaagcatggcactagcatctgcttgcattctgctgaggaagcttttacttatggcagaaagtgaaggggcagcaggcgtgtcacatggcgagagagagtggaggaggtgccaggctccttcaaccaaccagtttctcacatgaaccaacagagtgagaacccactaccatagagagggcactgagtcattcatgggggatccacccccacgacaaaaacacctccttccaggccccgcctgcaacattggggatcactttggaggggacaaatattcaaaccatatcattgtggaaataaatttgtaagataaattcttagagttggaactactgagacaaagaatacccatatttaaatttcaatatctattactgtgtttgctcaccaaaaggtagaaccaatctacactcacaccaacaaggtatgagaaggcccatttccctccaaccccatcaactctggatattagcaaaccttttagtcaatgtcagtttgataggtgaaaatattactgtgttactgttttattttatattttttaaattgtaaatgagcttgaatatcttctcatttgtatttggctatttgtatttaatttccttttttttttttgagacgcagtctcactctgtcgcccaggctggagtgcagtggtgtgatctcggctcactgcaacctccacctcaggggttcaagcgattctcctgcctcagcctcccaagtagctaggactacaggcatgcgccaccacacccggctaatttttttgtatttttagtagatacggggtttcaccatgttgaccagactggtctcaaactcctgacctcaggtgatctgcctgtctcagcctcccaaaatgctaggattacaggcatgagccaccgtacctggccagctatttgtatttcatttctataaactatttgtcgtctttgcctgtttttctatttggttatttatctttttctaattgatttaagggttttccaatattaaggttggccctttgtcttgtgtgttacaaatgtttttgttcagcttattgctcttttcggtttgttctggtcttcttattctctcttcttttttccgtggagaagtttaaaatttttacatggtcaaacttacttattttcctttgtaacttctgggtttatgtcatgcttagaaaggtcttctacagtccaggatattgaagaaacattcattgatattcttttttccttctactttaatgaggttagacacacacacacagttatttatataaatttgtatgtgtcgtattgtgggtttttataaaaagcatgtatttttattacaaagttcagaatttgtttatttttctttttcttttctttcttttttttttttttgagatggagtcttgctctgtcgcctaggctggagtgcaatggcatgatctcagctcactgcaacctccgccccctggattcaagtgattcttctgcctcagcctccctagtagctgggattacaggtgcccaccaccatgcccagctaatttttctattttttagtagagacagggtttcaccatgttggtcaggctggtctcgaactcctgacctcaggtaatccacctgcctcggcctcccaaagtgctggcattacaggtatgagccactgctcccagcccttgtttttcttaattcttgcaccatcttcagtttattttggtgaaataaatcaggtggggatccaactttatttttcaagcagatagttgattccacaccagttatggaatagtttttcttttcccagatgtgagaacctttctgagatgaaggtaaattccataaccataaaaaatcctgtgtgtttgcatttctgggtcctacatatgctgtaagagcttgacattcatataggcccagagacccctgctgattttcacagtttcattagcagattaatgagtacaccaacacatgaggtgataaaaatcaaccgtgcccactaatgcatttcctgtgcatatctgttacttgtgttcctctgccagcattttctctagagaagtaactgctataaaatgactgttggattggtgttcgtggacagtaaaatctcactggtgacttgaaacatgcattttaagtccatgtagacaaatgctgtcttaaacctataaaaaccatgtggtttcacttttctattacactcatgtattctaatctgtagctctcagaagtatcttcacacttgtcaaaccgtgtgtctgagtttggttcagaaaacatggttatagaataaatatttattgaatttgtgcctttcttcaaccccattttatactctctccttattgcacagaatcattttcagctgttttatgaactgctggaagattattttgtatttagggtggaaatctttaaaccaacacattatgtctcattttaaatttggcatagtatgaccatttaaagctaaattgcaattctggaagttgtaaattctcagagtataggaaacaactatagctgataactggagtgacacctgtaggagatactcttgtgttcagctagccatgacaatcttgttaagaatagttgggtgggagcctctttttgcttcagagaagagtctaaatcataaaatatttggaagaaatgaagtttcatttccttaaactattgtatatgtaaaaatataaagggtcatttttaagtaaaactaggtaagttagtgaaaaatggtcacaataaacctacactgagcctgaaaattatttaacatgtaagagttaattatgcatcctagaatttggggcaaaataagagagctttaatttgttgaaattttggctggaaatattactgatgcaaaaagtccaaatcccttttagtcttatgagagtagtcatttcttattaatagtcttgctaatttgtatgaaaattaagaagtttgagtcctttactcaagcaccagactagttgttccttaaggtcagtggacagtgcagcttatttttgaatccctaccataatggtacctggcacgtaataggcactctatgtgtgtttctggaatgcatggatggttgaagagtgaagtaataaggataagctttctatatcccattcatcagcaagtcctgttggctctatcttcaaatttatccagcatgtgatgacttcttaaaacctcagcttggtttaggccaccatcatctctcaccgggattaggacagtggcctccaaactggtctccctgttctacttttgcctctatacagcctcttttccacatggcagccagagtgattcttttagaagtcaggtgacaccaccacgctcacaaccctccagtgatttccatctcactccaaagtaaaagaccaagtccttaaaatgccctccaaggctctgcattttcgcatctggcctcaacctgtcccaccattgtttctctgaacccgtgtgtttctccccaaacctctcattctgttctagccactctggcttcctttcggtctgtcaaacatgccaggcattcctctgacccagggcctttgtattagctgctgcctctgcctggaacagtctttccccagatatcagcaaggcccactccctcacctccttcagtctctttccactagagtgtatgttccatgaaggcaggattttgtttgttttttcttttttcactgttactgtcccagtgcccagaacagtgcccaccacatagtgggtacttttatttgctggaaggaggaagaaagcaaagaagtaaggaaggaatcaggaagagggaagcaagaagctaaattaaaactcatggatatgaagatgtggccatggaaagtacggcctctggtcctgcccacgtcattaactccgtgcctgagaagggctttaaacatgacatcttttccggtagtttcctgttgatgtctttctaacttctataattatgttttcatttcttttctcttacctgggaaaagtgcctttgcagtagttctaattgccacctggcacagaaggagtgtgacaaatgacatataatatattgccttaactttctgtagctctttgtagaagctagattgtttctcttgaaagccttcttgagcccctgtcactgcagtgggtgctgtttggctgagagctccctggagtctgctgtttatctgctgtttactcagtaggccattgtgaccgccccttacctgaggctgcctctcctctctattgggcctttatgtttctcttcttggtttttcttttggattgcatgttgcctcaaataaaattgctaacaacatatggcctgttatgattctcttttcccaaactctgccattttgtatatttgtgacacactgcagattttgtgaagattgcttcataatatttgtttaccatctgctgcactctatttggtatcttgctaggattttttcctccattttaagtgacattaacaaaatctagccagtacataggctttctggttctacttttgcttccctaatgtgctggaaaatcatattactatgctccaggcaactagagaagcctggaattctcattgtgaaccaatgtatcagatctgtctgctcccctacccccaccccttttgttggtcatatccggtaacgcttttttggtcagatggcaaagaacctccatgtataagatagaaaaagctcaaattattttcttgcttcttagtaccactactttctagtgttgttctctaacatatttgtacctctgaaactttgtggcagtttagtaagtttttatgatttatggttccagctagtgtaatttttacagcttatccagcttgataggcagctagcctgaatcttggctagatgggctgtatatatccaagtttttgttcagaaaagtattttaggctactgtcatagtaatttgcttagtatgtatttctgctttcttacccttcactaacttttcgtagctgtcaattcactgtctttagagagaagtgcatttttgctttacaggttaaggtgagtggtttgctcttgggctgccatcaaggggtcagagacagctcagcttttgccttttggctggagccaccagtcttctcatggatatggttacttttctaactcagtttcctcttggacaaaaacaaggagtctttaataaaacgactaagcatagatattaaagagcaaatcagacagtctcccaaagagcagtttgtaaagaaaaccaatacctatataaagctaggtatcctattaacccacaacaactattcatcagtatgccatataagcctgattttatccccagcctttattagaatgcctctttcaacttatctgaaatcttcttttggagtcagaccccctaaggggagagttccaacattttatcactgggttgatgtcaaaagctattctaaccttttggcttcagttttctgtccacttaagcaaatgctcttgtaatgtttcatagctactttttatgcaacttctcttcaagaaattattctggtagctgacttctttcacagatctttttcttctgaaataatccctcaagagatttcttagaaatttagaattccaaaatattttggtttaagtagccttaaaggttcaagctctagctttgagaagttgaagaactctccttttgttcttgattgtgatttaaatgatttttatgtaatcggtgcccccccctttttttaaataaattataagaagggttttcactcgttttaccaaaatataagcacttgcccatcctatgtgaacaataccttattcaggtcttgggtatattgaaattcaaatataagcagtctctttttaaccataatctctatagctagcttagttgcagaaatgagatttattttaaaaaaactactttattcaggctggaatttgtttttatgccaagttcagaacttcataaagaacaaatcagtttagcctacatttaaagagaatttgacctggttttaaagcaaaaatgtaaagtgctttcatgtgtggtgatatgtaacattacatcatttgtactttgttttttcctgtctcctgcatttttaagaaaactttcgccttaaccttgaaaatattagtttctagaacttatatatagacagactcctttcttctctctctacagctggaatggcatttctcccccaatttggctctagagattctatatctaaagcgaatgaaagaatctttatgtgtgtaacatctctcaggactgtgccttcttcattactgcaagtgaccagtgtatgccttttactctgaaaacaggcaactcttgatagcagaatactggtagtgactctcctagatttagacagtgtgatcttgatgataccgattcacactgagttggggaactctgcagcagtgaaccaggatccagaaacaagtgcttggaaagaaaacaagtgcttggaaagagtgagagctatgggtcactgaacaggactggtccaagtgctggtttcgatcatgctatcagattgctgttggccactgaagagataaagggagaaagtattttgcttgaaattaggctaattgtgaaagaacacaagcttcctcctagggtccccatagcctagtcaccaagcagggggatatccttggaactacagccagacaggagggaagacccactgacttgtggtaggggaagatccctgtgttgaactgaactccctctgtactttcagtaagcatcccctgaccatgttgggcaagcttattctcttcatgatgagagatttgtctgaggttctccaggcttgggatcagaacagtctttctatatgatcaaatcagcaattatatgcccaagagtgaacaaaaataataattccgattgttaacaccagaactgaggcatcctgctgagagcctgccccttccaagttgtccccttgggaggctctgtacgttgctccagacgtttttggcatttctttcaactgtgcatttacagtctactacataggctgtcctcactgttgacaaatctttatagaaggatgaagagttaactatatatttggaaatagccataagtcattcttagacatgcttggcagatgatgtgggtaagtgatcaggccaacaatttcattttgggttaaaaatgagatttaatattctcacatagtctatcttcaggtttttaaagcagttttgaagagatatttcaaaaactactttgaataagagaagtatcatgaaataaatacattatttctagatgtggcctctgatgatacttactcaaatttacacattctggttatgtagtttgtgaagtcttgtcctccagccttaagacttaaattatttcaaaatagcatgaatagcatttgaagctttctatggctggagagtatgcaaaacaagtgaaactgttcggaaaaagagctgctaaatagaatgggggagacctgtattagagctgctttacaagttaaccttgcactaggcctaggttctcctgtggaaagagaataataataatgatgttcatgtcgcaggtttgttatgaggttttcaaggaggtattgcatatgaagcatagatcacagtgcctcatgtattgtagtgttcagtaagtgttagccatttttatcatgctgttgtgagatgatagattgcctgggagagaggaagaatggagaaatcggggtatggtgctgtttgggagatttaaaaagtgtggatagtagaacaagactggcctctcgttggtttttagttccgctaaccaaacctgttttgtcatactccagttatatttactttaacctagagatatgttgtgaatgacatgagcaatattttaattttctgctatccctaaaagaaagttttatattgagattctgatcatattccaaatggaaaacaaaacaacaaactaataatgtcaacatacccccaaaatgtggtgttgagggttagaatatcacattgtaataaaccgtttatattatgttccctttgtgcattaaacaaatgcacaccttatcatttgcattatgtgcttttaaacagatgaagatgaagatggtgatcgaattacagtgagaagtgatgaggaaatgaaggcaatgctgtcatatgtaagtatacgacaaatgaagactattttttaaaatcttaacgtgattgaggatgctgtttcttgggcatagtgaagacgagtaaataaatcacagttgtcatacatttttctatataataggtaaaggtttcaaggatttccgtatgtgaaagttaagggcattattttcaaaagacacttactgatcatatcataaacattaagaataatgcatcttaatgacttttgcattaggtatgatgcagactaaatggactatcaatttcctgtattttttatgcagtacttaaagtaacggctcattaaaaatgaacccctgggctctaaaaaatttttcaaaatctactttcaactggagatctctctcacccttccagactatagtttacaatgtagctgcaggcttaatatggatacacgatttaaagatgtactgttggttatttatgcactacccataatactcccaccgaaaatgaactacagggctacttactgaatcaaagtgatctgaatatattctgaaacgacttttcttttgtgtttaaaattttactgaaaatctgcgttaacagttatctgatactgaagtaaacaagagaaaagggcatatttctaaagcttcaatactaagcttgaaaaattcagctatcatgaggagacataggttacctgagtcttgatttgtgccttcctctcaagttttgttttgttatatctgagtctgtaatctgtttacaaaaccttttcccgtggcctggtagaaagagcattggactggaagtcaggagaccttagctctactgtggtttcttggccctaggcaaatcacttaacctttcagtgctgtagttgcctcatctgtcaattgtggataataatacttgtcctttatactgcacagggccattgtaatgatcaaatagaagaatagatgtgaaagccctttgaaaagttaaaagttctatacaaatgcaaatgatggaatcatttggaatcatgtggaaatgatggaatcagggctcttgcttttcactgagaccctaatcttagtcaacagttaggttgtaggtttttgatagacttcagcttcagccaggatattgtttcattgtaatgaaaactgtaaactgtctgtatgggtttctgccaatagttttaatttagggtaggagaatagagaacaagaaggataggatgattaacagagcattgcattccaaccagcacagaataggaaaagtcaatttcccattgacttcgcattaacttatgtgagagtctttgtgtactgagaatttagagctgggctcatcagtaccttgaaaggcagagtaggattgtctgctgaaaaggtctaccactggtattgatagattggctaactctcctgagaatgtgacatgcttatttttagaaaacccacacacacagatgggttctaattttctcacatatgtccattgcagagaactgacatcaatatactttcattatgtattcaacttaaccacatgcaaaagatatgtacttttgggtatgatcttacaaattgtgctttttgaaaatgttagtgggtgtggtcacagtgataatgatgatttccatttctaagttactgctatatacaaaatgcttgaggtatttaatttttttagttttaataatcactctgtaagacagatattatcatccttattttttagatgaggaagctgtggttaagagataagcccaaggtcttagagctagtatgaatgtgaatatggaatttaagttcagtttcttttcatgcccaagctgttgctcatttactgttttacactgtctctcccccaccttcctctttgcaggattttttttatgtcatcactgttatttatttttttttctccgagatggagtcttgctctgtcaccgaggctggagtgcagtggtgccatcttggctcactgcaacctctgtctcccgggtttaagcaattctcctgcctcagcctcctgagtagctgggattacaggcacccaccaccatgcctggctaatttttgtatttttagtagagacggggtttcatcatgttggccaggctggtctcaaactcctgaccccgtgatccacccgcctcggcctcccaaagtgctgggattacaggcatgagccactgtgcccggcctatcatcatcattattaaattctgaataatttgggtttatataataccttagttgtgatttctgcaccatgtattccttacagcatatgcttattttctcaaattcagtgtttaattatttttgtgttgtaggaaaatatgattacataatcttacattacatgtccttagtttaaaagtttctgagattacttgggtccacttttttttatctgaatagaagtcatctatctcattgatgagataattttaaaaaattttttgtagagatagggtcttgctttgttgcccaggttggcctcaaactcctggcctcaagtggtcctcctgcctcagcctcccaaggtgctggaattacaggcgtgagccaaggtgcctggccaggttggctgtcattttgatctgtcttggttcttatgattgaaatttaaggagaaccatttggacgtaaccttacagtaggttttgattggtagtcctcatgattaccagcatgttcctacaaatttgcattggtctttattttgtaggttcaatttggctctgaagtttgagtccaggatttcgtataaaggcatagggaagatactgacagattaccacatttttattgttttttgcaaaaagctgtttttttcttttgtttttggtcttgttttgtttttgagatgaagtctcattctgttgcctagggtggagtgcagtagcctgatctcggctcactgcaacctccgcctcctgggttcaagtgattctcatgcctcagcctcccgggtagctgggattacaggtgcccgccaccacgcacggctaatttttgtactttttggtagagatgggatttctcgatattggccaggctggtctcgaactcctgatctcaagtgatccgcacaccttggcctcccaaaatgctgggattacaggcatgagccaccatacccggccaaaagagcttagtttttcatatagaattcagtacacctgtggtcatcttagtatttctttaaaagccatatgtgggaaagcaaaaatagaggcacttttaccattagtcctttaatcattctttttcattgattacaaaggttaagtaaataaacagcctatatctctgcataagaataaaaacaaatttgcaacctctgagttgaaacttgaagaattactttttccccctcttggatgcaggcattttctggctttgggccagtacaagtgtacatttttatcagtaatttaaatagatttttgtattagacctgaaaatgttgcctttttaattgaaaacttatcaattatttaaatcactagcagcctgaggctgttaattttatgagtgccataataatggcatacagtggtttttgatacatgtgacacgtggaatattgtattatggtaaggatttgtcatgacaataggttgttgtgtgctgttaaataataaccaacatattaaaccaaagtctgttgtcacacattagtaccattttatgtaagttatttagaagttgtattcttttcttcattagagatatttttaagagataaagagaagaaaacaaagctataataaattgtcttttaagaaaatgtaaagtaatttggtctccaaggagatatttaatgtattgaaagaattcagcagccaagtgttattacagcaccattgtgatagctgctctgcattttgttatgagtttgtgttaatcaacaatctgtttttatagcatagtttcttgtaagttatgttgttagaatattccacttctgggatcacggcttttcctctgacactattgcatctttttaattcctccataaagttttttttttttttttttttgagacagagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagatggggtttcaccttgttagccgggatggtctcgatctcctgacctcatgatccacccgcctcggcctcccaaagtgctgagattacaggcgtgagccaccgcgcccggcctaaagtatttttttaattagaatttgaaatgctttattagaaaaaaaatacacacaacctacatattctgaaaactaaatacctgatcattgctaattaaatattcccttaatgtagtttaaattttgttgttgttgttctcatttcctcctctcattttctagaaagattgaaaatagcgtgctgcttttttccttccatttttttgtgtttgttgtctggtagttctatggaggcccagttctaggaggggattattttactgttaacctcttcttttgggtgacctttcattaagaaattcagccaatacatcttgcttttgtaagtagatttatatttgtttctgctaaatcctgtgtctagggatttattacacctggttctcttaatattgagaggcttgtgtgagtagaacacagtattaacaaaaataattttcatcattttgtctattctcactctttatatcattttttcccacattgccaggagagtatggcatacattttactgtagtgcctcccattatgagaccttgtattatatttagtacaagagtccttatatttaagtgaagtgtaagtattccctttggtgtatttgaccacagtgtaccctgtcagacgttgagtactatgagggaaaaatactttttgacctgtggagcaccttataaattgggatatgattggctttatcctaatatacataacttggacattgcctctaaaatcatgcagttactcaagtagagttggaaggtaaccacagaggttttgttcaactctttcattttacaaataaggacattgaggcccacagagaatagaagattcagatatcagttggaagtcacatggctaattaaaggcaaggcctggatacagactctcagtctctttgctcctggttgttttaaataaggtttttgttttgctctctattatagtcctgctcagctttgcaaatactgctttttcctgagtgtaaaaaataatacttattaccaaaatgtcactgtacttgagtttgtagagaaatgtaaaaaatactctgttggctgggcgcggtggctcactcctgtaatcccagcactttgggaggctgaggcgggcggatcatgaggtcaagagatcgtgaccatcctgactaacactgtgaaaccccatttctactaaaaatactaaaaattagccgggcgtggtggcatgcgcctgtagtcccagctactcgggaggctgaggcaggagaattgcttgaacccgggaggcagaggttgcagtcagccgagatcacaccactgcactccagcctgggcgacagagcaagactccatctcaaaaaaaaaaaaacaaaaaaaaaaaacaaaactctgtgggcgtctgaaggtttaaaagttttgtccttacctacaaggctgtgttttaccttgtttaccaaattcattgtccatttagaagttgaatatttaatagcatcagggccttagctattaggaagttttctttaaagaacaaagaggttagaagctcattttccacatggtgctttcaaatatgccacatattaaataggttctactttgaacttaactttgcaggtggcaaaatcagttcagctttcaatgagttgttagtcccctaattcaatgcaatttatccaaacaactgattacacagtatattcttcagagaaggtggagaaacggtgaaaagaatgagaaagggaaactgaaggaaataaattgttttggggatttgtttatttactcaaataatgacatgctgcaagctgtaagtaaggtttttgttttgttttcttatcctagtcaaaaaagaaaacttttttccagagacagattattttaattctcttctctgtttggaacacttggatgcctttgaaatagtgataaaagtgtagtgaccccttttagcccctgttgtgatctatgttggagcctgtttggtagcaaggagcagaagcatattcaagtttgcatcagaacgagggatttattatgtggctcttggaagcaaaggaaaagataagcacgagtaggcctcagtcttggtggcaccagggcactctggggaccactggaataggaggtttggaccaccaacattttgtcatttatatggctctgctcccagttcagttccatctctgtggagggttccgcttagcctatttataacaaaatgtctcatttggcttgctgtctgcatggcctgatagtcctgttttatttaagtggcaggttccctgaagctgctattaaaacttctactttaagaggaatagcacaattgctacagcctaaaaatcaggtgaaaggtcagtgtggacactaccccaagctaaccaaggtaataactctgaaagtttcagctgagaggatcccataaattttgggcctgttgctgaatacaaatttaaactccttctgccaacacatattaccttaaacatagccaatttgaatttcatctgctattggctgcccaaacttctatgaaggccatctggggctccttaaagtcctttatggttttaaccaaatggtgttatcattaaacttggccaacttgctgtcattttcactttcaagtcattaataaatacatctgtccaataacatgagcctataaatagggcccagagttggtccctgttgaccttcacattgtgattttctttctcatcatctaatcaatctgtgaccatatgtggaccctcggtcaagtcttttaaggaaaagcttgtacacattgtagtctcctcatgacaggagcaatgagttattgaggagtcagagcctgaagccaggtaagtaaatgtagctattaatttgatattcaaaatagattggcttcatatgttatttttgaccactggggcagttgtgtgctctgtgagaggtcagcatcataaaggaaaagcctcttaatgtaaagtatgagaaataattgaaagaaggtgtaactaatgacacatctgagtagcgttataattgaatttgtagccatttgatagagttaagattgttgagttcttcactgggaaaactaacaaattaactatggactgcaaatagttggttagtttattgattattgctgtaattactgactgagctacatataatagggtatgcttgcagtattgacaacaggaatttgaaaattttatcattagtatgaaaaaaacagcatgagtattccttataagtgaaatactgtaccaattatgttgtctgttaggcatgctaaggagagatttgagaaactctcctgttatagatgtatggaagaataataagtaggcctggtatctcctctgtacgtgagacttgctgctgaataagttggaaggtatgaccaatgagagtcgttactatgtctatatcagttcctctctggattcttcctgtaaacatttgtgccctgtctgtaatgtgctaggcactatatggcagtgatttctcaggtttttgaaggcatagtcctttttgaaaatctgtaggaagttgtttatttttttcccccagaaaattcacataatgcagcatttcaccagcttcaaggatctcctaaagcccatatagatcccaggttaatacctctggcataagaggaaataaaatatacaaggcatggttcctgcccttgttgagcttccaaaagagaaacagtgttccccacaatacctgtttactttattatttatagtactgtagtaattgaggggaagggaggggatactgactcaacctcaataaaccagttaaattctaccactgtactttgtccagatatctcagtcgccttgttttatggtttctgtgtcaccctattgttgcgaacatgtttcttctatgtactcttacttggaaatgagagattcaaggcaccatttcctatttcaagattttttttttcaagtactttttaagaaggtttcccatataccagctcctttaattttgatcttcttaacatctttataagatcagcaaggcaggttttttccccatttttacagcagaggatacagaggcataaacaattgtgtgcctttcttgaggtcacacagctagtcaatagagagctggggcctgaggtcactcactcgctggtttgtttcctcattcatccaatcagtttttcatgcagcaaatgtttattggatagcagttctctggccaagcactatgcaaggtggtgggggtgcagtgagcgtacagttcatgccctccaggagctcatggtccagtcagggagattaacaaaaaaggaaacagagttcagtgtgggaagacaagaaaaactcataattaccaagcggagtgataaatgatataatacacctaagcattaggtgctccatgagcacaagaagtgtctaatctagctttggggaccaaaaaggcttcctgaagagggcagtgtccaggtggagtaagttaggacaaggggactaggaaggatgtttggggcagaaagaacagtgtgtttaaagaatgcctggtgagtcagtaggagctgcctgtgattcagtctgtatggacagtgacgggggagagggtgggagatggggcttggaggaaggtgggttagaccatggagggccttagcccagggaagtgacatgatcatatctcatattgtcagaggcatttgagccatagcaactctgttagtctgttttcatactgttatcggaaaggggtcccaatccagaccctaagagagagttcttggatcttgtgcaagaaagaattcagagtgagtccacagtgcaaagtgaaagtaagtttattaagaaagtaaagtggtgaaagaatagctactcactccatagagtaggacgttcccgaaagtaggaggatgaatgtgcccaccctacgtatgatgtttgtttatgtataggataaaaaaggatcatggggagatgtgctctgctacaagggtttgtgataaaggattcattttcttaattactatattttgcaagaattgatattattattattatttttttttttgagatggagtcttgctctgttgcccaggctggagtgcagtggttcgatcttggctcactgcaaactcacctctcgggttcaagtgattctcctgcctcaacctcctgagtagctgggactacaggcacctgctaccacgcccagctaagttttgtatttttagtagagacgggttttcacgtattggccaggctggtctcaaactcctgaccttgtgatctgcctgcctcggcctgccaaagtgctgggattacaggcgtgagccaccgtgcctggcctgatattattttgtttaaagcaaaattaggaatgcttctgttttcaagatattagggtatcaggacattcctgaatctgggtatgtttagtaaacgttatcaatctgttcccttaatcataaatagctagagcctaggaatacctaacttcctgggaatgtagcccgggaagtcccagcctcatttttcctagccctcactcaagatggagttgctctggttcaaatgcctctaacaacattgctataaagagctatttgagactgggtaatttataaagaaaagaggtttaattgacacagttctgcatggctggggaggcctcaggaaacttataatcatggcagaagacaaaggggaagcaagtactttcttcacagggtggcaggagagacagttgggtagagggtggggcgggagttgccacacacttttaaaccatcagatctcgtgagaatccactcactatcatgagaacagcaagggggaaatccacccccatgatccagtcatctctcacaggacccctcctccaattaaacatgagatttgtgggcggggacacaaatccaaaccatatcagactccatcttgaatagaagctgggtaaaatgaggctgcgacctgctgggccgcagccccaggaagtcaggcattcttagttacaggatgtttagagttaagggaacaggttaatagcatttaccaaacagattcaggacttaacagaccaaggaaatgtcctgatgtcctgatatcttaagaacaaaagcattctgagttttgctttaaagataatatctttaaataataatatcttcttgtggaagacagtagttacacaaagatgaataatcctgtgtcaccagccttgtagtgcagcgcatctcctccatatggttttttgctttgttattttacatataaacaaacattgtacataaggtagatgtgttcctcctcttgcttttgggaacacccagctctgactgggtttattggtggagccattcttttattcctttactttcttaataaacttgctttcactttactctgtagaattaccccaaattctttctggcacgacatccaagaaccatctcttggggtatggataaggatccctttctgataacagtatttctcaagagtggcttggggtagagaatttatgaagcgtggaagccacttagggggctgttccttgtgaaagacaatggtggtcactggactggtgagaagttaacagatttgagaagtggggaggatgtcaagttaataaaatttagtaggctgggcatagtggttcatgcctgtaatcccagcactttgggaggccaaggtgggtggatcacgtgaggtcaggagtttgagaccagcttggccaacatggtgaaaccccatctctactaaaaatacaaaaattagctgggcatggtggtgggcgcctgtagtatcagctactcgggaggctgaggcaggagaatcacttgaacccaggaggcggaagttgtattgagccaggatcgcaccattgcactccagcctgggtgacagagcaagactccatctcaaaaaaacaaaataaggccaggtgctgtggctcacatctgtaatcccagcactttgggaggccgaggtgggcgaatcacgaagtaaagagatcgagaccattctggccaacatggggaaaccccgtctctactaaaaatacaaaaattagctgggcgtggtgtcgggcgcctgtagtcccagctactcaggaggctgagacaggagaatcatttgaacctgggaggcggatgttgcactgagccgagatcgtaccgctgcactccagcctgggcgacagagtgagactccatctcaaaaaataataataaaaataaaacaaaataaaataaaatttagtggttaaatacgggggagaagagaagagagatggtttggattacttccagatttctggtttgggaaacagggtcatagtgatggtatttcctgagaccataaacccaggcagcagaagacaggtctagggtctgataggggataggagaggaaatcagttttggacctgttgaattggaggaggctctgcacaatcaactggttatgtttcagaacttaggagagaaatctgggctggaaataaagatttgtgattcatcagctcctaattagtctcagtgattcctctggtagttgaaactttgaagtggctaaagtaactcaaggagagtgtaaaatgagaaggctaatgaaaaacagtgggggaaatcctgcatttaaaggagagatggggtaataaccacttacaggaaaccgaatggagtggttggagaagtaggaaaacccatggaggtggcggggcgggggagggcagtgggggagtggttgttgccaaagaaagagccagaggtcacctaggtcacccatcagcacagatgtcttcacactgcttcgccagcctctgaaagatcagaggatataacctaacctgcacagggtgtgagcgaagccacagctctccaccagctcagcagtctaccaggtaaccctacctatttaggtaaatgttttgaggtatgagaaatatgagataacctacttcttaacttgtaagcaataaatatacgttttatgccctgagtgcatggcatggcctagaatgaaaggagtaatttttttgtttgtttgtttactgataaaccatttgcttcatctgttaaatagaggtgatgatacttatagaataggataggattgtaaaaaactaagtgaataaatgtagatatgtagtgctgagcctaacacacataggtatccaatgagtgagggttagttctctccctctatctctatctctctatctctgtctctgttttctcttctttttttctttctttctttctttctttctttcttttttttttttttttaagatggagtcttgctgtgtcgcccaggctggagtgcaatggcacgatctcggctcactgcaacctctgcctcctgggttcaagcaattctgtctcagcctcctgagtagctgggattacaggtgcacaccaccacgcctggctaatttttatatttttagtagagacaggatttaaccatgttggccaggctggtcttgaactcctgatctcaggtgatctgcctgccttggccttccaaagtgctgggattacaggcatgagccactgcttccatccttctctctttcttaatagaaaatttgtgcctcataaacttaaactgtgctgttttggaactcaagttttttaaaaaatatggcagatttccatgaagaaaaaaatgtaattattgattgaattgtgccattagcattagaattagatttataacaaatatgaacactgtagtaaacttgcaaacaaaacaaagcaaaaaattgtacttgttatccccttgttgaatctggccctctgtttcaaattaattagatttttggtaactatgctaaactttgtcacatccttattaaaatgactgaagaattttgaagaacagctcagagggactctgaaactaatctgagtctagtactggagattccattagcaattgcaaagctgattgatcttttacccagttagcttattgattatcgctgcagttactgcatgtaacggattatgcaaggggtaacaggagaaaacacattttataattgctgctgatgtattcagtttggacacaatatttcatactctatataattatttctgcatttttaaatgctgcaacacttctaagatagaaagtttgcttaatattgtttcaatatgaggaggtgtacttttaaatttcttaactaataatgcattacagtttaccaagtgccttcactaattttattgctgcagtttaatttttgagcctcacagtaaccctatatatatatattttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccgggatggtctcgatctcctgacctcatgatccacccgcctcggcctcccaaagtgctgggattacaggcgtgagccaccgtgcccggccagtaaccctatatattagggtaaatatttttatgctcatttggaggaaactgatgtttaataaagttaaatgtcttcctgaaggctacacaagttaatgagtggcagacttagaattcaaccccatttcaatcagtaaatgtttattaaacacctactatgtgcagagctttgtgttagggctaataaatgccaggataagattatagacctgaagatgaagttatttggataacttgaagtaatattatgaaggttactttgttacatttctgtccaagctattatgttcagtatcttagtgtacaaagtttaggggtgtttttttggtcgttgctgtttgtttctttgtttttttcttttcttttggttttggtcatttctgcttattttatcactatttagaacaaaattggagagaatccctttaaaggaagagtatatagaaatgacactaatagatccagatctaaaaacaatttgctggccgtgtgcagtggctcacgcctgtaatcccagcactttgggaggccaaggcaggtggatcacctgaggtcaggagtttgagaccagcctggccaacatggtgaaaccccatctctactaaaaatacaaaaattagccgggccagtggtgggtgcctgtaatcccagctacttgggaggctgaggcaggagaattgcttgaacctgggaggtgtaggttgcagtgggccaagattgtgccactgtactctagcctgggtgacagagcaagactctgtctcaaaaaaaaagaaaaccccaatttgttttgcagtttattacttgctgtcttctctgttttcccatgtgagcctcacagctatcctctgggtagagcccgtcttgattttacaaatgagtaacatgaggcacagtgagcattttgtcatggaggtcacatgcttggagacaacagttagtgatggagctcctgggtttgagccctctgattcattcatgtgccttgctcatctcactgagcagcatggacctggtggccggtcaggactgctctgtgctaagaggtaccatgcatggccctgcattttatccttatcccatggggaatgctccgtaggcagtagcctgagtttctaggcctagtgccttgttggtggctgttcctcaggggccagttgtgtagggcccacactgtggttttgattacctccctttacagcatgtccttgatggtgaattactttgctatgtggaacataagcttctctattaatacagacacagatcaaatgcagtagtccagcaggagaaaatatacttggatttagaggaaatataaaaaacaaaaaacacaacctaactactcgctttagagaaactgttaagtggcatacttgatatcattactgtgactgtgttagtcgtagtacagagagatgtttatagatggcttaaaaattctcacaatgattataaaagtgtatatagtttgccagttgatttggcacagacctaaaatgaaaggaaaaccatttttatttatttattctgtgaggtaaataaataaagctggaaaacaggtcaatttcatgcatgcgaggttttatagtaggaaaaaaaagcattgcacctgttctgaccctttacatttgaggttatttgttttcaaacttgaccccaagcaccagttttagacatctctataattaacttgttagataaagcataaggatattttatttgtctttatttctaggataatggcaaagtagtaactgaaattactagcctattgtacatagcagttaattaaagaaaagcattaactataggagaacaccaccactgctgttgtcttgtatcagtacaaaaaggcagtaatttttttgacagccactgattggaaagttgcttgcagccttccagaagcaagggggtacatgctgtggatcaataaccggcaaatttcccattaaaaagaatacctgagcaatgttccaaatagccactggcatcttaattttccatggaaacctcaaatacttgtgtgccgaggacaagtcattttcggacaatttttccagactacttgttaacagttattgctgtcccaaaaggttgacagcctacatgattgatatttcatttacttgtcatcactgtttgagtaatggcgagtgctgtatttctgtggttttaaggaacagaatctcctgaaagacatttgccttagtatgtattccagagagtgtttcacatgtttatgccgtatgtatataagtttttatgtctgtagaaggagagaatcactttctttacagtttgaaaccctttggagagctgggtacacttttatcagtgtgtagctatccaacatccaccttcactttatttgttattagtgcgaacagccttagatgtattaacttgtgattcccaaaatgatgtggcattttatagctcccctttattttcaagaggaaaaaaaaaacccttgctcttgtaataattttaatgtacataaaagcaataggaagatatatgtgatatcttctaaaaaaaaacttttaaagaatgtcagcaaacaatagtaatcaaggagggatttcctaaacatatcgtatttaaataatatgcacatgtttttaatatagaaacagtgaggatgaaaaggatgttctgctctttgacagcccctcaaaacataaaatcagcagttttcattgtggatatttttccactaggagcatcactttgttatttgtcgagcattataagatgtgagagcacagaagccatctccaagttaggtggacatatgcttacaaattagcggagtggtaatcaaaccacagtaccacctactgaataatttgtgtttactaaggagtgtgaaagctttttcacttagaactttattttttgtgtgcagaattttacagtgcaatttgatccgtactaaagtgtttataaggctaaagcataaaaggtatgtttgtttgaaactaggctacctttttatcatgttaatcctgtcatctttggatgggtcatattttgtttgctatttccacagtctctgtgatttcgatttccattatctgtgcattttatacacaaattgaataatgtttgattaactggcatgtaggtccaagcccaatgtgaagcttcttcattttgctttgcaaaatccagggaaaaagagcaagaggcaatttgggaaattccactaaaatgctttatgtgtcgtctaaatatatatcattttcaaatatttcttaaatactaatataaagtcttaatcaacacttttactcttaaagataaatgccagggtgaaggctaacacactggactttcaatcctaaatattcactatagtcattttgatgtgccagtaggggaaaagtattctcaaggctgatatgtatataccagcaatttacaaaagtactgtgaattaaacaacccataagtgtctgttccagtattcatacattactgagtgatctctttctataatctctttgcagtattattccacagtaatggaacagcaagtaaatggacagttaatagagcctctgcagatatttccaagaggtaatgttgagcaaattctaatcaacaatgattatttcagtaaactgtttcatcaacagttatgtttccaaaggtttaaatgcacataacatgatgtttagctcttaattcgaaaaacaaaagaagtattcattatcgtggggattgcaggctatattatagttatggcagataaaatatctaatttactagagtaaattaaactaactagattgttttttgtttttgaagtacatacttacattagcttaaagaactcttttgggggtccacatggtttctaaagcaaggcaaatgaatgactttaattctggatatttataaattgtggctcatgatggtggccaaagctgctattgaggagaaagctttcagttagcacagaagcgaagatttactgaggtgttaggagagaaattttggtggaatgtttggtatctggttttttgaggaggtattttctaaataattgaaattcttcataaatggaaatttgattatctccaaaaatatgagctgatgagagtaagtttcagtgaatcacttggtcagataattttctttttcccttttaggtttggcagtactatccttgtatcagatatgattgttcaaccgtgtataaatgttccctcaaaatttgaataatggtgaacaagaacagtttaattatataaaccattaagtctttcacccgttatacattgccccacttggaatccatgttttctaactaatggaacagataaggaaattctctaagtaacccttctagaaataacttaattgaaataattaaaagttaaacttaccttcgttaactgatactgtacaaataatcatggtatgagttttccaattaaacattctagactttcattacctgtaactctctgaagtttgaatggctcaattaaccagtaggctcctatttgcactgataaagtctccaaaggcagctgtcttggccaacccacaagaagatctgggttcaagaataatactgctcttccagcatatgtgtgggcagcagaatcaggagtgcttagtatattactagtaacttattgaagtgctaagtaagtacagttgggctatttaaggccagtgatagtccaaaacaaggattgtgattaatccacttctgttgtacttgaagattaagcaccaaaacagaaaaaaagaaatgttgctatttctgtttattagtccaatgattaggatgtagatgatttcttttttttttttttttttttcgagacagagtctcgctctgccaccaggctggagtgcagtggtgcaatctcagctcaccgcaacctctgactccctggttcaagtgattctcctgcctcagcctcctgagtagctgggattacaggctcgtgtcaccacacccagctaatttttgtatttttagcagagacagggttttaccatgttggccaggatggtcttgatctcctgacctcatgatccactcccctcggcctcccaaagtgctgggattacaggcgtgagccaccgcgcccagccaggaggcagattatttcttaatgtttgcagtgactggagaatttgggcaagtttcaaaattctttcttcacaaggagtagtattttacaaactgaaaatttccattaatttctctattgacattatagctctgccatagaaaaccctaattgcagtatcctggagaaatatacttccaggcagggcacagtggttcatgcctgtaatctcagcactttgggaagctgaggcaggtggattgcttgagctcaagagtttgagaccagcttgggcaacatgtcaaaaccctgtctctaccaaaaaaatacaaaaattagccgggcgtggtgcacactcctgttgtcccagctacttggtgggctgaggtgggaggatggcttgagcccaagaggttgaggctacagtgagccatgtttgtgccactgtactccagcctgagtgacagagcaatacattgtctcaaaacacacacacacacacacacacacacacacttccaatgttgtgggtcttcatttgtctctaaaaaattttttttagttatcttcatccaaattctttcaagttttgtttgttttctttccttttgtgagcagtcctgtcattctcactgttcatcgcattatgcttcttcccatgataatcacaaccatttttagatgtctgctctgttaaggcattaatattgctttacgcatcatcatctgtaatcctcctgatagttctgcctattaggtattactgtttccaatttatagatgagaatattgagattcagagaggttaagtaacttcagagtcacacagcttataagtgcttactatgccctttgagtaagaatttcatttaaattataatatgattaaaatggaaaggcatatatattaaaatataattagagtgtgcatgggagtagtttggagggcttgttttggagtggagaggagtatgttatggggagaggatacttaaaggaggaaattatatgagatgtcattgtcatatgtagtcttagcataaaacccactaggctgcaataaattgttaaacatagtctttctaagccaaatttaaatatttcagaatatgagactgtctttttatttctgtgtttttttaatatgctatggtgtaattgtttctagtttttggtagtcttttgctttttgctacctgtctacatcgaatgtacattttatcatatgtagataagtgaaattatgcaaatttacataatcgacatgtagacatactgggtatatttcctgtgtctacctagttggttagaggccctcagatcttaaattttatggttaggccccatgttaaaaagaatctttagactgaacaagtaggaaggataggagaaaatgattgtttccttatttatttatttatttatttatttattttggagacagagtctcactctatcacccaggctggagtgcagtgtgtgctcactgcagcctttatgtccccaggctggagcagttctctcgcctcagctcctgagtagctggggctacaggcatgtgccaccacgctgggcatttttttttaattttttaatagcgacaaggtatcacagtgttgcccaggctggtgtcaaactcctgagctcaagcaatcctcccaccaccacttctccaagtgctgggatgaaaggcatgagccaccatgcctggccataattctgatgtaataacatgttctcctcattccaagtagcacagttgccttggatagtaactcccaggtcatggctaagtcctctacattgttaaaagatatgttaaatattaataagtgtgaacattgactagctttatagtaattcctgacccgataactttaggaaatatgaggttactgggttttttgactgctgtttacatctccagttataaaagtttgagaagtcaattgaggagtgaggcagatgttaaggttagagataagagttgatgtttgtctctgattccttggctagccactttgtttaaatgaaatttatgaatgcactgcttacttcagtggaaatattttgaagtgttgtcttaggaagtattgatggtccctcaaggaccagacgtcaaatgcatgtgactgtagttcaaaaggttaatttccattttaaggaaagaagattttgagtcttaattttaatgcattttagaaaggcaagtaaaaacattttgttatggtttagatatattttctaggaaaaataacataataaatttgagtatatttggaatatacaaaatgaaagcaactgcagtgttttgtaattattacccatatcttctccttttttttttttttttttttttttgacacagagtctcgctctgtcgcccaggctggagtgcagtggcgtgatctcagctcactgcaagctctgcctcctgggttcacaacattctcctgcctcacgacattctcctgcctcagcctcccgagtagctgggactacaggcgcccgccaccatgcccagctaattttttgtattttaggtagagacagcgtttcaccatattggccaggttggtcttgatctcttgacctcatgatcagcccacctcagcctcccaaagtgctgggattacaggcttgagccactgcacccagtcattacccacatcttattattaaacagctctatttcttgttgtcagaaacaggaaaacgacatgtacatctgagagaggagcaaaaaaaaaaaaaaaaaaaatcaaattaattcgtccccaaacaatcaatcaaaattgatggccccttaacatacaatttgtagggcactatagttttcaaatagaagcagtctataacatgggcaggaggcttttgtatttttaacatttgttgaagaagcatttgctgaattggaaaagtactaacctgtaactcaagatggtgtcaggaaattaatattcttttttcctggcactgccttatctctaggactaaatcttagcatatgtcaagatttgcaagaaatgtaataaaattagttatatatctgtattttaatacatttgactgcttatggctgtgcaaagtagtattcaaactagaatgttccatcgtagaatccctagcaatctttttggcattaaaacatccttttctcaccccgcttgctcacaaaaaaatcccttagctcttttcaaagtagtttaagtgatagcagatatacaatgtaatagaatgaggacagattgcagaaatttgaattatgaaaggaatctaatcattttagctcagttaacttgatttttatatgttttaagcagaaattggaatttatatgaggtggtgtcagaaagctctttgcatttataaatgctcactcctgcaagttaaaaccctggttcataattcccactttgggtcttgggagccacttttcaatcatttctctctgctaattttggtgtcaccctcatttctttttaaacgattcattttgagcaaatttgtaaatggccctgatgtgttctacaatttagtcaattactgtttcagcctgcaagcctcctggggaacggaacatacatggcctgaaggtacgaatttcaataattgtttcagtaaagttagatggatttgtaatgctgtgttccacttattgaaatgtcaaataaaactgcactttctcaagctctgacaagcgatccttttattttttttaaatgggaggtggagggggattcatctgtagtatttgctcagtatgtgtatatatttgcatactgggggtttggtactgtattttcaattatttggaattgttttgttggtcagtgtcttcaggataatcctaggtgctggtatctacaaagattttagtaagaatatagacttcatttcagtgattaattaagcacataagcatattgcacatggaataccctctcttgacatatttatgctagaaacatatatctagttaatgtcttttcattctgtgtattttgaattctggatttctgtttagggcttcacatctgaaagaaaagctggcttttgtattaggctcaaatatttcataattaattatttggacctcattttttagtgaataagaaacattctacatacagtgttctgcttggttgcagagctggaaggatataacttgaggttcactactaacccctgggtatattcttaatgtactttttgaacatactgtttttatatgtattctagacagtgagttggattttcacactgtttatgtctcctttttcatcactgtttaagtatttaatggaataatgacaggaatagaatattatgtaatgtatgggttatacggttttgtaacctatatactgaatagactccaactgtgggtttgtctagcaacaagctaattaaccttcatagtgaaatgagaaatttgtggcaaattataggttaattagaactgtgtcctcagaacacaagactgatcaagattctttctttacttataggtgaatactcgggccggaccctctcaacacagcagcccagcagtctcagattcacttccaagcaataggtgcgagcgagcaagtaaagtgtgcccttgatgtgatttatctacagagttggggtggggtggggaagaagctagaaagaaatttgaccagttagataacctagctacgtattgaccaaagagaaaggacctcatatggaaagatgaatgtttagatttagactgggtgctgagaaggctctctggggagagtgacgtttctgttttgacctgaagaagcagagaagggcgtttcagacggagggaagagggtaggtgaaggccctgaggtggagaaggagctcagcatgtttgtgagtaggccagtttggcacagggaggggtgctgggttggggaagggatttggagagaggagatgagagagcaataggagtgataggagctaaggaggtagacaggacttatcatgcggggcctcgtaggccctgtaatgtttgaattttccttttggtgcactggctagcagttagagggcttttagtaggagagggacatggccagccctgtgtttttaaaagatcctctgcctgtggtgtggcgaatgagcagaagctcccatctaatcctgccctcctttgatgtttgacttcctactccttgccaaatggtcatcaaatctcttactgaacatccctgtcggaggaatgcactttatcagccaacgcagctccttcccttttttacttggctacatctcagaaggctcttttttgtgagctgagatttgtctttctatagcgcccactcataacgttttagttaagccctcagaacgtggttgttccctcttccaggtcaacagctcttccagttgtcttccctccaaacacagttctagattttctgtctcagtaaattctcccacatccagtccattgctaactccagataacttgtcagtcctccttcactgcttcctaggcctccctcagtgccacaccctgtcagtccccacacttgtgggttctaccttctgagtagctctgcgtctttctactcgccagcatccctgctgctgtgtgggtggttccagctctccagatcactgccacagcctcctgagagtctactccctccgttcttggcccattcagcccctcctccaccctgcagctggagccatcttgccagtgtacagtcctgagctgcagtcattccctgctttaaaaccttcactgctcttcatgctttcaagatgaagtgtaacctccatagcaggtgagcagtgaagagcccttcacatatgggtgctctgtgtactccagcttgctggcccacctctgtaccccatcccacctgacattccagctttgctgatgaacacatagtgccctgaatggatcactttcttctctctactgggcctgcacattttcccgttttcctgtttcttttcatccccaccttgaccttcagtctggctaaccttggttatctttgaggactaaattatcttctgagaactgtccctgattactacccatccccagtgcacaccagggacctctctaggaattcctatgatactcccttcttccttgtattgtagtagtgagcacattgtattataatcacccctgtcctccagtagattctatactatttgagggcagtgactgtagcatattcattgacaaagttccaattcccagcatgatgcttgccacatagattatagtcaatcatgtttgaatgaatgaatgcatgaatgtatgtatgaattacttgtatttcttttacatcttacctctggactaaattctcccagctctttcatcttttctgatatgacattatttctagtcccctcatccttttctcttctttggatatctcagtgtctctcttcaggtgttgtactcaagttacagttgtaacacatttaaattttaaaatgtttttattttattacttttttagagatgggatctccctctgttgtccaagttagagtgcagtggcacaatcacagctcgctgcagccttgacctcctgggctcaagtggtccttccacctcagcctcccaagtagctgggactacaggcttgcaccacaatccctgattaagtgttttttttttatttttttaaatttttttaatttttagtttgtagagacggggtctcactgtgctgcctaggctagtctcaaactcctggctcaagcaattttctcactttggcctcccaaagggttgtgattacagtcatgaaccaccacagctggcctttaaatgtttttaaaagtgatttttggatagcttaggtcaccgtgaacatgcagatgaatgaaatattgagtaaagtgagtcacagagaaattgccaggatacaattttttcttttttttttctttttaaccagacaaagttgatagccagatactagcataatgaatgaaacagtattttcctctattactctcaaagcatgggttgttttttcttttgccttaggtgaataactgtttattaaactgggtttactaatgcacatggtgttcctaggccataattactgaattcaagtcccattgccaaggcaaggcctttcctaaactacttagctttctccttctgtaaattaggatgattaaactttccatctatctactgctggtgttagaaagattgatgaagctgtattaggaatcacgttttatttcttggatgaaaggcattctataaatgcaatgaatcaaaatgttattaattcaagtttataacataatggaatatctatgtagaaaccttgcctgggctttgtttggttatttgcgtctttacaataattggaactatcaactgggagtcatttgtgggaaaactaggatctgaatgtttcccagaaaaaaatgtgtgtgtgtgtatatgtgtgtgtgtgtgtgtgtgtgtgtgtataagagatagatggacttcgagcaagatctgtaccttagaggtctgtattttagtatcctttataaattagggataataactatacctaaagtatagttattataaggattaaattaggataataagcatttagcacaatgcctagcacatggtcatcacttgataaatagcagctgctattattatgttaactggactgattttaggcagctgtgtattttttccatatatgtttcagctttcatcctattctacaaaattgttaattgccactttagtgcatcgattcttagatgtggtgggacattaaagtcaagaacccttggatgaagacatgctttataaaatctaggaaaatagggactcagtctccatagtttacatttgaccatagcaaaagtttaagatgtatttagaaagaagagtaattataacttgaagtggtaaaatgtgatcaaacttgaagtctgagattctctcaaatgtaacctattaaaggtaccaaatggaatatgtgtatttcatattaggtcttgagtcctttctctttttttccttttcatttcttcctttcttgctccttccttcctccctctctccctccctccctctctctccctccctctctctctctctctctctctctctctctctctctctctctctctcactctctctttgtttctttttgagacagggtctcattgctgtcacccccccattctggagtgcacaattacgggtcaccacagcttcgacctcctggcctcaagtgacccgagtagctaggattacaggcacatgccgccatgcctggctaagtttttaattttttttagagatggggccctactatgttgcccaggcttgttcttgaactcctgggctcaagcgatcctccttccttggcatcccaaagtgctgggattacaggcttgagacgctgtgcttggccccttttgttttctgatgtatttatgatcttaatgtcttactgcattactactactgccaccacagtataataataaccagagcagcgaccaccatttatggaacccttagcatatgccaagtcattgggctatatttaagggtgagaagagagtggagtatatagaatacgtaagatgtgtctgtgttctcagggagctcccagactctcccctgttgggggagggtatggtaggaagaaagacatctatactgacaactagcatgggtaggtaggtaaagggctaaagtggataggttaagaatagagttggctgggtgtggtggctcatgcctgtaatcccagcattttgggaggccaaggtgggcagatcacgaggtcaggagtttgagaccagcctggccaacatggtgaaaccctgttttcgctaaaaatacaaaaattagccaggcgtgatggcatgcacctgtagtcccagctacttgggagactgaggcagaagaatcgcttgaacccaggaggcggaggttgcagtgagctgagctcacaccannnnnnnnnnnnnnnnnnnntttattattattataaaaaaaaaactggagtctcgctctacatgataggctggtgtgcagtggtgcgatcttggctcactgcaagctctgcctcctgggttcacaccattctcctgccccagcctccagctgggactacaggcgccggccaccacacccggctaattttttgtatttttagtagagacagggtttcaccgtgttagccaggatggtctcaatctcctgacctcgtgatccacctgcaccagcctcccaaagtgctgggattacaggcatgagcaccgcgccggccccttaacaggctttaaatctcaaatagaacattgctgggggaaggtgctattttaaatgctactctactagtcaggtagatattcacgggtataactcattataaagctagacgacttaagagctccccttgactaccatttttcttcaataaggactttcacgccaggggtggtggctcccgcctgtaatcccagcactttgggaggccgaggcgggcagatcacctgaggtcgggagtttgagaccagcctgaccaacatggagaaacccccagcttactaaaaatacaaaattagccaggcatggtggcacatgcctataatcccaggtactctggagactgaggcaggagaatcgcttgaacctgggaggtggaggttgtggtgagccgagatcgcaccattgtactttgcactccagtctgggcaacaagagtgaaactacgtctcaaaaaaaaaaaaaaaaaaaaaaggactttcactaaattcatccatatgagtgttaacatagtcatatatgttcagaaaacactttaatacttcctaaataactctgggagctgagtctcatacccataggaaaggaaaaccagctaaaatttattaattttatttgtaaaaacacacctgctatggacaagacacagtgctagattttttgtaatatttaatttttctggttaccctataaaattggtattttccccattttacagaaagaggaaattgaggttcagagaggataagtaacttgtcccagatcacacagctagtgaataccaggatttatttgtactacatatttgcttcccaggaagctgaattataacttttaactgtgtaagagaccaggacttaaattatctattttgtcttttgaagttctataatctttatttgctgtgaatattagtgcttagcagatgacattgtccacatgaaattgcctctgaaaggctatctaaaggcagtagaactaatgaccataaaaatgtcactgaagtagttcataagatattgtagcttcatcttgactgtaggcttctttattgctttcgattactaacagggttttagtctctttatttgataccttttgcatttggccagttacttttgaaaaaaatttacattgggagaaggatgtgaagaatatgctcaatccctatatgtaaaagcaaaggtgtatttcagtctggaattttcagtggtgttcagaggtgttgatgatcttgccactaaaaattatctttccttttcagcttaaagaagtcttctgctgaactgaaaaaaatactagccaatggccaggtaggtattattatatattaagattttcacataataataacatattaccgtccagtttttgtatccataagcttattaaacagataaagagtctgtgagtttcctgtcataaatgaataacatggcttaatttgattggcagaacaatttgcagcccgtttttcaaactgtgctaatgggtttcactcccagcagattgaagtaccatgcacacaccctgctgccatctcagtttttaaaaagttaatcagttctgaacaagtgtgtcaactcgtgggctgttgaaatggccctgcattctgaggtgactgtttctttcattatctttggggagaaaaggaaaaaccattactttctcaccttagctccttcttttgtcctgaaactaacactggctttttagggaggcagagtgacagcagacctttggcatataaaattcctggccttcaggagaccttagtttgcctagtagactggccatctaaagctgaatgacctaacccagccagtgagggacaaacgagccttcaggccagttatttcttactaattttgattcaagtaaatggacacatctgaaatagtagagtgcttttaaacatacactggtaaattaagctacctacagggtcctcgattcttcagtagcaacataaatgcgttttaatgtttgttatagtggaagccctttgatagccttggaggcaggcgcctgtccattgcgatcaagcctgcctattaggctgtattgactgagacatctgtgtcactgcaaataaaagactcttattgattttcttaactgctgttcacttcccgtccatgtttcgaaggctgaaatcttaattatctcagatgcttattcagtgccttcacacactgacctctccaagcctcactggcatttcatgaatcaagtacttgtagtggagcatgtcaagaagacaaagccaggtcctcatgcctgtcctttaatatcacctgtaacattgtggcctaatagatgtgcatgccttaaaacagtgctgtatggtaatgcttctggaggccttgcttatttagcacacaattccttgaatacagttagaagaaatgaagttgatctgcttctgacatctgattgccatccagagtatgtgaattctagtccttaaatatcctatatacagctaaggagaatctagtgtggtgtatgtataatctttgtagtctcaacattttagatagtatttatcgaatacctttaactttcagcagccaaaggtttgtttagattgaggtccacatctgtatcacctcagtgccttatattttgttagaaccagcatatataaacaaaatctgactaaaagcaaaaatattgagcctaggatatttatgtatcttcaacatgcttgcattctagttactaattgtaatttatgtatgagtcactgtgttcttcagctggaaaatatatttcaaaattgacataaattaagaagctttaactacatttgtccagcccagacaatggaaaataacctgtcatagactcttctttcaaaaatgaaaaacagttttttccactgcaaaaaataagcattttcataatgttttgacaaaaataagcagtctcataatgttttgacagtaagcctagtaccatagatatcttagtggcttcagttatgaggttctctatatggtgggaggttgtcctggcaaggatttttgacacttaaatgtttattgctttcccttgggaatgtgataacctcatattaaataatatggctttttttttctttataaggattagcctttcttacatttacttgcactcaaaaaattccctcaaaaaccaaaaaaacccacctttggaagctttcaaaatgtctccttctaattccttaattcctcagtgctataggataactaaacagtgagtgaaattgcattgcagtgaggtactgtgcacagttgtaggcatcaataaatttctgggctgaacactgacaccacttgatagggaagataaaagtcacatttaatgatactttaacacttgagcatagttttttattttagtggtttatgctctcaagcattaataatgatttgcctttccactagcctccacttagatttaataaggaattcatattaatcattaaaagaaagggacatgattcttcaagataatcaaatattgacaagttagaaatagctttctgcctgggttcattgatataggttatgtgatataaatatttatttcttttctgtcactcagagtaaatgccaccaattgattcagcattgatatagtgtcaacagttcataagaaacatttgactggcctgtgttttccgattagtctctgctctataaagtgggatttactaaatctctccaattgtctgctcatagagtgtgactgctttctgaaaccattattgcttcgatttgtgaagcaaaggtctagtgatgggactagtttctgtcagacctttacatataaaataaggattaattgagcatttttattttaatgatttataagcgataggtactgattcttcttaacacagacaataaacaaagaatattttctgtgttgatccataattgaattccatttcattttttccattaatttcattaatatattaaatcaagcactttaaaaaaagtttaacacttagtctttggaatggagacattgttttcctgttatcactttatgttggagtaattccatttttccagcttaaaaaaataaatcagaagatatttttggcaagttttattgagagctataaatcagtctcactgatgtgttttctggatttgtttttcctacttcagttatagtgtggcatcatctgtttaacattggcccttgatttgaaactcattagaaatagcccaaagtgtcaatttgaagaatttaaaaagtgcacagttactccaaagatatgtgagtttggcctttgcatctctaaagttattttttcttttttttttttgttttttagattttataggagagggtggcagtattttcctattcctgataaatcaagtataaatctactcagatcagatctagaactaattctggtccagctgcatcttttggctgttattttgataacttcaaaaagcctctagaaaaactttttgtatttggctgggcgtggtggctcatgcctgtaatcccagcactttaggaggcccacttgaggccaggagtttgagaccagcctggccaacatggtgaaacctcttctctactaaaaatacaaaaaatttgctgggtgtggcggcccatgcccagctacttaggtggctgaggcataagaatagcttgaacccaggaggcagaggttgcggtgagccaagactgcaccactgcactccagcctgggcaacagagcaagactctgtctcaaaaaaaacccaacaacaacaggaaaacctttttgtatatagaaaaaaaagggagggggaatatatatctactgtaaaatttaaaaagtttaaaaactgtatcattactagtatatgtaactcttagattcttacagttcatcttggattgcatatgaagagtgaaacataaatgaggctgtgtatgtaagtccaaactacacaacagccctcctttacccacacaaacccaacctgactctgcccatgggttgttgctgtctctgtttcttttatggcccctgcctctctttcagcaggagcagagctcagtgccagtcatttctctaaggtcatttgctatcttggcagttgacatgtaattgtaactcctgtggctttttcttcctcctccttcacatctattattctgccttttatttacttttttagtcaaaacaaggaacctggactgtatttaaaaactacttggaattggccgggcatggtggctcacgcctgtaatcccagcactttgggaggccgagtcgggcggatcacgaggtcaggagatcaagaccatcctggctaacatggtgaaaccccatctctattaaaaaaatacaattagctgggcatggtggtgggcgcctgtagtcccagctactcaggaggctaaggcaggagaatggcgtgaacccgggaggcggagcttgcagtgagccgagatcacgtcactgcactccagcctgggccacagtgtgagatctgtctcaaaaaaagaaaaaaaaaagaaaaaaaaaaactacttggtattgttgttgaataaaaagctctccttcacctcttttcaatttaaagagctgtgtgattttaaaaacatttttcttcttaaaaactaacatcgtagctaatgaaatttcttttaacttgtgtctttcagttgattgtttaccatcctgtgggccagtggccattgataggaatgtccctccatacttaataccggagacaaactgctgagctatgatgttgaactggagtatactgaaagactgagtttttgactagctatgtaacttaagtaaagtggactaaatggtcttagaatgctgtaaatttctgtgattttttaaatgatacttgatcccaactataatatttaaatacaatattccataagcttctaaatagcactttcttatataatgaacactcttcctatgcttcattttgaaaagtcaaattaatatccttatctaaatgaaaaaagcagaaatactactggttgattgtagatccctttaatgattttttcatagttaagatcaattaaattagcccatttgataagagatatgaagttctaaaaatattttttgtaatcaattcttgggctctgctttgtttttcccatcccccccaaatttttttacatgaggagtatttgtacagcatataaaaattagaaaatacaaataagcaaaaagaaaaagaatctgatattttttaatattaaaacacagtcaggccgggcgtggtcgctcatgcttgtaatcctagcacttttgggaggctgaggcaggctgatcacctgaggtcaggagttcgagaccagcccggataacatggtgaaaccccatctctactaaaagtacaaaaattagccgggcatggtggcgtgtgcctgtaatcccagctgctcgggaggctgaggcaggagaatcatttgaacttgagatgtggagtttgcagtgagccaagttcacaccactatacttcagcctgggtgacagagtgagacttcatctccaaaaaaaaaaaactaaaactaaaactaaaaaactgtcaatcagttcacaggccaaaggtttgcataactttaaaacattgtagaaagacattataggaacacgttgctcactttttatagatactaagtgacatggttccagaacttgctcttcaaaaccatttttatctttatgagactcttgcaatcctcctggttatctgaaggattccatatttgtcttgattttttccattcttgaatttgtttagacagtgttaattaatgcacatgcacatacacttgaaataaacattctccctctcccctcctcctccctgcactccttccccgcctgtgccctgacagtgttggatgcttactactccttgttaggttggagtgctgggaatgtggattgggtagcttcttcccttctcttttccctgtagtggatgtaagtggtaaaaagactatgatgtcagaattataccatttgaacatgctcagagacatgccatacctacccctttgcctatgaagtggtggaggggatatgactgcagactgtggcccctccagagtgtagactctatctactacatagcaacttcctgcttactcttaaaccttagtgccacaaatgcagaatttgtgtacttgagtgagtgaaatgtctctcgtagaaatttatgtcaagccatgatgagagtgtagcttgttagttaatagtacaaatcaggttgttacggacatgtttagattacttagagaaatgttctaagggaattagccccagtggcctatttgtgcccaccaatggatactgctatttacgtttccttcattgatcaaagtaaaccaaacagcaactctgctagtttagcatctcgtcactttatgtgctacttttcttcatgctgctttaaaatttatcattcggtccagaataatgagattttattttgtttatgccacaccttttatacagcttaaaatattttttttctgtattagtagtataaaggtagtgatgaacagaattcccctcaaataggaaaatagttgccaattgttctggcatgtctttcattacttcactgaccctaaatataataattagctgattgtaaagggcatcagtctggttgtactacaattaaattgggtgctggattggcctttacacattaatctgtcaatattcttttaaggattggtaaaatggcttggaaaagaagctgtttctgttacctgcattgtactcctaattatcacagctctctgaagcttcaacttcagaaatgtgtagaaggaaaatatttcccttggtaaatgaacccttgctttattcaattggtggaagtttagagtagagcaaaatatttaaagctttgctatactggtctgagagcaaactattttttttccaagtgatattgaattaaaaactccatccattttctgcccatgcaaggcagtgcaattccctggaaattgattttttttttttttttcagggcttgcagtggctttccccaagctttagctatatggaaaagaacacctttattaaatccacttagtgaataaagttggcagttaatttttaagcatctggaccagtgtgtagaaaattactgaatgcatcaaataaagtctgactagtcttaaagtcatttgataaataattgtatagggagctctctaaactctaaaacattattttatgggcacctactattcataatacaaatgagagtagttatttgtggtataataggttttatagaaccttgaaaaacatgcaaacttatatataaagttacgaaaatgactttaataaaaattacatgcctatgtatttttcctttatgtattataatattcgactatatgtgcatcttaagtgcattgatttcgtgcttttccatcttcataatatgatttctgcctaattattgctgtatactagtttgttatttgcaaagaaaagctatatctactctaggaaaatcataaacattatttagtttgttaaatgttaattatgggggtcatctgaggagttttctagggctgatttatttacagatcatgcattagattactgagtgtgtgtgtgtattgtcttcctaagtttgactttggttatgtgcagtgctctttggcattggttatatgcagtactggagactgttttcttatcagtatctctgacctgacccttttgagctatgttgtatcattccattttgacaccttttatcaaactttaatgaaatgacccaggcaaacaaattgtcattaaactttccatcacttcgtcccttggtatcgtcttttataaattggacagcaaacgttgtattgatcttctcgtttttgcagctgaacttgaaatgacccagactgcttgttgtttatggcccagagttgcttttccttgacatttccatccacagcatgacaccctttttgtttttctttctttcttgtggagatgaatgaacaagacatacgatatcgggacactcttggtcatggcaacggaggcacagtctacaagtgagtagtcaattttgtttaaactttctatccgcttttccaaatactgagtatccaagttctctgtggcaaagatttttaaatgaccactaacacttagattttatttccatatttgactccaaaattctgcaagacatctattttctcaagaattgcctggaaagtgcatttatattgcctttttaatatttccgagtctgcaactctcctgggtgtgtagttaatagtccaccattagtaagtgtacctttaactggcctgaagtttaatgcatttttttcctttgctttttaacactattattattattttttaacttgctagtaccctacgctagtcccctgcctgtttacagttatgcccagtggaagccagaccttataaataccattgctttgccctgtgtcaacactataagttattaaaaagccttcttcctgttgtattttcttctctcctcaccctactcccctgagataatttctacacattgatgaatatgttaagttataaagttctcccaaattccagttgcagtgatcttaccccaaaggaatgttcattttcatcttaaaaaatgctagccataaaaaatagttctccgacagggaggtcttctcatgcagtagtgcaaagtttaaactacataatgtaatatctggtacttaatagtctgcaatggtgtatgaaaaatattccactaggaattaaaaaatccatactctgtaagaaagccctgagggaataataaaactttcctccagagagctggttttccatgtatacactaatcctgcatcacattatggttgtgatattagatcacaaccacagatactttaacattgatattaatatgtatttccagagttgtaaaataattaacttattttctaattggttacccatgttcttagaattttaagttctgactaaccacatgaatacacataaaaattgccctattctatgaccatgaaggttcacatcctaaaaatcccagaacatcccctactcattgatgcagccttggtatagaatttgatttctcaggcttagaagctcttttgaagtaatctgatccagtcacccattcagggcttcagtgccctttgcagatacagccaagatgtgagtcctttctcctgaatatagtcctttaagaacttatgttcacatgtttggattgttttttcctgcagatgactgagtattgtgaacagttggtctgaaaatgaagttcttccactatgataattcagagaaataaataataacatgtttcttacatgttccttgggccttgggcctggcccttaaaattgaggtccaatgtgtctaatgatttttgcggctactattctctttccctggatcatactagcgttccttcccacgcaacctccactataaacggtatcttttcatcttagtcttctcttccttacgatctgacttagatttttcctgtgttctgaaggtacttaagttcaggtacccatagaaaggaaagaggaagaaggaacatgtatactctgatttgcttctattgagttccctggagggagcacttttcaaagcttgaacctttcttcttaatgcctttatgctgatagccaaatataataaaacaggaaagatttctggcaactctttgtattccttttatttgcttcaaatggaattaaaaaatgtttatttagactcctaacctacttatctgtgttatttcaccaaacctttagttttatattaattgaaggtctattgtgaatttattttcctagcttatttctagaagggaagaagcataagaccatgaaaccccagcagaatttttacgagacataatattctagatgttgacattttaatcctttattttaaaacataggtttgtttgtttgttggttggtttgtttattttgagatggagtctcgctctgttgcccaggctggagtgcagtggcacgatctcagctcagtgcaacctctgcctcccaggattctcctgcctcagcctcccaagcagttgggattacaggcgtacgccaccatgcccagctaatttttgtatttttagtagagatggggtttcactatattggccagactggtctcgagctcctgacctcgtgattcacctgccttggcctcccaaagtgctgggattacaggagtgagccaccagacctggccaggtttattttttaaaagagggagtatacagagaagtggaaaaaacatgcccatcccccaagggaaaattacaacatgaaattatgttaatgttgtttttaaaattgttattttaaattgtggtgaaatacacataactcaagttaacattttaaccatatttaagtgtatagttagtggcattaagtacattcacattgttggcaactgttaacaccattcatccacagaactcttcgtcttgtgtaatcgaaactctgcacccattaaacagtaactcctccatcactctgttaatgttgtttttagctaagaagcatggctagaacttctcctttaattagggctactatgtcaaagggaccattcttctatatgtccttgccacaagttttttaatttgctagaatgctgtgtgtaacgttaggaatttatcctaagagctcatttagctaccgttgctaatgctcactgtgagtgttgtaagatgtaatgtttttgacaggattgcttatagatggtgaatgacagtatcctgataattttcattcttatatagtagatttcttataaaaagaaatttcatttaccttattgcctgtgtgattcttgagaggggcggtgaagataccaaattgcataaccgcttgtcattgatcattgggcatcatttttgctcaggcttcagcttgtattattgttcttatatccctggcttttagtacagtgcaaagaaatgatataatcattgataaatgaggatccactttactaaagtctctataaaactaagtgtttgatgtgttatgattgagtttcttctacactaagttcaccttaatggtgttgatgataaaaaatatggtttttcaaacagcatgattacattataggctatgctacataaactagatgaagaaaatattggaaaatccactcattggtaacaaaactgcctaataggcttattccatttttttctttaaagtgtaataaagctaataagtgcaaagcaaaagtttaataatgcagtcttattcacttcacttgatggaatgttgggaatttcaagggatattataatcgtgtaattacaatgtatatgatttaacagttgatacattttcctcctttaagtgtagatatccttcacagttgtacaatatgaaattctggccccagacatttaaaccaaatggtaatgtgaattctgtgtgctgtctcctgacgagctgtgctctatattatgagagtgacttaggcaggtaattttaagttggtatttcttggattactaatttgggctacatggaacataaaggaaataccttaaagtatggcccaagcctaggaagaagaaaagtttaggaaaagataatgaatgtattttccttgttgcctcatttcctaaagtgctgcaagttgctccaaaaaaataaattcaggaaagacacatgttctatttccctctgagagattcataatgaatttcaaaaactttgagaaagtagagaatagtatgtgttgtggttaagtgtgagggctctaagtttgaatcctgcctctgtcactaattagctacgtaacctttggcaagttatataatgtcttatgcctcagttttcccatctgcaagatggggataataatagtatctaggttgggcggggtgcggtggctcacgtctgtaatcccagcactttgggaggccgaggcaggtggatcacgaggtcaagagattgagaccatcctggccaacatagtgaaaccccgactctactaaaaatataaaaattagctgggcatggtggtgggcgcctgtagtacccagctactcgggaggctggggcaggagaatagcttgaacccgggaggtggaggttgcagtgagccgagattgtggcactgtactctagcctggcaacagaacaagaaaaaaaaattaatagtatctaggttgttgtgaggttaaatgagaagatccgtaaaaggcttagcactatgactgacacttattaaatgttaactactggtaatggtagtactaataatagaaaaattattcacattttgtacttcctaccttgacttggccatgggactcttttcttttttttttttgagacagagtctcgctctgtcgccaggctggagtgcagtggaaagatctcgtctcactgcaacctctgcctcccgggttcaagtgattctcctgcctcagcctccctagagtagctgggattacaggcatgtaccaccatgcccagctaattttctgtattttagtagggatggggtttcaccgtgttggccaggatggtctggatctcctgacgtcttgatccacctgccttggcctcccaaagtgctgggattataggcgtgaatcaccacccccagccagccatgggactctttttgataaacatctcacagaattatagttgtgttgaactaactttgagaaattctgcctttatattatacacattatacttctgtattttcttctattctgtagttgcttaatgaatcatgatatcttatgtattatcttaaatacaatgattttttaaagtttcaaagtatttttaatcctaatttattttcagattgctataggacagctgggttaagcccattttaccactgaaaaaactggggcttatcatgtggccattcagcagcaaagccagatttctatacagcatttcttttctttttgcttggtgttcttcccccaggcagtgttgtctcaaggtcaagcagagtccattttgttttcttgtgttttctcatgtacccagcacagttttaaggataaaatagacccttggtacatcttggctaaaatgagaatgaggcaagtggaggttttagtggggctctttcattggatcttcctcatatctagctactttgcgaggctgtacaattgttgtagaacattcacctagaagaaaaagaatatccacactgaggagattgatattcgaatgattaactttctttaaaatgttaaaaccttcagtgcttagtatctgttgactcactagttactgtctctttttcttgggtagtatgtcatatggaaataaaagtaattaacaggcatagttactttggaaacattgtttgattccaaagccagtctctcagactctgcttccttggcatatcatttgatggagtcactcaaactttggatctagaaatgaagtaatatttaacttttaggattaaatcatagtaagtcagttagccagcaatcactgaaagattatcttttatattattttttccttaatgccagttattcaagccaagactcatattttcagctttggggccagataatctagtctcaagatgtttgaaaactgaattttctatctccagctccttcccacaggatagagtaagagtctgatctggacttgaggtagaattttctcagtgatacaatgggtagtatatatactgccttcaaggtgttttgaaggttgaatgtataccattacttaggaattaatttgaacctatctagagacaataagaggagggaaggaattgtcattctcaaagatgctggtctctcctcctttctgttgccttatctaaaaagaggtatttgctgggcagtgggctggggatggtccttggaggtggtaactgagatcctgtggcctattaggttgtgttttgcacttgtgatttgactgtagaggccaactaaaacattaaattactgtttgggagctggaatcatattagctcattatagtaatatgatttatttaatgaaaattagaaggactgatggtcatttgtataaaatgagaaaatacataaattgtctagttaaatgctatttagtaaacagaatatttcaaaacatggaattccttaggggaaacagaatgaaaagagtccttggtggtgaaaatattgggaaccacatagtacccagaaaaccttgacttcctctttcaccaaccaacctgaaggtgtgaaacttaaagagggagcaagaggtctggacccagcttcgcttgtggctgtgttagtggccctactcctttatatatttttgcatgatgtgtatcttgtaaattaagagtagtttttaaatggttttaaaattgacctgagagctagaatgatggtttgatttattttgactttaaatttctaatcacttaaggagtcttttccttgcagccaagatcatattttaaagaagcaaacaagacatcatcctaatgcaaaattaaatatttgtatatgactggattgcattatagtatcgtgacaagcaaggatattaatgttttcagaaaatcaatgaatatttgtcaaataaaattaattatgtatgtttccttctctccttctctcagcattcattgttacaggtttgtttcatacgataatgtatattttattgattcgaatctaaggaatgaacctgagctcatggttctctgtacctttcccacctttgcttttccccacctctccatgttcctgtaacttcatacatgctcatatccattatggcaatgatgtattattggcatccagccaacatgacaggatgtcacaggtcgctgagcagagattttcagactcagtttccacccgaattaactattattgaaatagtttattgagattgaagtattgatcattttctgctaaccttggcttaagggaaggaagaagaggcagtagtgtttttgaaagacactaaatttcatttttaaaaatctcatttatttagcctttttttctttctgttttatagcctttattgttttattgcttggaaaagggtatcttggttttattttttatgatagtataattatacttcagaaatgcacttgattactatgggtaacaaaattgttctagtatattggtttggccaatattgctatacaaacaacttttcagtcaattgagtctggtaaaaatcaatacgttatggtaatatttcaagtaagaatttgctgaatctaagtgtttcaacttcatctcctctcagagaaaaaaatagttttgaagtggcaagacttctttctaatattttagtaacaattttttatttataaagacgtttaaagtccccagcaaaagtggttgtgatcaggtaaacattacattagcgcacttccgtgttgtagggtgtaagagatctaatttccatttgaatctattccctgccacaccaagaaggcataacatcagggactgacatagtgtctgtcacttttggattctggattcctgtatgtagttctgggtgctgagtttacagacatatggacagttcagagagcacccagaggagcaatggagagaataatgagggattggggaattgtgtctgttcagtcctccttcattcatctgtccagcagccaagttctgagcatgtgctgtgtggagggcgtgtcagatgttggggacagcctagcctcataaaacttgtgtctggatagatgaggaagttctgttctcaggtatgcacaggaccccacagtctggggccacctgtctgtgtgtatggtgcacagatctggggggctgaggaagaactgatggcttttagctttttcctcaggaaggatcaggaaaggcctcatggaggaactggcatttgagctgagaagtgtttgaaaggaattggctaacttttctctgagaaagagaagattaaagggctccatgacagctgacttaaagtctgaagggcatttctgtagatgaggagcaggtttgctttgtgttcttctgaatactagacacaaagggcctgtcttgaatgtctctgtgacagtcggcctttggttagagtgattaatgtactctttctactcttgttcccactgggttgtgttccctggaggagagtcatgtctaggttaccttggtgggagtcctcacagggccagcacggtgccttacctactgtaggcacttagtgagtgtttcaggaatttacctgcagaggcagattcttcacagcctaaggatggacacaatgtgttgttcattgctgggtgactctgggaagtggtgaactcctctaccttaagcagaatgatgtggctgttgttcagaactgctgagaaaagaattcccactttgacctggacatgagatgactgcacaggtgtctcccaagcctaaagtcccagaactaaattcagcattcagttaccataaaaaccttatatcaggtgttgcttggttttgtttagtctatattcatttttcactgaacatcctgtcactgtgccaaggactattccaagcatgtacagtccagttgtgaacaagataggcaaggtccctatccagaactcacactagtggggcaaacaataatcaagacaataaacactgaagtaagattatagaatctataggtctatagattctatagacctattctatagacctattctataggtctatagattctgtagacctattctataggtctatagattctgtagacctattctataggtctatagattctgtagacctattctataggtctgtagattctgtagacctattctataggtctgtagattctgtagacctattctataggtctgtagattctgtagacctattctataggtctgtagattctgtagacctattctataggtctgtagattctgtagacctattctataggtctgtagattctgtagacctattctataggtctatagaatagactttgcatattctataaaaaatgtagaagaggtgctcaggaagacctatctgaggaggtgctgtttgagctgagacctaaagacaggatggaatcagtatgggaaaatctgggagaagaaccttataggcagaagtaaccactcaggcggaagccctaagattaagataggcatgaacttgtgtaattggagtagaataagctctggggaaggtgtagagatggacagggcttgatcatgctgggtcttttagtccttagtaaatccttgctaagaaggtatgttaccctctttttacttatgagaaagataacgtttggaagggctaagtggcatgcccaagatcaagtcaagaataaaacttaggtcttctgacacctgcttcccaagccaaggtttttctgtttgccattcactctctgaatttcctaactattaacccaagttatttttggatgtaagatataaaattagtgtataaatttgaaagtcaatgatgtatcatctctaggtgttaattttagaggctttttagtagatgttaaaacgtccacttcttggctgacagttatgacaacataacttgttatttggtctaccctttgggtgtccttatttaccaaaaacttataatttaataattgaatccctggattaaatgtatggttgtgctagcaggggtggtctatttcttgatttataagacacgttacttttttatagctattttacagtatttgatgtgttcgaaaatcgtagtctcttggttggcatattgcacaagcaaatatttgtgtaccatagcatctagggtatttacttaaattgcttttttggaaaataattcactggaaagtccaaaaggcatttaccgcgtataactttctgccacagtttttttttctttgctctgtcattggttactttgatgtaggggaccatgtttctgttaaattgctgtcttactagagtgaaatatgtttaggttctgatttgtacactaacgttgaattggaggagcagtttgcaaaatttgagggggaatagcagtagagatttaggttgtgggtattaagcattaaatttttttaaaaaaacattaatttgctttttaaatgtgactttatatcatgttgtcttcttgaccctaaaatttccttacttttccttgtcagtatggcaaaaagaaagagagagtacagtggtattgctgaaagcagttaatggtttttgtcttgtgaatttaaataataaaatgaaaaatgttcacacaaaattagaacttgctttagggcacaatcaatatagcattttaacaagcttaatgtatttggaagatatgtattgtgtgaggttctcaaacatactgattctattacgacggttaactgtagcagcaaaatgtatcaatatacttagccaataaacataaaacttattaaatcataattaaattttcagaaaagttatctaaaaattatgaataaaatatattttacatggcctcagcaacaaaatatatagccaatgaaactttataagtggtggggtaaaatacatgggataaaattatagaatgaatttttaccatagacacatgtaccgagttaagtttgtgtacaccatttgtttctcctctcttttaacttcttttggaggtaattcttagtgagtatttgcagagcacaacagctggggtaactgaccgaaggggcaaatgagaagtttccctgctcctttggagtctcaagtgaaatgtttcaaagccctacctgcccttatacgtggaagatgccaagaggtactcagagtcactgtggttgcatttacatttctacagtgggcgccaatcacaagcttcatgttatggccccagctgtgtgggaatgtagctgagcacactaggtatcgtcatcctcatttgatttatgaagaaatggaaacacagataaatgaatggatttccctgaggattcagaccaagtcaaggataagatcaccactgaaacccaggcttttttaattcttagtcctttcccaatgccattcctggtaaataattacattttggctctaagaggagctagaataaacagaatatatgcaaacctaagaatttctgccagcaatctctagcagatatacttcagctgtactttgaatttttattttgtgcaccaggcacatgtatcttatagatgaccaatatgaacaaacagctgtctcccttcctccctccttccttggaacgtgtaatctctgaataactgattagctcaatgtcagaaatgtttgtgctgatctctgaacctcagtcagttcaacacatgacttcctggaaattttatctttggttttcttttttttttttttttttcactgccatgattttgtgagttagtttatgagtgtatttaaatcatttctggaatctaaatattttggacttgctggtctttataaggaagttagtttccctcctctcacatagacctctttctgctttctcctatctatcatattttaagagtatatgtgacaccgttaagttttaatcttctaaatggattggagaataacaccttcccttgactaacctcaaaggatttttaaaaacagaatgttgcctaatttttgagggagaatgttctaacacagtttatatatttttgtaactcaacaaaggtatctcataaagaacattggtggaattgggttttaaagtccaaatactttccttctgttgtccagaacatagctcctcaacctagaggcatagtgtcatgtgcagtgaagtcactcaaattccttcttattattggtttgaagatgactgtccctggatggtataagatatgatggtagtttgtgtcgttcagtttttacgttaaaggaaaaagtctctcctggtttcttttgaccctagtcatgatatgcccatttcatgaagtcttttatgcacaaaagtgcacaaaatgaagataaagtgcctctctccagcctgacaaaagccatttctttgcagaatggtagctgcagcgaaagtaaataaatgaatggacagcaatcacagcctagttgatgaaactgttcaattaaagcacaggcatttacatggtgtaatttccctaaattgccaatgagcccctttagacacaaccagtgttcaaattgatttcagcattgattttggctgaagctgataaatttctgcttgttagttaaagtaattttgcagaagactttgtactgcagtattgaagtgttcatttagctgatagttaggagttatttacagaggcctctactgttgttctgagatgggacaattccccaatcatcttttacttttaatttttcaggcttcagtataccaatcaataggtgattgaaactgattaaaacttatccaaccagctgcctatggcagtttaattagaagctggatgattcttaaattaaagttgtcttattttcattgcaaagccatcttccagaagagtaaggcaagaacagtgcagaaaacttaaaagactggctttgctaaggtatcttgcaaatgttaaatcactcaatagctattcctaagacaattcaaaaatgtatcagagagtttgcttttatggagattagaagtaataacatgcttacttgccagccaaggaatgtttgtttcattcggtcagagagattacctattgtataatgatacatgtgaaagaccagctgtttgggatatatctattatctcataagcaagatgaatgcttgagcttagttttaaacactgtaatgcaggatgaaactagccatgatgatatcctctgcatctgccccctggaaaccatcagctttgaatttatatttttattctgttttgaggtcttgattaaaataaatctccattgaatgaaaaacaaatatttttatataagttcatgttgacttgtcaacagtattgtgggcaggattatagaagagagatttttgctcctcttcagctccctagggaagcttctccatactcattttatctagtgtggacaatttcttgagtttttaatggaaacgggttaatatttttgtcataggggacatattacatctgatattacggggaagaagggaagaaatggctcacttttcagaggtgcatttactctttgacccactagggtactatttagtgttctagaagaggtaatttagtaaattgtaccccagtggcctgaaaaagttaatgcaactctgaaaagtgagccattcaatcgattttccctattgcttttaaaaaatcaacactgaccatatccagagaatgttgaagacaactgaaattagaggatctagaagcaaccagtttattttcacacaaagcttgttgggacatgcactggatttggcttcagaggacccagatctacttcccactccagtacttacagataggaatcgtgaagcattcagtaacctcaccaagccttggtttccttgtctataaagtggtgataataataatatttacctcacaaatttttgtggaaatcaaatagctttactatatgtaaaatgttttataaactataaagcacaatagaatattaattattagaataaggaggttttctgaagtagccatttatgtatctgattttggaaagtaatttattgttagttttcccagaaactgtgagcaaagattagatggttatcacgttgtttcaagagagagtttcctagctagtcaatcctcagggtatttctattttcccccacatatattgcctaacaattccagttctttcattccttctcatcattaggctttatatctcttgcttctctgtttgcccactacattatttcagaatccttgatcaagagatcagaatgactgtagtttccttgatctcagaggtatttagaccatatattaaaagacattactctagttgatgtggagagtgttaaaagcttgaatcaggccacatcaacttgtggaagaaatatggaggtagtgatgaccacattaactctgaggcaggtatgggagtaaaaaggggtatatagccggagtaaacagaaagaagaaatggcaaatgtagagttacagtagctttctcttattgaaaatctttctaatctagccaagttccctatatcattcattaggttgatttatgagccctatgtacaatcagttatcttgaaattaatatctgtgacctcataacatatttgacttgagacctaaacagtatgaggggctctgtttttttttctttctttctttctgagacagagttttgctcttgttgcccaggctggagtgcaatggtgtgatcttggctcactgtaacctctgcctgcctggttcaagtgattctcctgcctcagcctcctgagtacctgggattacaggcacgtgccaccacgccctgctaatttttgtatttttagtagaaacagggtttcaccatgttggccaggctaatctcgaactcctgacctcaggtaatctgcccgcatcggcctcccaaagtgctggaattataggtgtgagccactgtgcccggcctgtttcttaaccacaaattattttgtaatcagtagtcaagcatctgtaataggtttttaggcagaaagaaggttggcaaagactgctatttgaactagtatagtttacataaaagcttctttttacaactgctgtttactttggatttcctgttttaacagctagagcctggctaatgtgtttatctattatggaaggcaacaactgtcagtgttgatttccctgaaactatttgaagtatttctgtggatggctactttagtatgtgacagaatactaaaatttcgaagcttggccattagtcctaaacgtgttaataaaatctaccttcaaataaacctaaaaagaccaagcaattagaggattaaattttaatttaaaaatttaaatttatttaatttaaaatttaaaaattatatttttcattagctgaaccacagctggtttacatttagttactgaaaccatatcattgcattaaaaggtgacatctagagggttttaaaattaatctcgcaaggtactaaaagatttttgtttgtgtcagtatttgtgtactcatgagctttatacagcagagaagcgttctgcatgttttgtattggcttcagagttgttcagccttataatcttttgggaaaatgtaatacaatcaactctcagattccttgttttaagtaggagacttatagtctcatgtgggtatctcctaatagtttaaccccctcgatttctaccatcttctttctttttgttttagttttcctttgtgccaatgctataaagtctttgaaatggaaacttctaagttgaggaaagacttgtatcttgttattctaaatttacataaaagcaggggcttttttggttaataaataaaatgtcacacaaagagcaaagaagcatcatctgtaagaatagaagcatcatctgtaagtatagaaactgatgatcctacagtatattagctttaaccaatgccatgttttaataaggaagtagatttaataattgaacctgagtgagaccaactcttaactttctgtgccaatgaggagaattaagaattgcgttttagacaatgatttatttgtcttgtctcgatcaaactttttcataatgaatcagatctcagagagctttcttttcctttgtctttttacctctgccatgtctctgatggacgtcctataaatccctagggcattcagagaatagagaatcagggaatacaggatatctcacaagctgtgaaatctttgcatggaaaacaaagaactgatgttattatttgagagagtgaactatctctgcaatgagctaataacaaatacatttgtaacttttatttattttaaaatagcctttgttcaccgtttttcttgtcttctacctgttctctgagagacatagggagcaaaataaccatcactttctttcttgcttacctagaataagaccatctctttttaattactggttatttcttgagccaaatcctaaccattgctttcactattttagtgactggattattttcttaggtttcctatccatttggagaacctttcaacaattgataacactctataaataattcacagagtaattgtgtccctcttttcactaaccttctttgaagtacgttatgtgagaagtagaatttaagtcagtagcatttagttcatgtggttaatgaaggaagtgccctgtgtccttcatagaacagtggcaatactatcatttcagtgtccctgtgttgccattatgaataaaagtcattatacatgcaattacgctccaggtcttttctccaagaggcaaaaaaggggtatttccgtgctcattttgataactattttgctaataaattgacatttatgacataggatattgtcagttatgctgaaatctgaaatatttatagtaagattataggccagcctcccccattctttctttaattatatcctacctcacaatcactaggaaagcacatatgctccctattataaattctttctgctcataatttaaaataatttgattggaatatgtttagaacttaatatgcagaatagtaccatagaaaatagatgcctactttaattgtatgagattgtaccagctttatcagaaaatgtatgatcagctctaggttatttattttgtgaacaagagtcagctgggatgattcatattttttggttctcctagaatttgaaattctaagcataaataattttagtaaacatggtaaaatccagatgcagttgatcttatgcatggcataaatttgtgtgggagtccagatgttggaatgtgaacacaggttgtttctcccttctgtcttgtgtggactttttaacatgttattttcacatatttattttccttacttttatttattttttgatacagggcctcactctgtcacctaggctggagtgcagtgatacgatcatggcttactgtagcatcaacctcccaggctcaagtgatcctctcacctcacgtcccaagtagctgggaccacaggcatgtgccaccatgcccagctaatttttttaaattttttgttgagatgaggtatcatctatgttgcccaggctggtcttgaactcttggactcaagcaatcctcccacctcagcctcccaaagtgttgggattacaggtgtgagccactgtgccctgcctattttccttacctttaaagattattctagaaattcagtttattctttgtaacgatgtatcttttaataaattcgcattaacagtttagatgaaggtgagcacacctctaaccttttatgtattgtactagactcatctttaacatttcaaggagtaaataatataatcagttggatttatccctaagtattgcttttgaaatcagtcacatgttttctgaacactttgtgcaaagtacttcgcttggcagtgggggagatataacatcaactttcatggcctcagggaccccattctttggggtctgttgttagcttactgtttgtaccttctcgtctcctttactgttttcttcgcatctttctgacctctgaatttagagagcctcagttccagtccttacacctcttctctgtttaattcacttcctaagtgagcgtgtgtagttccatggctttacatatcatctgtatgctgaggaagtccagatgtatgtctgtagccctggcctgtgtcctgaacttcagactcatatctgattaccagttggatgtcctctaggcatttcaaaattatctaaaactgagctctttatttctttggaaacctgcttcatttacagcttctcccatctccgtaattggaaactctattctataggatgctaaggacaaaaactttgcagtctttcttcctccttctttttctctcagattatgtatacctttacccacaaatcttgtgggttcttcctcaaaaatatttcaagaagctgaccacctttcatcactgttttcttgctaccctattcaaaaccactattactgcttgctaggattttactgcaaaagcctcccaactagcctcccagtttctatccttgctttcctgtaatgtgttctcttcactcagcagccaaagtgatctttctgaaatattaggtctccccctctgctcatgacctcttatatcacttggaataaaagtcagagtcctcaccatggcctaaatggtgctacacagtctgttttccttacctctctgacctcatctcccccagctagccctcttgcttattctacttctgcatacatgtcaagcacacatttccaccttgggcttttgaacttgctgtttcctctacctggaatccccttcccctagatgtccgaatggtgtgcccccatactgctcacatgtaacctgaaaagagaggcatttcctgacttcctccccaaccctaatatcaaatagcatgtccctaatgttgatcagtctctatatccttacctttatttttttcaatgcacttacccccacctcacatattgtatatttatttgattattgtcagtcagcccctattagaaggtaaacttcacaagggcagggacttggtctcatttgttctctgctgtatccacactgcctagcttattgcctggcaatcagagacatgcattaagtattaaatataaaaagaggatctaggaggagaatatatcatatactgtggaagaggtcaagcatatagtaatgaacaaaatggaccctgaccttccccttgaaacttacaataaagtagaacataacatagaccctatattaagaatttacagcatagttaggtaattagagtctacaatatagttaaataaagtgaacaccatttctgtaatcccagcactttgggaggccaaggcaggaggatcacttgaggccaggagttcaagaccagcctgggcaacatagtgagaaccttgttctaaaaaaataaaaataaaaattagccagccatggcggtactctcctgtagtctcaactactcaggaggctgaggcaggaggatcatttgaggccaggagttcaagaccagcctgggcaacatagtgagacctccgttctgcaaaaaataaaagtaaaatttagctaggcatggtggttcactcctgtagactcaactactcaggaagctgaagcaggaggatcacttgagcccaagagttcaagtctgcattgagctatgattgtcacactgtactccagcctgagtgatagagtaagaccctgttgcttaaaaaaaatatactagtaggccatgtgcagcggctcacgcctgtaatcccgcactttgggaggttgaggcgggtagatcacctgaggtcaggagttcgagaccagcttgaccaacatggtcaaatgccatctctactaaaaatacaaaaattagccaggtgtgatggtgggcacctgtagacccagctattcgggaggctgaggcaggagaatcgcttgaacctgggaggcagaggtttcattgagccgagactgcaccactgcactctagcctgggtgacagagcgagactctgtctcagaacagaaacaaaaacaaaaaaccactactgataaagtatatacctgtgaatttaaataactgttgaagagaaatagtaatttataacacgaacatataaggcaatagagtagttgatgccaatagataaatgaaaccacagggtaggaaatctagtaggtagggaagtaagtagaaataaaagaatggaatccaattgaattcaggaaggaataacatgaaagaagaaatggtgaccatttaagtaaatctgactgtataagacaacgatagtaataattcaaaatgaagttaaaaagactggagaaaataatatgttaagatgagaagggcttgattgaagttaaaacattctaagatttttatattgtttaggagaaggatatagataacaattaactttatgttttgttaagtcaggtatgattgttaaaaattatacgggtaactaaaacagtgaatagaatgtgtaacttcaaaacaaatagatggaataaagggagaataattcagtataatagaggaagagaagtcgataggtgtaaagtaaatgaattaggtggtagaaataaatccaaatatatcaataattacaaaaaatataagtagagtaatattagcagctaataggttaggttgcattttttaaaatacagttatgtgctattttagactgtattgggagaaatttctaaaataccaagacacagcaaaattgaaaggaaaagggtaggggaagatacctggcaaaaactaatcaaaagaatgctgctactgtggttatattaacataagacaaaatagactttaaggcaaaaagtattactagagaaatgttatgaaaatacaaatatttacaactgaaccacaaataccatgtattaatatgaaaactcctgagatgcaccaaagtaattcttaaaggataggtttatatacacaccttagtaaagaataactgggtatgatatgcttagaatctaactcaagaaaatcaagaaggtgggacagggaataaacccaaagaaagtggaaggaaagaaatactaatgaacaaaagtttgaaaaaaaaaaaaaaaagaacaaaagttaattaagtgaaaattcaagaaacaattcaacaaaaccaaaagctggttctttggaaaaacttaataaaatatagcagtgagaagcagaaataacaaaattaggaataaaaagggaacataattctatacataacagtgattttaaaaataataggatccagtgaataactttatgacaataaatttgaaaacacaaaatggccagtttcttagaaaaacttaatgaaattgtcttaaaaataaaaaccaaaatagacctagagcaatcaaatgattatttgtaaaatgtgcctgatgtagttttaggcactggaaataatagcagtgaacaaaaaaaacgaaagtgtgtgttttcatggagcttcctttgttgtggagggagacataataaattaataaattttatcaggtgttgctaactctgtgaagaataaagaaagtggccgggtgcggtggcttacgcctgtaatcccagcattttgggaggccaaggtgggtggatcacctgagatcaggagttcgagatcagcctggacaacatggtgaaacaccgcctctactaaaaatacaaaaattagccgggcatggtggcacacacctgtaatccctgctacccagaggtggcagtgagccgagatcacgccactgcactccagcctgggcaacagagtgaggctccatctcaaaaaaaaaaaaaaaaaaaagaagatgaagggagaatgtgctgaagggagaatgtgctgttttatgtaggaaagtcaaagaaacaatataggacctgaaggaagcaatggagcaaaccaggtatatattggagaaagtggcccagccctcaggagtaggtgcaaaggccccgaggcaggagcacgtttgatggaacagagttgagtattgtgcataagggagactggaagaagcagagatcagtgaggtaactaaccagggcccagatgatgaaatccttataaagacttttgattcagcagttagaaatctacccatgaaatggagatgagtataataacttctactcataagattatgaagttaatgaattaaatgcatgtggatttttttttttgtaaaacactatccaggtgattatttttttcatccagaagtagtaatttgtcaaacatttatgaagtgaggagcacctaccatgggccaggacatgtgctaagcataaagaatagaaagatgattaaaacatggcagcgctcactgcccagtactggggacagacacataaatacttttctgtagtgtgccaagggcaataatagagcatgtaacatttgaagagtaggagaagcatcaaagtttaactttatagcgtttataagaaagtgtatgggctgggcgtggtggcttacgcctgtaatcccagcactttgggaggtcgaggcaggtggatcatgaggtcaggagattgagaccatcctggctaacacagtgaaagcccatctctactaaaaatacaaaaacaaaattagccgggcatggtggtgggcgcctgtagtcccagctactcgggaggctgaggcgggagtatggcgtgaacccgggatttggagcttgcagtgagccaagatcatgccactgcactccagcctgggcgacagagcgagactccgtctcaaaaaaaaagaaagcatattaaagggaggtatataggtatttttagggtagcttatgcctcatattttcctgttaacccaaggagaatgaaaacttggccttctcatgattgtttagtgacgtttctgctgagattaacacctgaatggcgtacttaccacacctatctgtagtgtgaataaacttatagtagtgggcaagagataaacatggtaagaaatctagaagttggaacatggtatatccataccagatggctcttttaattgtctccaaagttggttcaacatgaagtaatactacgtgtttaagtttttcttaacaataaatgatatattgcaaacttttgccagttctttgttgttaaagctttattagagggtcatttgtagagcatatagtctaactagcacgtagagacactactgctctttaagtctgttttggcagctttcattctgaaatcactcagccagtttgaaaacttactatcttcctttttttttttttttagacggagttttgctcttgttgtccaggaggctagagtgcaatggtgtgatctcggctcatcgtaacctccacctcctgggttcaaatgattctcctgtctcagcctcctgagtagctgggattacaggcacccaccaccacgctgggctaattttgtatttttaatagagacggggtttctccatgttggtcaggctggtctcgaactcccaacctcaggtgatacgcccacctgggcctcccaaagtgctgggattacaggtgtgagccaccgcccccggctacttcctaccttcctaacatttaattcattagtcttatctcattggatcctcacaactctataagggagagactgctttccctattccagactagagataactgagacttggtggggcttactgacagtcaggttcacatgtttaagacgtgggagagctaggccaggcgcagtggctcacacctgtaatcccagcactttgggaggccaaggagggctgatcacaaggtcaggagatcgagannnnnnnnnnnnnnnnnnnnttgcctggagcaatttggatataatggtctttggcctgattgaaataggtcagtacctttgtaagttttgaattatatgtttccctgccctagaatacaggtaaaaaaattaaacatcaccgatctctttgtgtgtgtgtgtgtgtgtgtgtgtgtgtgtgtgtgtgagtgtgtttgacggagtttcgctcttgtttcccaggctggagtgcagtggtgcaatctcagctcattgcaccgtctgcctcctgggttcaagcaattctcctgcctcagcctcccgagtagctgggattacaggcatccgccaccaggcctggttaatttttgtatttttagtagagatggggtttcactatgttggccaggctggtcttgaactcctgacctcagggtgatccacctggcttggcctcccaaagtgctgggattacaggcacgagccactgtgcccagccaaacatcaccatctatttcctttaggtcctaaaatatgcatattctgtcgcggctcatcttggctttgccactgactgtgtgagcttggataagttatttaacctggcttttgggtgcttctgctgtgaaagaaggggattaggttaaataattttctctgttttctactagctcaataaattatctgattctgtaccaagattacaagttaagaccaacttctttgtctggtcatctataacctattgttacaaatgaaataagaaagtatggatagaaagtattcgcttgcactgggctctttgttattttaaatatttgaaaaacttacaccaggcgactaacttttgccatggtaaagtgtatgtgtgtgtgctcaattttaagggctgagactgttcccagaaggcctgtgctggtcacaaacaaaatggaacactcaaggaccaagcactaaaaatatctcataaaaatgcttcctccatgcagtcattgaatcaggtaattactgtggcaacaacaaactaatttgaagtgttagctgttaattaaaacattgcagaggtgtatagttgtcttttggtgtaagcagagcctccattcaaacttcattaatcactttacaattaatgtgttgaggaaggtcaagacaattgagatgtagtatctgttgaaagtaaacaaattccttttctctaagtaaataccatttggaaagttaagggacacactcgactcatgcctggcattgcctttgtcatccagttctccttgatgattaaatgttaaattggtactgtcattgcactgtaaaccaaaccacatagcatctttattcctcgaaatcgaacccaaacttccacggatgaattagcgtgcatcataattaaattatcaagcctctccttttaattcacttggaaataggacacctttcttttagaaaagagatcagctttcttgacaagctaattaagttgccaaactgtccagtatggtatgtatattagactatctgctaatcattttcttatcgctgctgctggtctcaaacgtccaggtgttgcttattcgaagtaacaacactgatctttttacaacttttgaatcctgtgtatatatttaattatttgtctttatatttcagttcttgattagtgattcgaatatataatatttttaaaagttggaattggaagaatctgtgatgtggagggggaaaaataatatatcacaaagtcttacgtattatgttacttggatttacgtggaataaacttactaatttcctttaaatcacatttcaggccaagtgcggtggctcacacctgtagtagtctcagcagtttgggaggccgaggctggtagatcacttgaggtcagaagtttgagaccagcctggccaacatggtgaaaccttgtctctatgaaaaatacaaaaaaaaattagccaggtgtggtggtgggctcctgtaatcccagctccttgggaggctgaggcaggagaattgcttgaacctgggtttcggaggatgcagtgagccgagattgtgccactgcactctagtctgggcgacagagcaaggctccatcttaaacaagcaaacaaacaaaaaacataatgtaggggatagggttccacttataaaatgtgtatcactttgtacaaagtataaaaaattattttgctggcacagtggctcatacctgtaatcccagtgctttgggaggtcaaggtgggaggatcgcttgaggcttggagtttgagaccaacttgggcaacatggcaagacttcatctcttaaaaacttaaaaaaaattagccaggcatggtggtatactcctgtagtaccagcggtttgggaggctgaggtgggaggatcgcttgagcccgggagttcaaggtcacaatgaactaataagatcacagcagtgcactccagcctgggagacagaatgagacctgtctctgaagaaaataataattgattaagttttattattattttctatatctttcagacagagtctcgctctgtcacccgggctgtagtggagtggtgagatcatagctcactgcagcctgacctggactcaagcgaccctcttgcctcagcctccctgtagtccctacagggggactatagaggactacaggcacgcaccacgatgccaggtaattattttattttttttaaaagacagtgtctccctatgttgcccaggctggtcttgatctcctgggttcaagtgatcctcctgcgttggcttcccaaagtgctgagattacaggaatgagccactgtgcccaacctgattaaagttttataagtagtatttagaaataaccaatgaggttgttatttgagaatatctttagacactttcaaaggttaaataattctttggtaaagtaaacagttgtcacccggtttttgtaatcttgctttttctttaaatgaaatatacttgaatttctgtataattaattgatataataaaagttaagtttaccttccatgactggcttgacctttgtccactcaagttggaaaagcaaaatgagtaagttcttataacactcatatatttggataagtatatacatatgctttatatatgtagtttcctagtcttgcctgaatttgtaacattttacttgtaaacgatattacaaatacctatatgctcttaataactaaatcatttctataagtcagtcaccttcaaaaaactcttgtcagtgattgttcaactctgtaaatttactaaaaagtagaatgtacccttaaaacaagtgaatgttatcatatgtaaattatatctcaataaagctgttaaaaaattttgtcagtcctttctgctcgtggacgccacagaggaaacatcattaaagtctctgttctccctgctgtcatgtctaagtcagagtctcctaaagagcctgaacagctgaggaagctcttcattggagggctgaactttgaaacaaccgatgagagcctgaggagccattttaagcaatggggaacactcacagactgtggtaatgagagatccaagcaccaagtgctcctggggctttgggtttgtcacatatgcccctgtggaggcagtggatgcagccatgaatgcaaggccacgcaaggtggacggaagagctgtgggaacaaagagagctgtctcaagaggggattctcaaagacccggtgcccacttaactgtgaaaaagatatttgttggtggcattaaagaagacactgaaggctgggtgcagtggcccatgcctgtaatcccaacactttgggaggctgaggtgggcagatcacgaggtcagggatttgagaccagcctggccaacatggtgaaaccccgtctctactaaaaatacaaaaattagctggtcgtggtggcaggcacctgtaatcccagctactcgggaggctgaggcaggagcattgcttgaacccaggaggcagtggctgtggtgagccaagatcgtgccactgctctccagcctgggcgacagagcgagactccatctaaaaaaaaataaaaataaaaaataaaaaaaagacactgaggaatatcacctaagagattattttgaataatatggaaaaattgaagtgattgaaatcatgactgaccaaggcagtggcaagaaaaggggctttgcctttataacctttgacgaccatgactctgtggataagactgtcattcagaaataaccatactgtgaatggccacaacggtgaagttaggaaagccctgttaaagcaagagatggctaatgcttcagccagccaaagaggtcgaagtggctctggaaactttggtggtggttgtggaggtgtttttagtgggaatgacaattttggtcatggacgaaacttcagtggtcatggtggctttgatggcagccgtggtgatggtggatatggcggcagtggggatggatggctataatggatttagtaataatggaagcaattttggaggtggtggaagctacaatgattttggcaatttcaacaatcagtcttcaaatttcagacccgtgaagggaggaaactttggaggcagaagctctggcccctatggtggtggaggccaatactttgccaaaccatgaaaccaaggtggccatggcggttccagtagcagcagtagctacggcagtggcagaagattttaattattgccaggaaacaaagcgtagcaaaagaggagagctagagaagtgacggggaagctacaggttacaacagatttgtgaactcagccaagcacggtggtggcagggcctagctgctacaaagaagacatgttttagacaaatactcatgtgaatgggcaaaaacttgaggactgtatttgtctaattgtataacaggttattttagttcctgttccatggaaagtttaaagcattccaacaaagtgatctaatgtagattttttttttttgcaccatgctgttgattgctaaatgcaatagtctgatcatgatgctgaataaatgtcttttttaaaaaaatatttgtcagagcaaccaaattttctgctaaacagcagaaaatgatgtttccatgttggcagtagtggattatgtaaattttggttttatttttgttttaagaaaggggaagtttaggggctcattaaatatgttttacaactgggcaggtgaagatgaggaattcctgaggcactgacttctgttccccattttccctatgccattcctatcctaacaccagatgagaggaagagccgtctgatcttagctagtgtataaaatcctctatagggcaagatttttagttcttcgaaacttacttacttccttatattaatatttttatgggcttgcaataacaatgcttgtttatgttatgtggtttattttgaaatttttattgtataaaaatgtgttgcagattgcttctaaataatgttcagaatatctagtccccacagtatatgtgtaaaggccacatttcatttaa

SEQ ID NO: 1503 - DNA, 2083 bp, Homo sapiens
agcgttcgctcaactccagaaccttccgacctccgctagttcctgcgggcctttgcccgcttcccggtgcaccctccccgggagacacctcagacccccgacagcctgggcaggctcggtgcctgcgggtgcgttcctgatcacccctcccctcttccctccccctcatcctccattcccttgttttcaccctctgtcctctgcccgtcactccccttgtcacctcttggagccccctcctaaccagcggccagtgggtttcccataccccaggatgtgagcctctttaacctgtaatgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtgaggctgccgcagggcactgaaagcccaggaccagtaaccaaggagaacaacccacccgtcgcccttctccgtatgctgcctgcgccagaagagctttgctgggccctggcttccctgccctcgccttcacctctgtcagcaggtggccttgcctggggagccccatgtgtggcccaccccaccaggccatccccataccttctggtttgaaggcgctgacactggcagagaggtaaagggtggggcattgagaatggaggctcccagggtccctgcccacttctgttttcctaatgtttttctctataaagggtcaggcccgtcagcatcactgatgggaataaaagtattaatgctttgtgacagcctctgcctgaaaactggacagaaggacccagaggtgttctttcattttctctcttacctccaatctttcccctttcaagctacaggtaaaggctctaccaccat

SEQ ID NO: 1504 - DNA, 1317 bp, Homo sapiens
atgctgtggctagcccttggcccctttcctgccatggagaaccaggtgctggtaattcgcatcaagatcccaaatagtggcgcggtggactggacagtgcactccgggccgcagttactcttcagggatgtgctggatgtgataggccaggttctgcctgaagcaacaactacagcatttgaatatgaagatgaagatggtgatcgaattacagtgagaagtgatgaggaaatgaaggcaatgctgtcatattattattccacagtaatggaacagcaagtaaatggacagttaatagagcctctgcagatatttccaagagcctgcaagcctcctggggaacggaacatacatggcctgaaggtgaatactcgggccggaccctctcaacacagcagcccagcagtctcagattcacttccaagcaatagcttaaagaagtcttctgctgaactgaaaaaaatactagccaatggccagatgaatgaacaagacatacgatatcgggacactcttggtcatggcaacggaggcacagtctacaaagcatatcatgtcccgagtgggaaaatattagctgtaaaggtcatactactagatattacactggaacttcagaagcaaattatgtctgaattggaaattctttataagtgcgattcatcatatatcattggattttatggagcattttttgtagaaaacaggatttcaatatgtacagaattcatggatgggggatctttggatgtatataggaaaatgccagaacatgtccttggaagaattgcagtagcagttgttaaaggccttacttatttgtggagtttaaagattttacatagagacgtgaagccctccaatatgctagtaaacacaagaggacaggttaagctgtgtgattttggagttagcactcagctggtgaattctatagccaagacgtatgttggaacaaatgcttatatggcgcctgaaaggatttcaggggagcagtatggaattcattctgatgtctggagcttaggaatctcttttatggagattcagaaaaaccagggatctttaatgcctctccagcttctgcagtgcattgttgatgaggattcgcccgtccttccagttggagagttctcggagccatttgtacatttcatcactcagtgtatgcgaaaacagccaaaagaaaggccagcacctgaagaattgatgggccacccgttcatcgtgcagttcaatgatggaaatgccgccgtggtgtccatgtgggtgtgccgggcgctggaggagaggcggagccagcaggggcccccgtga

SEQ ID NO: 1505 - DNA, 27587 bp, Mus musculus
acatacacacacatatatatacatacatacatatatacatagatgcatatatgtagagaattgcaagccagttatctctgaaatcttttatatctgttgtttagaatcttaggtgcctatgtgcttctaaatggctgcagggttggggaagccatactgcctttgttgactcttattttccaccgtaaagttcaggtctaaaacagtcattatttccagaattccaggctctgacacctacccagaagagtctgtgcatgtcacaggagccctgagcagcttgttcaaatgtttcatatttacagagagcagcacagataagataaatgttttgctatcttcttacatgttttgaataggaattcagatgatgaagactcaggagccctaagatctggtcattggattaaaaagcacatatagagaacaatatatcagggtagccagattgaaggagtcactgtaacttaatttatttgtgtaatcttatttgtgagtttatacaatgaagtgattaaaaatattatgctcatgtaaataattcttttataactgttttccatatttgaaaattgaattacggtcataatattcgtgttgaaagttaataaagataactgctctttcggtactagaataatgcagtttgactcttttgaatggctcagtggtatttactatgataccacttctgtttaatcaatttgctctgccatggtgtcctatttctagaaaaccggaggacagttgtcgtcctatacatggtagacgggactgatctcaggcttatgaggttgtgtgtttaagagtttcagctccacagtggaatctctgggaggtggggctggattacacaggagtaggcaatggctttctagacgtcttaaaattaccattcaccctcaacacaggtgacctaaggatatttcagtctccagcggcttcctaaaactctgccctatccttttgtctcctcctgattgtctctgtgggaggccttatccaccccttaagtctaacatttctgaaacaatccatcagttccttttctccaaacagatatcatttattaacttacattatcaacggtgcctcaattcttgcgcttagcggcactggaacttgggtgggtttccactcatgcgcactgactgtcagtcagtccagcgctggtgctttgctccacccatgcgcactgactgtcagtcagtccagcgctggtgctttgctcatccttttgcagctcaggccttgccagctcacatctgttatggcaacagcctcactgctctgaattgtccttaaccttccatcatactatcgtgcaacctctccccgcagggagtcgggagaggtgggactccattcttaccttagatgtgaagagtcctggaaaaatccacgcgccttttcttggtatcaaagccccctgcaccccgcatgattggtgtaaacataatacctatttcgtccttaaataaataaaattccttgttactttctgataaacccttgcagtaaggtcatttccttaatcttgtcctatctcaatttgctgtagacttcatggtccagctcaggactgctctgtatataagcctccagactcattgcttctgtgagcttttccttggaactgtcaatgactctatagaattcatgcactgtccatgggtttggagtataactgtgaacctaccagggctttcttttatatctttccatttccaaagaaccaaataatcagagctcattatttaaacttgctgaattaatgactttgtcatggaagaatttagaatatcagagaacaattttctgactaatcaaattttgttttcagagtgtatacattaattattctgacaaattttctctcctagaaatgaatgttttatgtctcagtactcatatggtttttttgtttgtttgtttggttggttggttggtttttgcaccggaactttctgacagttgcatataggacagtaatattttaaagagacaaagacaagtgtcttctacattattgtacatgtgtatcatattgttcagtgtcatttttgggaggagagattttatttctgccatgatttcatataaaaatgagaatttcacaaaagcagttaatggaaaatgagagaaaatgaccataggtttttttttcttgaaaatttaccttgcatttaaatttttaatatgattttcacctgtgtcatctgtctgtgggcatccaaagcactgtaggtcatagaacagagttaagggtatagctttgataagtaatggtccaaagtgattcatttagtaaatttattcatcatatttctatttctgttttcattggcacctataatcaatttgtaattgcctgagttgaatgatatttgttttgttttaaaatattatgtactattaataagatttagtgtacttgatacagttgatagcaatgacatacagtcttggacaaggttagccggttagcttttttttttttttaaatcaacaatagtcatgctttgtcacagtggtctctactactcttctgtttccttctgactctggcaactcctgtcttcagatctaacagtggtcacagctgtggtgctgcatgccacaggtgtcccctgctcctgttggcttctactctctcacaatttgaacagtgcatctttcataaacaagcctgcctatgggtgccagtgacttaacaggccacgtattttcagttggaatcccgaaagagacaacatacatgcttgtatatcatattgttgaaattcatttaaaaaaaagattttacttataccatgctttcttttaaaaatgagaagaattgcaagaaaacagttgatggaaaatgagaggaaataaccatagttactttgaaactatttacctgagctacaagatgttgagcccccagtatgacttacaggctcaagaacaagcactagattggctcatcagagagcctgtaccttacagagtctgaaaggaagctagtggtcagggggctagaaggtgaaggatatcctagtcccaaacaggaaatacgtttggaggaaaattatagtaacttaatcagatctgtggtcaggacccaggcattctttgccagggcaaccaatgacgtcttcataactggctacaaacacgagagtacaaagcagccaaacatagcctcgccccctatctaacatgttactaacacatcaaattctgttcacttggaattttcaaaagaaaacaccagaattaggaagctataacttcatttttcccccaaatgtatagaagtgttgtgatggaaataaatggaatccattagaatctctagaagaaaaatcaatttctaattaagtatgtataatatctttctaatatcatctttagcatgccagtctatgcttcagtcttgagtcacaccagccttggtgggccactttatttcactatgatgcttatgatataaaaaaagaaagacagaatattataaatttaaacatgatttaaaatgtaaatctttttagttaaggattcagccattaaaagttggactgaaaggtaactttatgagctgattgacatatttttgtacatggagctaaaatgaaatggaagagctacaatggataagcactaattgtaaagtagaaattctttatgaaaagcagtttgtataataatagtgtttgtaggtctcatctgagattcatctatgaatctgtaggtctctcaaattgtgcgcaaactctttgtgtgtagttatccctcgttatccatggagaacatgttccaagactctctgtagacacttgaaatcctagatagtaaaactctgtaaatgaatgtctttcccatctttgccaagcccaccacacactgtgtctgcaacttctgcagtcagaggtgtaacagcaaactagcctgactttccctccttagtgtgaatcctaaatacctcagcatttgatctttttttttccttattaattatagaaatttttgccagaatcaccgttcgttcactgcaggtcattattaagtaaaataaaggtagtttgaacaaaaccagtgagatatctcagtggttgatctgatagctcagggaacaatttcatggctaactggtgattgtgcatagtagaacaaccaactaaagggataattcacatctcaggtgactaacattgaacctcatcacaagagtgatgccaattcaaaatttatgaattgtttatatctgaaatttcccatttaatgatctgggtttacagatgaatataggtaatagagactgtggaatggaaaatcacagacaaggaagagctagttggaaccatacttcctctaaatatgagcacaaaactgatgttgtcttgtcgaatgaacaaagttgttctttttttcttctgttcatttatgattgaaagtatcagtcacgaataaattacacattagctctttagtattttgtgtgactttgtttgaaaaaaaaagtcatttatttttgttttcagtagcctcatctataaaacaagggaatggctttagataattttcaagttccttccagctgagatctctctctctctctctctctctctctctctctctctctctctctctctctctccatacagaactccactaaaatggtggagaaaatgaagtttactttggtccagtcctcttgccattcaacttaccgactgctaaatagtaattcccttgattctcacatgaagatctcagtatcagctctttgatcaagtccagactctagaggacctaaaaccaaccactggaattatgttagaatgttgatgcagtgtgtcagagggaaaggaacaatagaccaaaatctgttgggaggcttgagttcaagtctcaaaggctgctcatttgtcttgaacttggactcgtcttataggctcatgattctaaactactatgttccctacattgtattttatacttcatattctttgtaaatacacaatttagcttaactgggaggtgtgtgtttgtgtgtgtgtgtgtgtgtgtgtgtgtgtgtgtgtgtgtgtatacatccttttaaggtcaaagttctttgatgtttgatcaccttagagatgattttccagtgcacctgtacagaggttggtttggttcctaagcatagtaattgacccacttagaattgatgagaaggaaagaagttgtttttgtaactattgcattcccttggaaacacaatcaattgtcaaccttctagaagccagttctaccacaagtttcacagactattggtgggaactctggctctcacagccttgccctgggctgcagataagtgctttctcacctctgcccttagtcttcatgtcacctggtatagagcctatttgtgaggaaaagagtcttgaggttactgcttcctgtctccacagctttggcttgtttagctgctaggagaggctttgaaaagcaaagcacaaattcaccatcaaaacaacctgatgattggtagacatgccagccaaggcagtcttttactgtgttgagtgaatgcagttgggagagtaacgctgtttcttgtgggtgtagcctaggtaaaccactcacaagaaggaaaacagaatcaaatatttgcagagggaaagaaagatagttcctagcatggtttagaaaacaacacatcttcaaacagaagtccatagaggaaagctaaatgtatctctagttccttccaagtcggtgcttctcaacctcactaatgtggtgaccctttagtacatttcctcatgttgtggtgaccccagccatcaaattattttgttgctatatcataactgtaattttgctactcttatgaatcacaatgtaaatatctgtgatgcaggatatgtgatattttaccctcaaggtggtcataactcacaggttgagaaccactggtctaagtctaggtatgtccttaaattttataatattcccttaaattatttgaaataccacagatccccagaaactccaaaaaacaaaccaaaatacatagccaagctgaccattgtcatgtgcttcagttcatctgtatctttgtgctgtactgctgtagggtggagatggatctcttcacgcatgctccatttttaagggaaattaaaaggagctagtagtatcatacgtattagaaaccacagtgagtacacatggtcaataccatttaggacaactgtaatctttctttcatacctaaagaaacctattttatttcgtgtgtctccagagaagatgtcgattctgaggtcctgtcaggtagcttctcacggggaataaattaaggtgggactgaaatctagaaattgtattaacatttaaaaagaggtcttatcagctcaaatcctaagctaggaagctgttagccacatatcagcacaatacaagaaattaccttgactatagcatctctctttaagcatcagctaatctaaaaattatctgtcgacacagaagagagaaatgtgagcaccgacggataaactgcccatctccttttcacagttttcaaactcttcccagcaaaagctggcacagtcactgaatgaggcatttcccctttccttggtctgtgcttgatctccagcacaatggcagccaacacacagccttgacacaggggctgtgcagttctcattgagagcatgcttggtttgtaacgctgaggtcaaatgggcttgggagaaatcagacaacctcagtcatgctgaggcttgagctcagaggcctcgtgctgggaagaagaagaaaagctacctttgagttctcatattactccttgtgaagaaagaccgtttcagagaatgactgcagtctcttcctctgaaagtttccatcctgtgtcccgacccctgatgctgaaaacatgtcttcgttatacccagatgtccacacttgacttagtttttggatctgtctattctggtaatgaagtagaaatgagtaaaaagaaaaataccttcttgtttcttaccctgtttggctgaggaagtcattttaaatgcttccttttctctttaaccacacctaaatcactgtcaagttgggtaagcattagcctgtaaacattgctcacttcatccactacttctaagccagtgtagtctctcacctctcacctctgatgaatcttgcccactctccatgccctcatccttgtaccttccataatactgcttccactttggttagcgtgatctacagaaatgaaaagctgtgagcacctgcttttcggcttaagagccttcacttggtctctatcactggcaggagatcttggtaaacatttgtcaatcaatgtaggcatcatcctttatcccacagactagcagtcttcatgtctaggaaatcaactggtcccacaacctgcagactgttgtctactggatcaaaactatatatatatatatttttttttttttttcttccttactagactgggaactgcccaaggaattcatgtgtaggaaatctgttttccttctcacatgtgtcttgggaagatgtcatctgctgaatcagacagggattactaaaagaacattggagtttggatgttggagcttgtcctatccctctagctcctccctacccctacacagatgttcacagtagcattgctcataacaggcaaaaaaatgttgagtgtaaaaacaaaatgtactacagctgcacaacagaatagtcataaactggagttctgatactttatcacatcacacacgaaacttgaaaatagctatgtgaaagacgccagatacaaaacgacacacatactgtgatttcaaacataggatatgtcctgaatgggcaagtagagacaagaagtagaggagtggttgccaggggctggagggagagcatgacgggaactgatggctcctgcgatggacgtttccttttcgtgtaatgaaaatgttttacagaaatggtggtccactcacaactcccattgtattaaaaaaaatcccttaatcgtgtttttaacaagaagaactttatgatacgtgaattacatttcagtaaagttatttcaacccaaatatcaacactaaccacatcttaacttatatcaaatatatcagaatttctgagagtaagaggttgtggatatgcgttttctttttaagttctatatgtattgaaatactgataattatatagatgataaaagttagtagagatttaattctgtgtactcaccttctacccaaagcaaaaaagaagaaatacaggaaggaagaaaggaaaaacaaactcaaacaaacaaacaaacaaacaaacagaaaccaaaaccaaaacacctgtgtacatggattcaatcccaggttaaatgataaatttcatttttaacaacttcggagtctaactggctcttgggtgtggtacaaataaccttttaaaaattagaactagcaggctgaagagattgctcgacaattagaggacagcctcacaacaagaactataaataggtagctcttagcatgcttccccagtaaaaattgattttaattttatttatttatttttaaaaatttcttcacagacagcaatttgtttactactgaaaaattcaggtcatgtctgagaaagaggatgcctacatcctatccgtctttgatctatgatgttgactctctgtgcctaagcggtcagctatttaggtggtgtagcctttggtttcagttctgattttgttcaccatttgctcaatgtctgtagatgaaccattcatgtttctagacctcattcagtcatctttttctttttaaacaaatgtacagggacggtgtcccacacttttaatcccaacactcaggaggcaaaggcaggtgaattagtgagttataggccagcctggtctatgtagtagacagccagtgaatacctgtttctgtttctgttttgttttgtttgtttagaaaaaaaaaagagagtcaaagacatggtaggcacctgttaccaagcctgacctgtgggtggagggaaagaaccaatcctacaacttgacctctgacctccatttgcatgcatgttctctctctctctctctctctctctctctctctctctctctctcacacacacacatttaaaatgtaatactttcttttaaaaaaggagtgtacttctgtatttctgtgttctggaaatgggggtgcattggaaacagtacgagctttgtctcccttctcccaaaggaactgagagtatagttttattttctttgcctttaaggggagaaattgaattagatggtatccagagctttgattgttgcataaagatagaactcttcttgctttgagagaataatcatgcaacgtttttgggaggctcttatctgaatttgctctggaagagtaatttaagccagcccttggggctacaaacgtggtgcctttctttacccctttattgactgctcttggtttggtcaataagcaaagtcagaatgttttaaaactttgaaatacttttacaaaaatctgttgcagagttgaaaaaaaaatcacttggacatctgtgtcaggctttcaagaggcctccaagctgatcagttattcaggaagtcaacccaaggcctgactaacatcataggaatctcaactggactaacaaaattctagtgactagctggggtgctcaatgctcacagcagctcacatttagctggggtactcagtgctcacagcagctcacattgtgctgtccaggtggaagcacgctcctgtcttcccattcagagaaagatgccagcatcattgaaatataaacttgagaactttcagtgtagtcatcattccaagaagagctattaatatatctttttctgccaagggactaactttgttggaggtctgttcagttggctaattaattcactttgatttcagggcaatggaattattattcttatgctcctaactaaatgtttttttcccttcagaaaacaagattttggtaaagcagtcgcccctgcttgtggtagatagcaacgaggtcagcctcagctgcaggtattcctacaaccttctcgcaaaggaattccgggcatccctgtacaagggcgtgaacagcgacgtggaagtctgtgtcgggaatgggaattttacctatcagccccagtttcgctcgaatgccgagttcaactgcgacggggatttcgacaacgaaacagtgacgttccgtctctggaatctgcacgtcaatcacacagatatttacttctgcaaaattgagttcatgtaccctccgccttacctagacaacgagaggagcaatggaactattattcacataaaaggtaacacgccactgtactcctgtaacctaaaggacggttgcagaatgctgaaggcagggttgggataagtgaagctggggctctcgcatgtgatctgagactcgaaggcaaatctcataaacctgtttctttttactccagcaatgattccagcttatttggaatgcctctatctttcctcactgaaggatgagggaagagtctatggaaatagaaactatgagattttcctgaattcatttgaccttttggatcaagtatgaaattgagcagagtcctctacaatgaaacatagtctgacagatcaggactcaggaagaatgggttggatactaaactaattttttttttgatccatgttcttccacttactaagtttctttccattttccaaaacataaaaaggatgctggtctagaaatttagggggcatgcaatttgagatcttggctaagttatccaactttttaatagccccaaacccaatataattaagcagcactcatgaatcagcagcaataagtacattatgtttacgttgagattatgttctgtgtaaatactgggaagaaaaataataggattctcaaactcaaatatagttattggcattaacattaaaaactgagggagggtggatagatttttatgtatatgagaatgacagataagaaaatatatactccattttacattcaactttagcacaattacaataaatgcattttcttttatgccataacaaaggtgtacttaagaaaatttaaatatcaaacaagaaaagaattattatgttaacatgacagtatctttcatgtcctggcaaaaacagaggcaattaatacacaaattaagatttctaatatcagtaattctcaggcaaaatatttaattggattgagtcagaggataaaaagatatactattttggaagagtaaaacacttttccatataaatgatacattactttaggctagtatattgtgtgtatgcatacatatcgatttaggagaactagaaaagaagtcagggattctgtacttggcagctttcagccctgtttatatttgtatatcataaaccctaagtaggtaactggaaaaatgcctgtgctcaactttaagtttctgacttaaccaacatggcttgaggaaggggaggtagataatgatttcatactctgccggataattctaatgtgtagccaggattaaaacctcatggatcagagagttgttgatattctttttatttttgtattttattacaactttattagaaagaacttggaaataaaaaaaaaaaaaaaactcatgtatccaaattcatcagactcaaagtctatacatctcaatgaactgtgaagtattctgcttagttataatcttccacgagttttaatagaactgcatggagttttttccccatcccctttctcataccaaataaataacctgactcattcagtatcggataatctgttggggttggagccagatatttatcttttcaaaattttccaggctagagttctgactgccatattaagctgatgatttttcttaggggttgaaaacatttgtatcattttacttatttcaaagagtttagggtataggtaaattatctatatacctgacgagggctgggggtcaggttaaagtcactgaaagtcgccattagcactatgcagtgctaacaagacccagtgactgacacccatgtagcactacaaagcagtgtttgtaaccttagccttgtatactgacaaagtatgatcagtggtggggttgagtaagtcccaaagagcaagactcgatcatctaagctggtggtattttgcatgttttagtactttcaaattcgcctctgatgtacaggacagaaatgtactcaactgctgtttctgtgtcctttaacccacatgttgtgtttttcagagaaacatctttgtcatactcagtcatctcctaagctgttttgggcactggtcgtggttgctggagtcctgttttgttatggcttgctagtgacagtggctctttgtgttatctgggtaagaggagcaacattgcttttatgtaacttctctgcgcctgccctctgactatattaagactctggcctgtatcttttctacgttaaagcaaatgacgcttttcagtctgtccaacttatacatagtaatgatctgatgtgagttctgtttcccagaaggcaccaagtagccaggcagaattagaatgaaatgggaagattacggtgggaaattagagaattagcttttcttattcttaattttctaacataataattgcatatcaagcagcttaaatgcatacataaggtataaaatctaaatctcatcaggattaggcaactgaagcccgtgctttggcttggggtcaaaaatcaggagaaagtaggctgctgaaattgtgcattcaaaccagaagaaagcaggtctgtttatgtcagtcctattttctgtctcttctgaagcagttgccctgtgtgaggtcaacttggatgctgtcattatgagactgtaagaggagagggactgttcagagctctccccactgaatagagattactagtctctatagatttttctgcaataagtttaatagatattttcttcctcaatgttgaatttttgattcaagattaaacattttgtgttcgtttgattttttttttttttttctgagacaatgactcaccatgtggaccagattcgtctggaagctactatgcaatccaaactgacctcgactcatgtcaatcctcctgcttcatcctcttgagggcttataggtgtatagcaccatgtctgacttttgaacatatttaaagatttttgaattttaatttgtgtgagtaagtgttttgcctgcatgcatgtctgtgcaccatttatatgtctggcactcattgaaagccagaagagggcatcagtttttctgaaactggagttacagatatttgtgagctaccatgtaggtgctgggaattgaaccccgttccctggaagagaggccagtgctgttaactgctaagctatcttccttatgcttgttgaacacattttgatgaacacattcactgttaagatggtacgaccttaacaaggatccttttcttagaaacccctttgtgtaggagtaacagaatgccttatgtattgattccaaatgcctctgatttttttttccccagaagttgggtgaatatacaggtaagttcttcaatgagaaatgtatgctgcacaagacaaaaaagaccccttatcttgctactcttcacccatctactacgaagcacacttaggacttagtgaatgcttattgtgctgctaaataggtaaccaccatacaaagcaaataaggacctaactaagcctgtttgagatatgatacccatttaaaggcataatccaaatatttaaagagacaacttatgatcagggatttctagaactcatgccatgtgatgccatcttatttactatagcattggagaggggacagggcagctctagctctaagtcatcaagttgtatcttcccaccagagatttaaattgtttatttgcttagccaaagttgcctctctattctattattccccacacattcctgtagttcacaggccatggggcaggtggacatttgtcaggctaccttttgacgagtctataacttttacacagtggggaacagtgctagcttgttcatgggaattgtttcatcttgagaattccaaaagttgtcaatctgggtatggtgacagaggctttagtatagaaactattgcccaacttctggctctgatattagttgagaacgtccatcgctctggactttggagtctgcactcttgctatcttcttgctctacaggggcctccaatgactttagaatccttaggtttgacttggtttttctaatcctcaactactgactttcttcctttccaagtctctaaccaagaacttgaatttcctaatctaaagaccaggtgcaatagccctctgggtacccttccaagaaggggctcccttgtcatgtattgacctaggtcaaaggaatttactagcttcgtgggaaggacttctggaaactgctttggctttcagtgatcccacaggcaccactttaacacttatggtaaatatatatcaaggaaatcagcttctaagatgaggcaccaatgcactgagtgactgaaatcaccccaaaagcagcttctcactttcaatgagttaaaacaattcacctttcaagtcatgcatcagatatgttttgtgctttcctttggcagccccccaatttctggtaagattcatcttctctgccttgggaaaactgttcttgacttatctcacaggctcactgtgactagacagccttagtgctctacttgtgtggattttgggagtcaaaccaggctatctaacaaaaatgccacttatttggacttcaaacccaggtctttgtactctctgaccaagtgggggtataagaataatttgcacctcacagaacaatgtagcgcctttaccatgagctcttcctttcctgctatttggtcaggaaacatcttggtgagctgggcatttagggatcccgaggacttaaccactttctgggatcctatttttgtctggccagcaatgtgccctaggtgaaagttaactgggttccagagccttctgagaatccatgctgtgcaactgtaggaagctccaggctgtgtgggtttctgtctctgtgcttgacctgatgttggcatttgagtaaagaaaaggcatttcttggtcaggttgccacagactgcgacctgtttttttttttttttttttttttttctaattctctgttcattcagctgagctgtcacactggctccctttctaggttagaggagcgttgttttggtttgtttgtttttgtttttgttttaacatgctttatgccagtatgtaccacaatgtgtaggtaatgcgtatttaggtagcattatctgcctttaaatctgcattcttgaccattttagtacattgcttatgtgtgccctgtgtgtggctgctttgtctaggaaacaaggcagaggtaggaggaaaggcaaaggatagagtggccttgaagtcatgcatctttaacgggcattggttggtgagggacacagatacacagacacaaggggtgggtgttctatgcatatacattgtgagagtgcacatgaacaccataggttttggactggatccccagccatttccatcccattggttaagaatcagctaaacccactgtctgataatagtgttggggtaagcatgggagctgattgtaacagattttctttatctttgtgtgtagcttggagaacctcaaagtcacaacacccttcttactgaggcctttctttaagctatggtttcactggaggatccacaggcaagggttggcaaaggagaccctaaaagctagcatcagtactgaaaactgcttgcctggatagtattcccagcagtctttgcttactttgaggccttggcatgtgggtgtgaaaaggaggccaaggctgtcctcaaccactcattatcaatccaggaacacctgtccctcatacctattgtatatacttatcacatctgacttgtctgcttagaataaggctttgtgtttaaataacagagaatcccgactctgcaatccacatgactttctgcttttgacaactatgcaaacattaccatcacattgatctagcaatgatgccctagaccacagtcataaaaaacatggtcaagatgcaaagtgagtttacctctagttccaggcttagtatcattcctctttctctgctcctggtagaatttggtggtttttttttgttgttgttgtttatttgtttgtcttgttgttgtttaattacagaaaaatagcttacttaatgaatgattaaagtgggagtgtttaatctatccaaagactaaaggctttctattgcatttacatatcaatagtgaatatgttctaaaatacattcttgggcttcggattagatgacaacattgagaataatggttgcatttttataaaacaatttcctttagatttttagtagagctgttgatagtcaggctttgattagtcattatcctagtccaaggcacacaaaaaggctcctcagggtcatttaacagctgatgatctgagtaattatccctaaagtcttagaacccctccaataatacctcctctaagtccttccatattgacctttttcttttttcatttccccccctagacaaatagtagaaggaacagactccttcaaagtgactacatgaacatgactccccggaggcctgggctcactcgaaagccttaccagccctacgcccctgccagagactttgcagcgtaccgcccctgacagggacccctatccagaagcccgccggctggtacccgtctacctgctcatcatcactgctctggataggaaaggacagcctcatcttcagccggccactttggacctctactgggccaccaatgccaactattttagagtgtctagatctaacatcatgatcatcttgagactctggaatgaatgacagaagcttctatggcaggataaagtctgtgtggcttgacccaaactcaagcttaatacatttattgacttgattggggaagttagagtagagcaatcaaaaagatcattcattcagccttgggaagtcaatttgcaggctcctggatgagccctgccccgttttcacttgccagcacatttcagtcatgtggtgtgatagccaaagatgttttggacagagaagaaaggatagaaaaaccttctctttggctaagttggtgtttggggtggggataggttagagtatagtacttaactatttgaaaaataatgaaaacacttttttcactcatgaaatgagccacttagctcctaaatagtgttttcctgttagtttagaaagttgtggacatatttttttaatgatttctgaccatttttaatcacattgactcatggaatggcctcaaagcaccccccagtgcttctttcctcattcccggtcatgggaactcagtattattaatagtcacaacatgatttcagaactagatagccctcccacaccaagaagaatgtgagaggaagtaaggtcactttatgtaaaaaaaaaaaaaaacaaacgcgtacacatatgtatgtatacatacatacctatgtgcacacacacacacatatacatacacacaaaatgctatgaagagttatctgtttagtagcctgttatagtcaaatcattttaagtttcaacttcttacagttgggccacttgttgtcctttgtggatggatatctgaaattgtgtctatatattgctagtcatgatactgtgaacaaaaagggtagtgttagtatttgtcagggtggtaaggatgcattccaggaagcttcctctgaggaagggaatgaggtcattcttgccatgtatgaaagacatagatgttttccagaaggcaccattgggagccccagtataagttcctttagactctacagtttagagggattttatatgtcctaggactcaggactccagaactttgtgggctcagctgcttcataccatggggatacattgacatgaacaattattttggaatgtgtctttagggacgacatcaaagttctcaagtacctacaagacctgatactggaatgaaggtggactttcttttttgcttccagttcggatcaactggaatgtatctggggaccttgaagaacggctgtccagctgtcttcaccatttgtatagtgctttgaattattcagaggttttaaagtcaggaagacctggtttaaaaaacatttcattatgagttaaatggcctcaggcaagtcactgttcatccaagtctatgactcctcaactgtaagatggccacactgaaacttgctaagatcctctggcctctgcctcccaagagttgggatttcaggagtgcacaatcatgacccaaactcgtgataatctctcagcttcaataactttccagctaattggaatatcctgtaatcaaacatgaggcatttcccctccccccactgtttttgtgtataaagagatctttaaactttttttttaatatgaggggtaagaaaagataggaatcttttaattctagacagaagatattgtgctttggttttttttttttttaatggcttctattctgtgcttttaattaaaccagagaaggccaagattagccctacttgtgtgataaaagaatgctggcccttgtgattgcagtcagcctcttgacacatagagttcttgaatctaagttataaaattatatttgaaaatgacagagctggagaatttatagaaagggtcatagcaaataacaaaccatttttttttaaacggaaagatttggtctttggcaatcaataactttgttttctaactggaaaaggaggtttactggagatgaatcacacctgaaagttttcatacctcctctgaacacaaccgaaacataggtgtccaaagcctttcgctctcggtatgaaccaacaggcgggttaaaaacactgggtcagagtaaagcttttgcagtttcagatgtagtgtgtatgaagaaaactatgtcacttgctgctattattgtaagagtctaagaactaaaggtgtgcctgtaatttctaattatgagctcacctatttggtaccgagcatgccaattttaaagagacccggtgtaccttatagctacatccaatgataaaattaccacactagcacatgcctgtgtttaaactcgtgctttaatgtttttcttagggcaggtatgcaccccctttgcagtgagttgggagagattttgaaaaagtgtatgacaaacatttttaacacctttggtttcctctctctgtgtctctttgtctctgtctctctctttctctcctgtgcatatgtctcccctccctcacttctctgtctcttcctctctccctctctctgtctttctctgtgtgtctctctgtctctgtgtatctctctgtctgtctctttctctgcagattttcaaaacgttgtttttctatggaagaaatacaagctgtggttggtttgctacgagtcagtagcagtttatcagtaggccaatgttttatctcttggagatttcagtctgggtttacccaatgtattctctgtaatgtgactgctggggacagatataacttgattgagccttcaaatcatttaggtcttcaatcatttagtcaacggagtgagccactaatctgcaatggctattttaatatgcatactgatggtcaaatggatgtctgatctctcatcccagctttctgtactaccatatgggaactatatgtaacttgtatacttacctgaatatgttaaattcaactacatggtaagatggaccagaaattgcaatgttcatgtccatatagccaccattaacccaagttaagcacagtagtgtgggttctctcaggacttgtgaatgagtttatgctctctacaaagacaggtgaagcttaaatctctcttgcactgctatgtttatgcaaatatcaagattgtttctgtaccagggacttaacacattctattcatactattttccctgtctacaatgttatttcatagatatctacttggtttgctcttacttccttgacatatttgcccaaatgccaccttcaactgtagttaattacctgtacaacctgtctccatgccttgttttattttctctataactctactaataggtatttttcttatttattggtttattgcctgttttttttcctaaatctacaccggatctccaaagggaaagaactccatttgctttgattttattgctgtatccccagtgcctagaataatgcttagcctgcaataaatatttattcattgactagatggatttcacgtgggtttatgagttagtggcaaatctgaatgatctgctcatagtctgagaaggaagcagaatcacttctgttttccacttcctattagagacagaagaggtaaagcagacacagagaaatctggtagaaggacatatcattgatacaaattcatttacagcttagaaattttcatgcatcctgaaagatgaatacagtcggagtcattctaaaaatgttattctaaaaacaaccaattaggaataggttgattttccatttaaagttctcaagttctctctcaatagcttcttgacatcctttttgtttttattttttattttttggaaccttcttttaaaatgttgttattggggctgaagagatatcccagtcatttagagcatgacatgggctatttttccagaggtcccaggtttgtttcccagcacccatatttgatgctctcttttgatttctatggccaccagatgcttatgtggtccaacagacattcatttaggcaaaacacacacataaaaaataaataaaaataacattgttgacaatttcatgcatttgttcgctgtatctgacaatacccatacccagctcctggccaccatggccctgggcagtccccaatgcacaaccccctcttgttttcacgtcctcccctttcttttccttttcttttcattttggtaacccacctagtccagttagtgccacttgctggaatgtgtaccagtcatggtggcttgaccttgaacaggtcttgtacaggtagccatggctcctgtaagttcatagtacaatggctgtgcagtggctgtggcatatctagaagacagcatgtcacagcatgccacactctctggctctgacattctataagttagttccctcttccatgacgtcccccgaactttgtgggaaaggttgcttgctacagattcccatttagggttgaagaaaacacaaaagtcactcattctcaccaatctgaccagtttctgcctagtgcagaaaagaggcttatttggcaaaggctgagagcagcacttacctatggatataaaaagaaatatttagaaggaagtcttacctgtctattcagtaaaacaatagcagtgggttccctattatgacctatgacttatgaaccatgagccacggacttttgaccaggttcacagtatcaggcatcaattccttcctatagtgtaggactcaaatctaatcagaaagtgactggttaacccataaccttcctgtcaccattgcatctgtgggcacatcttctctgtcaggttgatattgtagcctccagggaccggttcttggtggcattgtttataaccccaccccacccctcagttgccagaaaagcacctctcggcactatgaaagttaaccagcaggaaagaaattctcaggccatttctaccttgactactctgttctgttctgtaattaaagtctgttgtatcttcagcagcagggctttaccatgcagttaaggtgggcaaccaggacaatagcagcttctgctgccttgcgggcctccgcagtctctatgacatatcccatgcctggcactgagagttttttcatttaaaacccatgtttctgagggaagcattttgtcaatgctttaaacccatctttagcttctggtttctgaaaatatggcttttgtagttaaaaactcaccctacagctgaattactgctcttctctgtggagtgattttgttccagtgaagtctagaaatgctttgttagctctgatccaaaaagatctcaaacaatggtcaggacaggaaatgccagtctctttacctgtcttgctcatggcgtaagtgggtgcttgaaaagcttgcaacagcttcagccaaaaagaagagcaaacaagcaaaatacgtggcattgggagcaagctgaaaatttataccatactagtatttaacacacacatcagcggacagtggctgggggtggggtggggtggggggcagtgcaaaagaatcctgtgtgtggaggaggagacacttgagccacagacacaagagcttgtctgatacttggtaatccatgtagctgtttctatttggccttaagttttcctttgcagatgacctggagtaaacaaggtacatgatgaactcatttttaaacccactctttgttttgttgaaacgagacttgtggagttcaataaatgcagagaaagcttgaaaaagatgagctcacatccaggctactacttaagaaagtctggaatcagctagtctcgtggatgtttcaacagggaaatcagatcaaactggaaaggtaccagattaatagatggaaaaacctctgcacagatctcagtaaggatgtgtttattgtactaatggaaaattgtataacctgttaaaaagttgaggtacctccagactcatcctcaaggtataacacaaggcaaattctatgacatcactagacaggcccctctatcatgtcttaaccccacaaatgtgagaatttacaatcaacaaacaacagcctttagtgcactttgtaggagattcagtccagggctccatctaggcaaacaactgagctgcatccccagcccagggtagtttccttttcagtgggaagagccatgtgtgtatatatctttgtgtatgtgtgtgtgtgcatgtgtgtgtgtgcataagcacatgtgtatgcatgtacatgctgatgttggatattttctctatcattctgcactgtactttttgagacagactttctcactgaatgtaggactcatgccagtgagctgcagtaagctcctgcctccaccttcccagctctagtacgtcaggtgagccccttaaagcctgactctttacgtgactgcttggaatggatccaaacttagatctttatgcgacaggtcccttactgactgagccacctccctagacccacattcctatttaagcagtatcttttgtcatctctcgttatatctggaacagagatgatagatagttgagacaaatcaaagaaactcctgggttcattgcaacagaaatctgacccccacagtaaaaggcagctacagatggtctgggaaccaccttagaaacctgctgatggtgtgctctgtgttctcctcaactgagcctccattgatgtgctggcagtggtactcaggatcttgggttttgagaaatacatctgagagattggacctccttatgttttcccatctgacattctgaaagtagggtgtgtgtgtggtttttgtttttgtttttgttttttttttgaatcataggtttatggttcttaaaactgtagactactgtccagagcagtatgtgaaacactagcttaagtgccttttgctcatttcagggttgacattggacccaatgcttgaaactacttgcattgaaagtctgtgtgtccaagaatatgtcagactttctgagctgacctcactcttggggcaaaatcaaggatcagaatgtgtgcttcccaaaggccatgccctatgccatttgcccacttaaactctgcgaaaggattggaaaggctacaaactcaaggggataaaaagttgtaaaggatagcctggatttcactcatacttcattatgtaaaggcatctcaatgacagataatctcctttgtctccaaagggcaagctgtgaactgggtggaaatgtcagttgagacagaagagcagcaaacagctctgttttcctatagttgtggttttgcatggtgacgatgacacatgaagatgagaacaggtagcatgaactccagtcattatctgagtgaacatctctgccaacgctgaaggatatgtgtgggtgtcacctgcaagcacagagatggggagggagggagggagggagagagggagaaagggaaggagggagggagagagggagaacaaaagaaaatagaaggaagggttgagaaacaggaagttaactgcatagagcatctagcaattctacagcaacaacaggtgaaagctagcctttacaaaacttaacagcacagttactaaatattaaaatcagttgtattgctagcactagagcacacaatagttcttactgtcttgaaaacactattcagaacacccaaacccacagaggactgtgagagtcagcgaggcagaaaaccaaaaccaaaaaacaaaaccctgagtacagaaaggggactccagcaggattgaagggatcagatataactgagggagggagagggtagtggataaacatgtaaaagccacactacgtataaagcatgaaaatgtcatgataaacctattatgaatgtatgtaccgtgtatgtaaataaaaaagtgaagatgtaaaagattaacatgcctcttgaaagagaaactattagcttttccttaaaaagtaaaaaataaaaccaaatacaggttaaggtataatgtgttcacggacaaaagcttaatgtcttgattaactcaacaaatatagatttagcaactttcggtggtcagatctgactgtgagaagagacaggaagggctgctggaacccagggaatagccaggatctcaaaggttgccctcctgatactccctcattaagcttcatgtgatcgaagcctggaaggaggtgattaggggatagctggtaaagcctgtgttagggtggtagcaacttcctctgaattcaaacactctgtgctgggtgaaggctccttaagattcaggaagtaagcaactcaggccccttgcagagagctccaggatacaggcttcataagccaagctgggattcccttttcagagatgctgttgacactaaaagacccctgacccttaagccagggccctaaaacttattgggaagttcaggaagccagttttaggaactgcacaaaaaaggcaaatgatcctagccccgcagatgttacaaagataggcaatagatcctgtgggttaagaagcagcttattgaaaactggggacgtcattctcctctgagtgaacccccttctcacttcctaccctcaactatgaataacccagcatgaggtctgcagcctgcactctccggctccctggtgtttctggatcctgtaccctgatcacagtgcagccacatctgaagaccccacctctctggcattaaataaaacttctttagctctttaagctcagctaagttctcaccttttctttttccctacaaactcaactcttacatattcatacacatgcttttgtaagtaaatccacagggtctcaggttcatcaagtcggacttagtggacatttttgttgttgttgttctgcatttggggtaaataggtatttgttcatttcttcagggaagatcacacacaagaaggtattcccgcttgtgctgtgctcactgtggctgagctcagagcacgtgtctgcacatgcatgttctggagtgccaaattccaagcaggagaagcaggtaagtgtgtgtcaggcttgttgctgtaaaatgacacctttgatacaagggagagatgctgacttagcagataactaattcagtctgctcttctccatgccaaaaaatccaaagagagcagtggtggggctggacacaaacatgaggtgattggtgtgatccaagtgactcattaaaattagtcacagtgtgtaggaagccatggtgtaggaagtcatgatgtaggaggtcacaatttaggaggtcacagtgtagagtgtcacagtgtaggagctcacaatgtaggtaatcacagtgtaggaggtcgcagtgtaggaggtcaaggtacagggggtcactgtgtaggtggttatggtgtaggtgatcacagtataggagatcaagttgtagatggtcatggtgtaggtgatcgcaggaacccaagtctggagacagtttgatgatttgtccagctgtgcaaagttaaagaaaggatgggatgacttcgggtttgggccagcaccagtggaaggatattttacactctgaaatggagaaaacgtggaaggactgtactgtcataggatggcaggtagaaggtgtttgctttggagtctcggaagttttagggaagattaaagtgattgtgttgttaactgactatgagattctggagttggaaggagtgaatggagtctgagatgagcataaatggctgaaatgtatcagcatgtggaagatattttgacaagtgactctacaaagatgtagggaagctcttttcaagagtggtcccgggaccaggagcatcatttgttagaagggcagatcttcagacccagctctagacttactgggttgacaaggctcacagggcagttggaagcaagccagtgcctcccagccacagccccactgattccctacagaaggaggttgttccaagcactgagtcctgggagctgcacaggcttagagggtagaaccggctaagaaggaagagaaatcatgaaaccacactaagaagatagatttctgctgtagaggaatgtgttgatttaatgccatccaaaaacaaaaccttagatgttagagagcttgacagctgcctcaaagcatcctctaacagcgcaaagggccgaagacggatctgacagttgcgagaaactcgagtgtggaattaatctccgtgaaactcatgataactgtgggagctttgtatttgaatgaagtagcatttcacccggtgggaggggaaggcagcttaacaattggccagacatgtggaaatagataattttaggtctttccataacacatatgcaaaaatatattccagatggactagtggcctggatgtgatcagggattgcttgaaggaaaatctaagataatatctttattcctgtgtgatagtaaagaactcatcaagaaaatagatgaatagaatttgaacccagtaaaatgtagaacacttggatggtcaaagccagctccacagatcagggttaagggtttctagtggccccagaggcaaaatttgatatttggaatgtcagaaatatgaaaatgatgctctaaatgacagtggggaagaaaaaattctagaaatacttcaatgggaaatgcaaagggaagagcatggagcatgcttgacttgcagaggaatgaggaaatacacaaatgcaaacagcccggccttccctgccatgctggctgcaggagggaaaccccccagttgta

SEQ ID NO: 1506 - DNA, 1492 bp, Mus musculus
acacactctgccttgctcacagaggaggggctgcagccctggccctcatcagaacaatgacactcaggctgctgttcttggctctcaacttcttctcagttcaagtaacagaaaacaagattttggtaaagcagtcgcccctgcttgtggtagatagcaacgaggtcagcctcagctgcaggtattcctacaaccttctcgcaaaggaattccgggcatccctgtacaagggcgtgaacagcgacgtggaagtctgtgtcgggaatgggaattttacctatcagccccagtttcgctcgaatgccgagttcaactgcgacggggatttcgacaacgaaacagtgacgttccgtctctggaatctgcacgtcaatcacacagatatttacttctgcaaaattgagttcatgtaccctccgccttacctagacaacgagaggagcaatggaactattattcacataaaagagaaacatctttgtcatactcagtcatctcctaagctgttttgggcactggtcgtggttgctggagtcctgttttgttatggcttgctagtgacagtggctctttgtgttatctggacaaatagtagaaggaacagactccttcaagtgactaccatgaacatgactccccggaggcctgggctcactcgaaagccttaccagccctacgcccctgccagagactttgcagcgtaccgcccctgacagggacccctatccagaagcccgccggctggtacccgtctacctgctcatcatcactgctctggataggaaaggacagcctcatcttcagccggccactttggacctctactgggccaccaatgccaactattttagagtgtctagatctaacatcatgatcatcttgagactctggaatgaatgacagaagcttctatggcaggataaagtctgtgtggcttgacccaaactcaagcttaatacatttattgacttgattggggaagttagagtagagcaatcaaaaagatcattcattcagccttgggaagtcaatttgcaggctcctggatgagccctgccccgttttcacttgccagcacatttcagtcatgtggtgtgatagccaaagatgttttggacagagaagaaaggatagaaaaaccttctctttggctaagttggtgtttggggtggggataggttagagtatagtacttaactatttgaaaaataatgaaaacacttttttcactcatgaaatgagccacttagctcctaaatagtgttttcctgttagtttagaaagttgtggacatatttttttaatgatttctgaccatttttaatcacattgactcatggaatggcctcaaagcaccccccagtgcttctttcctcattcccggtcatgggaactcagtattattaatagtcacaacatgatttcagaactagatagccctcccacaccaagaagaatgtgagaggaagtaaggtcactttatgtaaaaacg

SEQ ID NO: 1507 - DNA, 657 bp, Mus musculus
atgacactcaggctgctgttcttggctctcaacttcttctcagttcaagtaacagaaaacaagattttggtaaagcagtcgcccctgcttgtggtagatagcaacgaggtcagcctcagctgcaggtattcctacaaccttctcgcaaaggaattccgggcatccctgtacaagggcgtgaacagcgacgtggaagtctgtgtcgggaatgggaattttacctatcagccccagtttcgctcgaatgccgagttcaactgcgacggggatttcgacaacgaaacagtgacgttccgtctctggaatctgcacgtcaatcacacagatatttacttctgcaaaattgagttcatgtaccctccgccttacctagacaacgagaggagcaatggaactattattcacataaaagagaaacatctttgtcatactcagtcatctcctaagctgttttgggcactggtcgtggttgctggagtcctgttttgttatggcttgctagtgacagtggctctttgtgttatctggacaaatagtagaaggaacagactccttcaagtgactaccatgaacatgactccccggaggcctgggctcactcgaaagccttaccagccctacgcccctgccagagactttgcagcgtaccgcccctga

SEQ ID NO: 1508 - DNA, 51365 bp, Homo sapiens
tctccatgttggtcaggctggtctagaactcccgacctcaggtgatctgcctgcctcagcctcccaaagtgctgggattacaggcatgagccactgtgcccggccacatacaggtttcttacatgcatatattgcatggtggtgaagtctgggcttttagtgtacccaccacccaaatagtgagcattgtaccccataggtaacttttcaaccctcacctgcctcccacctcccaccttttggtgtctctaatgtctattatttcactctgtatgtccacgtgtacattgtttagcttcctcttttaagtgagaacatgtgtgtttgactttctgtttatgagttatttcactaaggataatgacctccagttccatccatgttgctgcaaatgatttcattatttttttggctctgtattattccatggtatgtgtgtatgcattgctgcaaatgatttcattatttttttggctctgtattattccatggtatgtgtgtatgcgtatgtgtatgtgtgtgtgtgtatacattatacaccttttgtacgtgtgtgtgtgtgtgtgtgtgtgtgtatatatatatatatacctccaatgtatagctatagcccatattctttattcaatcctctgttgatggactcttgtgttgattccatatctttgccactgtgaatagtgctgtgctaaacatacgagggcaggtatctttttgacgtaatgatttctttccctttgggtatatacccagttgtgggagtgctggattgaatgctagttctatttttagttctttgagaaatctccatactattttccataaaggctgtactaatttacattcccaccagtggtatacaggcattctcttttctcctcatgattattggctgtttttagactgtttattaatagccattctgactagtgtaagatggtatctcactgtggttttaatttgcatttctctgatgatcagcaatattgagcattttttcatatgtttgttagccacttgtatgtcttgttttgaaaaatgtctgtttaacaagcaaatgctgagggattttgtcactaccaggcctgccttacaagagctcctgaaagaagcactaaatatggaaaggaaaaactggtaccagccactgcaaaaacacaccaaaatataaagtcaccatgaagaaactgcattaactaatatgcagaataaccagctagcatcatgatgacaggatcaaattcacacataacagtattaaccttaaacgtaaatgggctaatgccccacttaaaagacacagactggaaaactggataaagagtcaagatccatcggtgtgctgtattcaggagacccatctcacatgcaaagacacataggctcaaaataaagggatggaggagtatttaccaagcaaatggaaagcaaaaaaaagcaggaattgcaatcctagtctgtgataaaacagactttaaaccaacaaagatcaaaaaagacaaataagggcattacataatggtaaagtgatcgatgcaacaagaagagctaactatcctaaatatatgtgccctgaaaacaggagcacccagattcataaaacaagctcttagagacctacaaagagacttatattcccacacagtaatagtgggagactttaacaccccactgtcaatattagacagatcaacaagacagaaaattaacaaggatattcaggagttgaactcagctctgaaccaagtggacctaatagacatctacagaactctccatcccaaatcgatagaatatacattctttttagcaccgcatagcacttattctaaaatcgaccacataattggaagtaaaacactccttggcaaatgaaaaaggacggaaatcataacaaacagtctctcagaccacagtgcaatcaaattagaactcaggattaagaaacgctcaaaactgtgcaactgcacggaaactgaacaacctgctcctgaatgactactgggtgataacgaaattaaggcagaaataaagaagttctttgaaatcaatgagaacaaagacacaacgtaccagaatctccgggacacagttaagcagagttaagagggaagtttatagcactaaatacccatatcagaaagcaggaaagatctgaaattgacaccctaacatcaaaagtaaagtaaatagagaagcaagagcaaacaaattcaaaagctagcagaagacaataaataactaagatcagagcagaactgaaggagatagagacatgaaaagcccttcagaaattcagtgaatccaggagctggtgttttgaaaagattaacaaaatagatagaccactagccagactaataaagaagaaaagagagaagaatcaaatagacacaataaaaaatgatgaaggggatatcaccactgatcccacagaaatacaaactaccatcagaaaatactataaacacctctatgcggccgggtgcagtggctcacgcctgtaatctcagcactttaggaggccaaggcgggcggatcatgaggtcaggaggttgagaccatcctggctaacatggtgaaactccatctctattaaaaacacaaaaaattagccgggcatggtggcaggcgcctgtagtcccagctgctcgggaggctgaggcaggagaatggtgtgaacctgggaggcggagtttgcagtgagccgagattgcgccactgcactccagcctgggcgacagagcgagactccgtctaaaaaagaaaaaaaaaaccaaaacacctctatgcaaataaactagaaaatctagaagaaatggataaattcctggacacatacaccctcccaagactaaaccatggagaagtcaaatctctgaatagaccaataacaagttctgaaatggaggcagtaattaataccctatcaaccagaaaaagcccaggaccagacagagtcacagctgaattctaccagaggtacaaagaggagctggtaccatttcttctgaaactattccaaaaattagaaaaagagggattcctccctaactcattttatgaggccagcatcatcctgataccaaactctggcagagacacaacaaaaaaagaaaatttcaggcgaatatccttgatgaacattgatgccaaaatcctcaataaaatactggcaaaccgaatccagcagcacatcagaaagcttatccaccatgatcaagtcgacttcatccttagcatgcaaggctggttcaacatacacaaatcaataaatgtaatccatcacataaacagaaccaatgacaaaaaccacatgattatctcaaaagatgtggaaaaagctttgataaaattcaacaccgcttcatgctaaaaactctcagtaaactaggtgttgatgaaacatatctcaaaataataagagctatttatgacaaacccatagccaatatcatactgaatgggcaaaagctggaagcattccctttaaaaaccagcacaagacaaggatgccctctttcacactcctattcaacatagtactggaacttctggccagggcaatcaggcaagagaaagaaataaagcgtattcaaataggaagagaggaagtcaaattgtctttgtttgcagttgacatgactgtatatttagaaaacctatctgtatttttagaatgctgtatatttagactgtatatttagaaaaccatctcatgccagttagaatggcgattattgaaaagtcaggaaacaacagatgctggcgaggctgtggagaaataggaactcttttacaccattggtgggaatgtaaattagttcaaccattgtagaagacagtgtgtcaattcctcaaggatctagaaccagaaataccatttgacccagcaatcccattactgggtatatacccaaacgattataaatcattctactataaagacatgcacacgtatgtttattggagcactatttacaacagcaaagacttggaaccaacccaaatgcccatcaatgatagactggataaacaaaatatggcacatatatgggctgggtgtagtggcttacgcctgtaatcccagcactttgggaggccaaggcaggtggatcacctgatgttgggagttcgagaccagccagaccaacatggagaaaccccatctctactaaaaatacaaaaattagctgggcctggtggtgcatgcctgtaatcccagctacctgggaggctgaggcaggagaattgcttgaacctgggaggcagaagttgcagtgagccaagatcgtgccattgtactctagcctgggcaacaagagcgaaactctgtctcaaaaaataaaaaaataaaattaaattaaattaaaaaaaagaaaatatggcacatatatactatggaatactatgcagccataaaaagaatgagttcatatccatcgtctcagcccaaaaactccttctgataagcaacttcagcaaagtctcaggatacaaaatcaataggcaaaaatcacaagcattcctatacaccaataatagacaagtagagagccaaatcatgagtgaactcccattcacaattgctacaaagaaaataagatacttaggaatacagcttacaagggatgtgaaggacctcttcaaggagaactacaaaccactgctcaaggaaataagagaggacacaaacaaatggaaaaacattccatgctcatgaataggaagaatcagtaccatgagattggccatatggcccaaagtaacttatagattcaatactattaccatcaagctaccattgactttctttgcagaattagaaaaaactactttaaatttcatatggaaccaaaaaagagcctatatagccaagagaatcctaagcaaaaacaacaaagctggaggcatcctgctacctgacttcaaactgtactataaggctacagtaaccaaaacagcatggtactggtaccaaaacagatatatagaccaatggaacgaaacagagacctcagaaataacaccacacgtctacaaccatctgatctttgacaaacctgacaaaaacaagcaatggggaaaggattccctatttaataaatggtgctgggaaaactggctagccatatgcagaaaacttaaactggtccccttccttatagcttatacaaaaattaacttaagatggattaaagatttaaatgtaaaacctaaaaccataaaaaccctagaagcaaaccaaggcaataccattcaggacataggcatgggcaaagacttcatgactaaaacaccaaaagcaatcacaacaaaagccaaaattgacaaatgagatctaattaaaactaaagagcttctgcacagcaaaagaaactaccatgagtgaataagcaaactacagaatgggagaaatttttgcaatctatccatctgacaaacgtctaatatccagaatctgtaaggaacttaaacaaatttacaagaaaaaaacaaccccataaaaagtgggcaaaggatacgaacagacacttctcaaaagaagacatttctgcagccaacaaacatgaaaaaaagctcatcatcactgatcattagagaaatgcaaatcaaaaccacaatgagataccgtctcacgctggttagaatggcaattattaaaaagtcaggaaacaacggatgctggcgaggctgtggagaaataggaactcttttacgctgttggtgggagtgtaaattagttcaaccattgtggaagacagtgtgtcgattcctcaaggatctagaaccagaaataccatttgacccagcaatcccattactgggtatatacccaaaggattataaatcattctactgtaaagacatgcacacgtatgcttattgcagcactatttacaacagcaaaaacttagaaccaacccaaatgcccatcaatgatagactagataaagaaaatatggcacgtatatactatggaacactatgcagccataaaaaagtatgagttcatgtcctttgcagggacatggatgaagctggaagccatcattctcagcaaactaacacaggagcagaaaaccaaacaccacatgttctcactcataagtgggagttgaacaatgagaacacatggacacagggagggtaacatcacacactgtgacctgtcagggggtggggatcaaggggagggagagcattaggacaaatacctaatacatatggggcttaaaacctagatgatgggttaataggtgcagcaaaccaccatggcacacgtatacctttgtaacaaacctgcacgttctgcacatgtatcccagaacttgaagtaaatttaaaaaaacaaaaagaaagaaaaatgtctgttcatgtcctctgcctactttttaatgggattgtttttttcttgttgagttgtttcagttccatgtagattctggttattagccttttgtcagatgtttagtttgcaaatatttttcccattctatagttatctacttactctgttgattgtttcttttgctgtgcagaagctttttagtttatttaagtcccatgtgtctattttgttgcctttgcttctgaggacttgttcataaattctttgcctcggcagatgtaaaaaagagttttttcttggttttcttctgggatttttatagtttcaggtcttacatttagggctttaatgcatattatgttaatttttgtatatggtgagaggtatgggccccgtttcattcttctgcatatagctagccaattttcccagcaccatttattgaatagggagtcctctccccagcatatatttttgttaactttgttgaagatcagttggttgtagatatgtggctttatctctgggttctctattctgttccattgttctatgtatctatttttatactagtaccatgctgttttggttactatagttttaccatgtaatttgaagttaggtaatgtgatacttcaaagctttgttctttttgcttaggattgctttgactattcagctctttttggattccacacgatttttaggattgctttttcaaattctgtgaaaaatgacattcttttgttctgacaattcttaaccccacttcagaccagttttctcatctgtaaaatggagataataataatcttcctcacaggttgtgtattaaatgagatctggaatgtaaagttcttagtatggaaatgctattatttttactgaaaatgttgtagggtctcagtatcctgtgtattgccggatttaaggtccttattttatttctgtcatttctacctcttggtatatgtgaatgctattggatttcaaaagcaaatgtgaaaggattctaatgaaatggtttgcttctttagtgtcatacatgttaaaacataggaaggcaaatgtcaaagtttgtgtttctttttattctatggaaagaaaattaaatatggctcatcaaataataaggccaataatatttaattattgttttgtgaattcgtataaatgagctgacctctctgggctgcagcttccttctctgcaagataagggaattaggccagatgagtgaactgtttctttttcagctaagtttgacccgattactactatttacatagtattaactagatgctatgtagtcatctttaatatgcttgaagacagttattaactcactccttagccttttgttgttgatcatggaaaactactgggtatctttgtttcttctgtgtatattctcagtatgtataatgagtctcagagcctcttgttttaagatctgggtaggctggtggctctagaatatggatgaccttttaggaaaggtcaccttgccatctgtaaattttcccccagatagacttcaggccctggggaaggcatgggttcccctaactggatagaggatcagagccaggaagactgtgtcaaattctagaagtgaatcttctccaggactcagggcatagctttgtcacttacctatagttcagaagtgtgagtgaatcatttccaaggacaaatttctccaaaggaccaaaagatgtgttagtaagaggggttcacaaagactgtgtttgtgggaaaattgaagtgtgaacaaagaaggtctaccaggacaggaaatacttttgatctgtcatttatcagatcaggagggagggacatgaagcctgcctcctcttacagctaggtcatcaaagagtttgactgtagcattttaaaatagcgaagaaaaaaaggtaacaacactaggggtttgttaaacaatttatgatataattagagaatggaatattatgcatcaattacaaataatgtttataaagatacttaaatgacatgggaaaatgttcaagatataacaaataatagtacatatctgatgaaaactataagtaaaacatgatattaaacatgtaaaaatcttaacagaccaacaggtggaaggcagtggaccagaatattagcagtgtttatattagggtggtaagaatgtggatgaatcttgttttaatgcttataatttttctaaacattctcaatgaaatatgccttacttttatagtcagaataaaaagcaatacaagttatcttttaaaacaacccacatacacaaaacccccaactagagtaattgcacaaagcttagattatcaaaaagaagaaaaaaattactggaaaagttttgaagaagtcattgagtacaagatactgacgtaggtgccggaagaagagagcagttggccgtgctggtggaataaccctctctgcaaagggcctgggagttgaagaagggtgcagtcgggtggtggttatgaatctcagaaatcctgccacggagcctccttttgtgccctattacttaaccttgagggacatagagagcatgagacaccaaggggcttttggttgccttactgtcccactaagaacatagaatgttgttttgactttccctttgcttagggaacctcccccagatactcagctggctggctgcttgcacgtagaatgggttttgcaaagttcctagaagtgagttggaggaggcttgacataaatcaagcactgtgtgctaaatgctccagagggctaccttatgtcctacacaaatgttacatttctaatatttgtaactcctttaaacgtttatgcagatgtttcccaattcctcagtagaattcttaccattatctttttgacacaacctgtccccatcctatgaaaatctctcctctgctagagactttattctttctttctctctctcccccttccttccttccttccctccctccctctttctttctttccatctttctttctttctttctttctttctttctttctttctttctttctttctttctttctctttctttctttcttttctttctttctttctttctctttctctctctttctttcttcctttcttttttctctctccccttccttccttctttccttcttttcttttcttttcttttcttttctttctctctttctttctgtctttcttttctcattctgttgccctggctggagtgcagtggcatgatctcggctcatagcagcctccacctcctgggttcaagcgattctcctgccttagcctccctagtagctgggattacaggtacccaccatgatgcctggctaattttttgtattttcaatggagacggggtttcaccatgttggccaggctcgtcttgacctcctggcctcaaatgatccacccactttggcctcccaaattgctggcattacaggcgtgagccactgcacccggcctgttccttcttaagaacactttgtctcccctttaatctctgctggatttcaagcaccccttttacacaactcttgatatccatcaataaagaataattcccataagcccatcatgtagtgaccgactatttttcagtgacaaaaaaaaagtctttaaaaatagaagtaaaagtctaaagtcatcaaaacaacgttatatcctgtgtgaaatgctgcagtcaggatgccttgtggtttgagtgccttgatcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacaggtaaacaatgttaatgtctttctttctgtaaatattttttgaggtcttccaattggcttagtttattttaaatttctaacaatgtgtgaaatttgaacatttgaagtgtagttttgctgtaatagggcaatgtgttattttgaaaatcattgattctcagactacaatatagtatcttaacaaaagtcccttggaaataaattttctaagctattagtttctctagctattagttgatagtgtcccaagaatttattattattattattattttaaattgagatggggtttcactatgttgcccaggctggtctcaaacttctgagctcaagcaatccacctgcctctgcctcccaaagtgctagggttacaggcatgagctaccatgcccggccaataatttttaatttatgtatcgtttctttctttctttctttttttttttaatttaagaaagctgctgtaagtagattggctctggaagctctgaatttaggttgcctatgttcctaacacaggtccaattctcactagctaagcttaggcttagctattatttaaactctccaaacctcagtttccttaactgtaaagtgggaataataataaacctcacctcaaggtcattgtgaggtaaaatgaaataatccatgcgaagggcttagctcagtcaggcttcaagataaatgtgaactgtaattactctatctacctgaattgaatgagttccaacatgaattctggagtcaccacagaagctgctacaacaccaatattaataaattagttttcttttacaatcggccaaaatgtattttcttagattaaaattctttaagttcccaatgacgatgatgaggaggataatacatctagcactttgagcagcacacagttctcgtaactagaaggtaggtattacagttaacttcatttcagatgaagagactgaggggtaggcacattaagggatttgcccaaggatgtacaggtggcagctataggaggcagggtctgaaccaccttagtctgactccagtgccggtgttgttgattattatgctattccatctaacatggtgtgatttgtaatttcatggactcaggtaaatccagggttaaattaacttcggaaaatcacaagcacaattcctaacagaaagaatttgttacttgggtgggctggagtaagatgctcattcaacgtgttctcagagttagaaaaaggcccccgcttggttcaaaaactggactgataggggtcaacagtcatgcttaaataaggacagttatttttccctgaaagatacattgaaaagccagtatcctcaattttctttcttattttggcagtacagagactgcattatttgttgttattcttaaacattaagtgtacatagcccaaagagtataatttcccaatctgcagaggtacagtagttgcatatatacccgtttattttatggtctgacgtaccagtgagcacaaattgtgtatatttataaaacgtgttgatataatgaaagacatgagttggcaatgagatctggtaccaagcgtttacagctaccaaatatattctacaagaatctttaacatttattttaaaaaggtcaaaccttatttttaagagatctctcaaacttaaagaatatttaaaattacttaatttgttagacagtcaagggaagcctaccctgactgaaaactatttaaaattggtaattgtacactaaatacttttctgatgtgctttgtggacacctatctgtcatcaacttattcactctcttttgaagagtttttggtaagactcaaaactttgtatgttttctttagaacatttattaaaaggggactagctagataagtggttggagagttcacacacatagggcctttgttttctactttgacatatatttacttttcaaatgccaattcacttttctagtaacttttagcatttgatactgagtggctatctaatgaagaaggaaagagatgggagtgaaggggacacttttacagtcttttccagtaagaaaacttacgagcaagaaaagaatgaccacataaaaaatgtatgatttggcctggtgtggtggctcacgcctgtaatcgtgggacgctgaggcgggtggatcacttgaggtcaggagttggagacccgtcgggctaacatggtgaaatcccatctctactaaaaatacaaaaaaattagcagggtgtggtggcatgcgcctgtaatcccagctacttgtgaggcttaggcaggagaattgcttaaacccgggacgcggaggttgctgtgaacttagattgcacccctgcactccagcctgggaaacagtctcaaaaaaaaaaaaaaattatgctgcattctaatcaaatagtgcaaagcttcttgtgtgctttgcctttctctgtacacaccttccattaagaaattatagatagggaaattctctggtcaaagtgtaactgtccttcctaggtctgagaaaccactgttatgcctgtgttgagatgtgtatctgtgtgcgtgcatgtgtgtgtatgtatgtatatgaagaatagttcttttttccattaatttaataatgtgtgtgtatgtatgtatatgaagaatagttcttttttccattaatttaataatgtaacttatttgtttacagcatagcttaaaatatttattctataaaggttaagtctaacctgattccttatgagttggatgacagtgtagagagatatttatggctaagttaaagaagtgtgatttaggaagagtgaggaaaccttaacttagataagccctttgcatgttttctactagactcggataattgtgcaactgagatccacagagagtattttgctggactttgggataggagtccagcccagaactacagagccttaagagggaaatgctctgggattgatgatagaaggatggtatgcacaaaatacttgacattggtcacatgtttcaggccatatttgctattttttagcaagcctaatcatccagtgtgaagagaaaaatcagcatattaccacttatttttccatgagatcattccttttcacttctccaaaacttgggcaaaaaactgtcaaaatggccagtttggacaaagctaatttctccagcgccttcccttagcgcttatttttctgagagaggcatggaaagcaggaaaataactgacatttaataaaaagtcatcagcaaagcaattaaaaattttatttgtactctagtcttcagccaatgactcccctgagctggttgtatacggaaagaagtaatttgtttctcacagttaagtgttgctctgagactgggcttgggaaagtaaggtgaaaagatgaatgtcaaaaaatcaacagattgccgtatttacatgacttccaatatgctgtggccagtttttctgttaaaagaaattgactggatgtttttgtcatttcaagtaaatttgatggatatttcaaaagtataggcattgcttaaggatttgttttactctactaccgtgccctagttaacacattgtgttttttaaggcaaccatccagcaaggacgtttacagcaaggactgcaaaattaatatcaatatatcaataccaggaaatggaatgagtcattgccacagatagattagaaatagaaatgaatctgtgattgtaactccaaagctctcacattcaaacttttactatgggtggggagaggatctcgctgcctccccttctttaagacatagaccctcctcctttttaacgtcttatgccttttttcaagggtggagaaatgccatatgattaccatttggcttttatcttgtgtggatatcttcctccaagtatttcctgcaagcagtgtgctgacatttacaaaaggaaaatttttatgccaccaacatcccagaagaaaatttgttgtggtttatcatctctaacacaaaagccctttattaactagtgtaggcattgatgaggatacgcaattcatgtcagacttggttgtctaaaaatcagaggacggacactccttcaaagcacaattgtttcccagcaggtcatggcaagggatagaatcttcttctctttctcatgttggttaaatttttgtttgcctttttcttcaagaaatttattatttatggaacttcacagaggctggaacttttcttctcagtacatagttgagctgagcatctggaaaaattacatctgggtggttttgtgactgactgaatggctctctggttaagctgtgttaagatatctgtgtctcttttacggtgatttatttggccgtttttggccaatgacagggtgttagcaccaaaaacccaaaaccaaaaaaaccaagacaattcactcagagctttgagcctgataattatagcatgagaattggtgcctgaagctggggggaaggtaacccaggccccacagagaggtggttgcatgcaagtgtctaactttttccttgttaatctcattttgaggactccaaacactagaagagaagtgcactggataggatcaagaactactcagtcatttggtagaggcttggaaaaaagagtttagacttctcactatttcaatgttaatttcaaaggcatgtttatttagtctcgtgtcaccatgcaggttatatgtgcttctgttttcattgctggaagagaacctgcaaggtggtggagaagttcttacttaactttgagctgctcccttatctctgcattaccattactgtcatctttttctttgtcatcatcttcattatcttgggtattgtggctgacaatataaccaggttaatggttcctgatggtatcattcagaattactcactcatagttcactttggcctctgatctaattgtgagcccctttctgcaatatctgaatcacctcattggctcacaatccaccatgtaatctacttgtctttcatgttagacttttcgtgaaagatccacctcctcgaagaagcttctggatacttcagcctttattgtggtcttggaagaggagttctgatggaagtgtatctcaacttaacaaatatttattaaacctctcatattttaatctccatcagagtttcagagaatataaaaagaaatataggccggatatggtgcctcacacctgtaaccccagcactttgggagaccaaggcaggcagatcacctgaggtcagaagtttgagaccagtctggccaatatggtgaaaccccatctctactaaaaatacaaaaattagccaggcgtggtggtacacacctgtagtcccagctactggggaggctgaggtaggagaattgcttgaacctaggaggcagaggttgcagtgagcagagattgtgtcaatgcactccagcctgggtgacagagcgagattccgtctcaacaacaacaaaaaaaaagaaatataaaatcagtacacaagtattgtgtagtacaagtaattaggtagttaactgagttctctctgcttttacagcccctatgatttagttgagtaggttatatataataggaggatgtaacatctggaaacagataaataacacttggcagtcactacctcaccatgctatttgatgactaaaggactttggtttgcctacattatttttataatctgaaatgtcctctacacctctcacctgaagaagccttctctgagaccccaaatggcaaagagagggacttccttccctctcaagtttctccaaattattactgtgtattgacacatttattttcttttccactagactatgaactccttgagggcagaatcatgtcttattcatccttctaacctctgtattaggcacaatgctgtaagcatatagttactcaataaatatttgttgaagaaagaaatgaatgaattagtaacaaaatgaggaagcataaaataaatactcgtaagattaatgtagaaaggtaagcctttatggagagttgggaattagactggacagtagacaagatttgaatgaacgttgttattaataataattgctagctaacatttattttgcacttataatgtgccaggtagtgttctgcctggctttccctgtattaagtcatctaatctccaagtcctatgaggtagttactatgattgctatgattatactatttcatagatggggaaactgaagcacagagtgggtagagcatcttgcttatggtcacaaagctactaagtatgtaaatccagatggtcttgctctggggttcatgttcttaccaatgctgtgttgtctcaggaaggaaaaggtggattaataaagaaattaaaccaggaatactgtttcatgttctcagaacagatggcaactctgaatgtgtgaggttatggtgaagcagcggagaatccagttaagcaaaggatagaatactggtaacagaaattcaaactttattttcaagtcattttgaagtaatggcctgggtaagaagaaaatatttcagaatccttatctttggaatgaagctggagttatgggaatggatggctagtcgaaaggagagggcataactgtagaaaaacagagagtggagctgaatctggaaactaactggctctgatgggagtcagctgaaaaggatggttagctagtgaaggagacaaagaaagtggtgagagaggcagggggacacagtgaggctagtggaatgccactaagccaatgagggaaagagtttcaaaaagatagtggttaatagcattaaacataagagggaaaggagtgaataatggcttgggatttggctgaaacgccacctgggacttttgagtttaggcagagacatggagaaggaagataagacttcacaggattaagaaaaagtggagggggacaaaacagagacagtgaaaaggagaggaaatagataaggtaaagacaattaggaacttatatcacctaaaatgtctaccatggtattttgtgcatgtaataataaatgtttgcaaatggctgagtgacttaagtatgtttgacatgtggaaggagccaagtgctggacctgagagagagagagagagggagagagagagagagagagagagagacagagagagagagtgtgtgtgtgtgtgtgtagcattgcagggcttgagggtagagaagggtattattaggaaagaaaggaggaggagggagaggaaaaaaagagggtggggatagttttctcaaggagatagggagggagatttgttgcataggagatgagtgtattagagagaggaggacaaatctctaagaagatggggaggaagagaagagacttataggggtagagataagttagaatgaagctatggtagatgagtgattctatactggtgaacctgaggttaaaaacaaacaaatctctcagagtaggtcatgatgttaaacctatatcaacaagggctactgggtaatacatgccttctctctgaagactttgcccatgtgtactttaaattcttgcttgagtcctcaacaatgcacactatggctaggcttgacctcagctcacggctgagatcacagggtcacagggttcaaaccaaccctgcccaacattatgggcgggactccagtttccagtcagggatgttaatcttagcatttccctgtgtgttttggaacaaggatatggttgcttgaccttggcttggggaggccagtccgctattcttttgccctctcttttttcaaactcaaaagctaatcccaaggatttctcaaggtgggggatgtgattaggagtattagtctatcatactgtgacagaacttttctaggcctcggtttcttcatctgatacatgaagagtttgggctggaggatatctcaggtctactttctggcttaaaagtgcttctgaagtggaattttttaaaaagctaacttttgtcgggtctaacaaggcagctcaactaccccatccccttgtggatgctcttatgacctgatagagcaaatacaagaaattagaaaccagccatctctgaaatcccttgcagggattgctaaccaggatcctaaatgctgctaatgtgcttagaaatgactgctggacttcgagggggcaatgctgcctttgctatctcctgttttcctatgcaatgttaaggtccaacacagtaattatttaaacttctgggccatgacatttacctggaggttctgtatatgacaaggtgatcctgagcagattcttcagaggtatgtgatttaggcagaatggaacagacaggaaaaatgtactgttgtcttcatcacagagttgttttgaatgagggatcaggataattgtggctcaggaggaaaatatggctctcaaatttggttactagattaaaacatatatttagaaaataataaattaatagaggaggtctctttatacctgtgggttttcttttgatccgttaactgaattactataataatatatatgtacagaaagctataattccctggttacctcctatttagactacaggcaaccttttagaatagtgagatttgattttggggagttgtctggtggctcttggtatgggttccactttcatgtaagttaaggtgctcttgctatgttgtccccttagattgtctttctaacattaggagatcagaggaaaattgcagacctgacctgtgaacggtagggattgggtcacactgcatctgagtttatgttgctttgggttaggaagttttggtcccagagcactcacatcctgcattgctgtgtggtgtctctgagtggtagggatgggttacagcacaggtgatggtttttagcaattttaatattaactgtcatcctaatacatatgaacttcctaatgtacatttctatccccaactggcttcctcgaactctagtcctatacttctaactccttctggatctttcctccaggatgaacaaatttcctcttaacttacctcattttgtcaatggtgcctccactcatacccttacccagtgcgtgaactctgggtcggtttccattcctgttcaccatcagtctgtaaaactgagcaccaatgccttgtttgaccctttcataccagctgccacctccacagctcaggccttatgaactcacatcagtgctattgcatcagcctcctgattggtctctgcctcagctcttcccttgctccaagccaagggcagtcaagattgcttgctgcactcctcaaggctgtgctaaccttcccaaagcagcatgtaccacaacattctcaactcagacatcttcagcatctcccatggcctttctggtaaaatctatgtgccttttcttggctccccatgactggtattggccatcttcacctgtttccatcctacataaatggaatactctgccagttcccaataaactctcacactaaggtcatttccatgatcttagcctgtctaaatttgccccagaccttatggcccagctaaatgtgaagtctctacaaaagcctccagaatcatcctgtctggaaacaaggcttctttcgcgtgcctgtcaatgaccctttaaagggttcatgtaccacggatggcttcggagagtagctgattgtgtacctgccttcggatttctcctagaatgaaacagctctgtcttttacatcttcccatctcctaagaatcaagtacattaagtcccttatttatttgatgaataaatgaatgaatgacgctgtcacagcagaagtcagaataccaaaggacgattctgtgacacatcaaaatttcttctcagaaagtactcattgattgtttttgataacttttccctctcaaaaatgaatgccttaggtcttggtgctcatatgggactttttgctactgaactatctgacctttgacttactttctgacagttacatgtagcacaataatttttttaagaggacaagaacaagtgtcctctacattatagtgtctgcctgtgtaggaacacaaataaaggttaaaggtggggcttagattagtgctgaccaaaagcaacttctttactaaattatttatttatttgagatggggtctcactttgttgctcaggctggagtgcagtggtacaatcaccactcactgcagccttgacctcctgggctcaagtgatcctcccacctcagcctcccaaggagctgggactacaggcacatgccaccacagccaggtacccccacacccagctaatttttgtattttttgtagaaatggggtctcgccatgttgcccaggctggtttccatctcctgggttcaagcgatccacctgtgtcatcctcccaaagtgctaggagtacaggtgtaatccactgtgccaggcctttagtaaatttattaatcaggattctatttctatttatattgttacctataatcatttgtccttgttcaaactaaaacctctttagattttgttttaaaaccatactttctgtcaagaacagttaatgtgcttggtataactgatagttgtgatatacacaatcttggccaaagctggttgcttggtctgcttctcttgatggaagtcattgcttctgtcatggtggcctccactacacaactctcttgccttctggttctggtaacttcgctgtcccctggtctctttcgacctaagggtggtcataattctgctgctgcaagtcacaggctctggcactacccctcgtggttctgctcttgccacacctttgccaacagtcctttcataaataaccttcctactcttgcccaattttgtgtgtgccatctgttttcatttgggatctggaatgagacaacatatagttggcccactgtatccacgggttatgcatctttggattcaatgaaccatggatcaaaaacagtatttgtgggatgcagaatctatggatacagaggaccaacaattgcatgacttgagcttccatggattttggtatctgcaggggtcctggaaccaacaccccatggatccagaggaccactgtatatgcatgtttatcaagcttattcaaagccccctttttctgtgtgaagagattttccttaaatcttcatttcttgtgaaaatgggaagactttcaagataacagtcaacagaaaactagatgaaatgaccacagaattatttttaaaccataacttgcattattatcattattattaccattttttcattttaacatgaatttctgggagagagaggctgggtccattcaaagcatggtaggtcatgaatagctttgtttttatcttcattgcagctcagagaggatggtgaaaggtgctacagtctggtgaatgttttgtacttctctttctcttatcagaaggaagccaggccaccagctaaggttatcagagccatagactgttgagtccccctttcttctcagggagcacggtttgtctcacagtttcctgagcaaccaccgggttgtcttgtgggggagcctaccccttacagagcctgaaaaggagccagtggtcagatggtcacgtgttgaagggcatcctgggcctgaacaggaaatatactcagaggaaagttacagtaacttaactagctctgtggtcaggagggaggtgctcttctatgccagggaaatcagcatcaccttcacagtgtgctcacaaatatcacagggcaaaatggctgaaagtagaagctttcattgtttttggttcctacctaacatgtgaaattctgttcagtccgaatttttaaaaggaaacaagataattagaatcttacaacctgatttttcaactgcaaaagaaagtcagactatgatgtgcataaatggaacctgataaagttcttaaagattctggaggaaaatcacattttgctaattaatcatgtattccagctctctaactgcttctttagcttcccagtacgttttatttctctatggtgctacgataaagaaaaggaaaaactatgacaaacaaatgtaattcacaaaagccctgaagttaaggattttcctagtgaagttcagactgaaatgtgatttcatgtgttgactcatgtctatgttcaatcccttttgtacacttgggtaagctagaatggaagatctcaatggtataattattacttgtgcatcagaaataatttataagattatttgatgtgatcatactgtctgtaagccttatctgggatccatctatgaccttcaggaaatcttcaaaattgtaagcaaaatgttttgtatatgtgcattagaggcaaaaaatttggaaatgtatttttttctagatatgagcatgaaataaattcagtcttgctgaatgaacaaagttgtttttctgtccatttatgatttaaaacattactcctagatgtctaaataaataaattacatcttagctcttccattatttgtgtgaccttgtttgaaaagtcatttacttcttctctttttttccccccaatagcctcttctttaaaataaggaattggcatagatcatctccaagttcccttccagttgagtgtggttttttgcaggataagactctaataaaatagtggggaaaatgaaatgtattttgttctggtcctcttcccattccattcactcccctacttaatggtaatctcctccctaaccctcactccagacatctggtaccatcctccctatcaagtccaactttgagaggatctagaaccaatcactgcaattgtgttgaaattttgatgcaacatggcagaaggaaatgaacaatagattagaagtcataagttatgagcttaaatttcaaggatcacttatgtttcctgtaaccttggacaactcatctacctctttgacctcagtttccccatctgtaagatgggcataaagatgactgtcctgcctatttacttcacagttgaatatagagttcagatgagataagagacagcattttatagccctgtgaatgtaagccatagatactaaattaagccaatgtgtttcccatattgcattttgggcttcattttctttggaaatctaagcattaactgagctggtgggagggtccttttaaggtcagggttctttgatgctgggagccacaccttagaggtggttaccaccccacctatgcagagggttgacctcattactaaatatggtaattgacccgtttataataggtgtaaacggcaagagttgtttttttttgtaaccaagcttccccaccacccactgccattctcatggaagttcaagcaactttcaattttcctgaagtcggctgtttcacaagattcacagattatctgtgggaaatcttttagctctcagtaccttgctcacaagcagcagataagtaccttctcacctccaatctcactcttcatgttgcctgttgttaagcaggagctgtgagggaaagaggtttgaggttagtgcttcctgtctccacacctttagctggtttagctgctaggaaaggctttgaaaagcaaagcactaaattcaccttcaaaacaacttgtcaattcagttagagaaatgtcagtcagaccaatcttttgataacgtaagcaaagaaaatggatgggttgacaatgtttcttttaacctagtaggtttgacctaggtagaccttacctgaacactcacaagaagtaaaatcaaatattcacagggaaagggctgggtctcctgatacccaagtagcctaagaagaatgccttccactcctagcatgaactggaaagcaaaaagaaatcaaacacaagttaggacgagggagctacatatttgggtttcttctgagtctagatatgtccttacatttgtaatatgtccttacattatttgaagtactgtggattttcagaaactcagagaccgaaaatacatatcaaagccaaatgtcatctgatattctgattatcagctactttgatttctccatgtttttacttcatagagcaaggggtgtgcatttttacacatgccccattttaaaagaaaataagagaaatcagaattattgtgtttactcaaagtcacaatgatcacacatattcagtatcacttagagtcactggttatctttttctagcaccaaaagtaaatttctctcatttactgtcttgcaaagcatatagagattttgaggtcctgtgagatagtttcctatttaggcttctctgaattattgacatgaaccaaggtgggaccaaatgctatgaggatataaatattgagaaacgagattttatcagccaaccttgaactcagcttgaactctaaactaggaggctgttagctacatgttaacacatagtaagcaaacgatttcaagcacagtatctgtgtttgagagccagctaatttaaaaatgatctatgttgacaaagaagagggaggaaagtaaacatgagcaataaattggatggcttttcctcaaatggccttatcgaaaacaaatagttttcaagctcttttccagcaaaatcttagcacttttctgcataaaagccttcagtagatcttcatcaccttcagaagagagcccaacctctctaatggagtgaactatgcttgctctgacaatcttgtcttttgtaactcatggcccagcaaaaagaaggtagctgtaattccccaagtcggccacactcttaccctcctcatctcccttgcccagactactctttttctctctttgtcttatcctccccacagtcccctaactcaccccagcccaaacacacactctcccacctcaccccagtccccaacacaaagacacgtcttagccaggctaacttttacttagtaaaagttggtcaaatccatgtatgcatactccttcaggactcaggtcagccgtcatctcctgagatccttagctggtttccctgttgcccccggaagttttgtgcagatcactgtgtcactatgtttaaagtagggtctatttatatctttcttccccatcagatcatgagctgccgtaggacgggaattgagtggcattcatttttgggaaatcaattcttctctcccatgtgcatcttaggaacatgtcacaccctgagttagacaggacatattcagcaaaccactggactctagatgccacagcttttcttccttcctctctctcccttccctctctccacctcactgtgtgtgctgggagagggagtcaaactggggagccatctggggtttctctccagcccacccacactccctttttttgtctccacaaagaagtcctattctcattcccatctttttctttaaatcagctcacaaaggcagatcaggaagaatttgaatgtgcattaaaacagaatccaaataattagcaatagaaacacaattcccagggcggtgagcaagcagaatacaaatgcctaacctgcactcactctctgaaaaggaggagagatgcaggcattgcttgctggagttggttgctcttccaattagaactgacctaatgactccttctaagtaaaaaaaggaaacaaacaaaataaatcaaaaacaaaaaaacaaattggatgtttgtattaagacaggtcgaactttttgattctttgcatgtttatttttcagtgcttttgcaaaatatttgtggaacaaataataagtgaagttaaagttgttgacacaggtttccaaaaaggatttaatgagatggtagtcaaacctagctgctgataacaacaatacagccgaatcaccatctttcactccacaattattttatgagagtctattagtcatactgtgttatgtaaagaagcataacatgtggtcctttctgtcaagagacttggaaaccaggggcctaagggaaatgcacatgaatccaaagctaagcaaattgaagcatgtgaaacaagagttgtttaaaaggtagaactcaaatgtcaagtgagcgatacagatagtaatcattttgagacctgagaagggagtggtgctctgtgccaaggagttagtagacaaggcatggaggtaggaatgctcacagtctgttcttgggatgttggcttaaatggtctaattaggagggcttcggtttgaggaaatgaggttggaaaaacctgtggaggccgatttgaggataagaagttagttttcctctgttaggccactggttctcaaatttgactgccatctagaattactagagaaacttaaaaaatatgaatggatgcctgggtcctatacctagagattctgatttaattggccttggaaaaccaaaggcttttagatttttccaggtgattctaaatatgttgtcaggtgaattccactaggccatagtggctttcaacccaattgaatattagaatcaagtgggggaacttttaagataatatgaaagacaatccacagaatgagagaaaacatttacaaatcacatatctgataagaaacttgtatcaaggctgaggcaggcagatcatctgaggtcaggagtttgagaccagcctggcccacatggagaaaccccatctctactaaaaatataaaaattagctgggggtggtggtggtcacctccaattccagctactcgggaggctgaggcaggaggattgcttgattctgggtggcagaggctgcagtgagccaagatcatgccactgcactccagcctgggtgacagagtgagactctgtaaaaataaaaaaaaaaaagtataaaaaatgcatacagaactccaataattcaataataaaaagataaatagcctaaccagttaataaatgggcaaatgatctgaatagagagttctctaaaaagaatagaccaatggctaataagcacatgaaaagatgcttagcatcattagttattagagaaatagcaaatcaaaccatgatgagatatcacttcacgtccaccaggatggctataatagaaaagatgaacaataacaagtgtcggcaagggtgaggataaattggagccctcattcactgctggtgagaatgtacaatggtgcagttgctttggcaacagtttgacgattcctcaaaaagttaaacatagagttaccatatgacccagcaattttactgctggcaaatacctaagagagttgaaaacatacgtccacacaaaaatctgtatgcaaatgctcatagtagcattattcataatagccaaaaagtgatgaatagaaaaacaaaatgtagtatagccatacaatggaatattatttggccatgaagagtgaagttctggtgcatgcaacaacatggatgaaacttgaaacatggatgaaacttgaaaacattatgctaagtgaaagaaacgagacacaaaaagccacatattgtatgattctacttataaaaaaagtccagaataggcaaattcatagggccaaagtagatcagtggtttccagggatttaagggagggaggaagcagggtgatggtaaatgggtatggtatttctttatggagtaatgaaaatgttctggaatcagatagtggtgattcattcataactttgtgaatatactaaaaaatctctgaattttacactttaaaacagcaaactttatagtacctgaattatatctcaataaagttattatctaaaataaagaaaaaaaacttagtatcaatccttccccccagcctagaccaattaaatcagaatttccggaagtgggaggacttgggcacagatattttttcattttaaagttcttgatataaagccagcaatgattttttaaaaataattttgtagagatgggttctttctatgttgcccaggctggtcttgaactcctgggctcaagcattcatcccgccttggcctcccaaagtgctaggatcacaaaggtgtgagccatcatccccagccagcattattgattatataggagacaaaaagctactattaatttagttctatgccatttccttcttaccaaaaccaaaacaaaacacctgtgtatatgaattcaaattcagttaaattgtaaatttcatttaaaaatgaatctgattttatttggctcttcagtgtgggtatacgggatgttgcttcaaataaacttaaaagaaatgcaagtaggtaaataattattaacataccccaaaacaagagcaaaaaaatgcttttgtttgcattgaaatttgaatcaaagacacaaagtggtttgttgttttagaaaaattcttgagggccaggcgcagtggctcacacctgtaatcccagcactatgggaggccgaggcggtggatcacctgaggttgggagttcgagacaagcctgaccaacatggagaaaccccgtctctactaaaaatagaaaattagccgggcatggtggtgcatacctgttaatcccagctactcgggaggctgaggcaggagaatcacctgaacccagagggtggaggttgcagtcagctgagatcgcaccattgcactccagcctgggcaacaagagcgaaactctgtctccagaaaaaaaaaaaaaagaaaaattttggaaggtgtcttggttgcaaagttgattctcagtttctcagtgcttcagtggtctatttctcaggtggtcatagccaacttgggttttagttctggctttgctcaccatttgtttggtgacttcagacaaaccagctaatgtttctaggccttatacaatcattagaaaagaaaaaaaaaaagaaataatattgtcctgtgccaacaatgaggataccatgggaaatgagatcaatgtgttctcttcacttatggagttgataaactagtttcaggttctttgcttttaaagattgaactaaatgctctccagattctttgatcttttattgggatagcagtaaaggtagatgatggaccagagagataactcccctctggagtctttcacctttcatgatataagggaatagatctatgaatttcttggggaggctattctctgaatttggtgcagaaaacacattaaagcaaactcttgggttatattttttcttatctcttcatcccactcttgcaatgggcaataaacaaagtaaaaatgtttcaaaatattttaattcctttacaaaaacctgtatcacaacttaaaaacaaatctatttgtaggttgggcttggtggctcatgcttgtaatcccagcactttgggaggccaaggtggtcagatcacttgaggccaggagtttgagaccaggctagccaacatggtgaaaccccgtctatactaaaaaaatagaaaaattagctgggcgtggtggtgcatacctgtaatcccagctacttaagagactgaggcaggagaattgtttgaactcggtgggtggaggttgcagtgagctgagattgcaccactgcacttcagcctgggcaacagagcaagactctgtctcaaaaacaaacaaacaaagaaacagatctatttttgtgtctgtgtcaggcactaaagccacctccaaatatatcactcagtcaggaaattggcccaatgcatgattaatattaatgtctcaggaatatagatttaaaaattgtgagtgcctagctgtggtgctcaatgctaacagaaagccatgtactgccttctgggtgaaaacatgctccattgttccattcaaaagaggatgaaaataatattgaaatgttaacttttgaactctcagtataattatcccctgaagaggtcctacatcttctgccaagagaaaacctttgctggagatctgttcatttagttaattaatatattttgctctcaggaagaaaaattatccttatattcttgttctaagcaaatgatttttttttcccccaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaaggtaacatacaactttaccagtgtaccaccctaaagtaatggttttcaaatgcagtcctgaaaactgggttgtggtcagtggtggggttgaataaggcctaagtgatttgatactaacaaagacaaataatgttttcagaaaaatttttccctttactgtagaggagattcaaggttatattttgaatatctttattttcctttgctgacattgagcgggagagtaagtgatgaagttaccgcatgtgggaacagatcatttttctccattccagtggatcatggcagaaaagaggttaccattaaaatataagcccaggtgccctcaagtaacagctgggtctaatgggttaagactcaggaagactcacttctatttctaattaattctttttttgtgctccataatcttcctctgtaaaagtacctttccattttctttttccttccttccttctttccttccttccttccttccttccttttcttttctttttctttttctttttttttgagacggactctcgctctgtcgcccaggctggagtgcagtggcgggatctcagttcactgcaagctctgcctcccgggttcacgtcattctcctgcctcagcctcccgatcagctgggactacaggtgcccgccaccacgcctggcttattttttgtatatttatttatttatttattttaattaattaattttttttttgagagggagtcttgctctgtcgcccaggctggaatgcggtggcgcgatctcggctcactgcaagctccgcctcccaggttcatgccattctcctgcctcagcctcctgagtagctgggactacaggtacctgccaccatgcccggctaattttttgtatttttagtagacagggtttcaccttgttagccaggatggtctcgatttcctgacctcgtgacccgcccgtgttggcctcccaaagtgctgggattacaggcgtgagccaccgcgcccagccattttttgtacttttagtagagacggggtttcaccgtgttagcaaggatggtctcaatctcctgacctcgtgatctgcccacctgggcctcccaaagtgctgtgattacaggcataagccaccgcgcccagcccgtacctttccattttctaaaatatacaaagaatgctggactagaaaccgggggacataaaatttgctattaatcaactgtgtgatcttggataagtcacctaactttttcatagtcaaaaactcagtacaactgttaagcagtatttgtgaattagtgaaaataagtctactgaacttttgttgatgttatgttctgcctaaatgttagggagaaaaatcatgattccccaactcagaagaatacagtattggtagcaacaagtaaagtttgattttttggtatactttgtggatatatcatagcttttcatttttgtggaatgataataagaaacacatatgttcagttttgtactgaatcctagcataatgccaatgaatggtttttcttcaatgctggaacagagccatgctgatgaaaaataggatactaaataaggaaagaattgttaatgtggcagataagcttttgtgttctggcaaaatagagacaattaatgtgtgaatattttgtttgctgagtcctatttagatttctaatatctgtaatatccaaacagaatattttaattgtatcaagtcaaaggttaaaaaattatgctattttgcttgtagctaagagtgaaatattttttcctatatgaaaggcatgctactttaggatagtattttatatatatgtatacacacatatacacatatcatttatgttagaactgagaaggacaccaatgatcctgtacttagtaattttcaatcctatctgtatattataaatctgagtaggttttaaaagaaataccaatgcctagttccagccctgagattctgatgtaattgatatgggttgaggaaggggtgctggacatcagtatattttcaaactttctcagataatttattgtgcagctaggatggaaaatcaatggactagaggatttttggtatgctttctagttctaattttctccaattttgaatagaattctataggttccttctcatccccttttgattcctaaagatataaagtgatttgtttgtcattatataatctatgagacagggttggaactagaaatttatcctctgattagcagtccagtgttctgactgccatattaggctgatgattttcttaaggcttgaaaacatgcatattatttaacttattccaaggatgcagtttagggtctagattaactatcttctgatgggagaaagggataaagttaggttaaggccattggaagtcaccgttttgaatcacacagtagaatccacaaagtcaagtgaatacaagtctaccagtgtaccatcctaacgtaatggctttcaactgtggtcgtgaaaactgaccagatcatggtcagtggtggggttgggtaagtctcaaagaggaaatctattcactctaagctggtgatatgtttaatatttttatttctttcacatttttctctgatgttcacaaggaaggaaatgcactcaattgctattcctgtatcatttaatccactctattttgtttttcagggaaacacctttgtccaagtcccctatttcccggaccttctaagcccttttgggtgctggtggtggttggtggagtcctggcttgctatagcttgctagtaacagtggcctttattattttctgggtaagagaagcagcactgcttttatgtaacttttccactgcacatgaaatctgaacacattcaagaattttgcctatgtggtttattttctgtttaatataggatgatgattttcttttccccatgcttgagtaggttctcttttagcttgttcaactctatctgagataaaaatctgatatgagttagatttcccagaaggcattgagtaggtggtgaggcaaaataagaagctaaatgggtaaattagggtggagggattaggagcagttgcctttcttctccccattttgcaatataattatgacacataaaacagttttaatgcgtatatatgtataaacacctaggcaacttgggaagctaggcaactgaagccaatggacaatgttggcttgatcaaaaatcatgagaaacttggctactgaaattgtgtattcaaacctagcaaagaaactagatctgtttatctgagtcatatttttttttctcctctgaagcagttgaattgtgtgaggccaagtatggtgctgtcattatgaaactataatgggagttagaattttctgagctctcaccactgaattgaagtactaacttttgcaaatgtttacgtaataaatgtggtgtatttttctttaccttcctcaacattgaatttttggcctgggtttgaacacattttgatgaacgcacctacagttaagaacgtacccctgagtgacccttgttcttactcagaaacttcttaggtacatagtatggtacagaatgtattgactccatgttgtctttgaatttttttctagaagttacatgcatggatgagtcatttcttcaatgagaaatgtattctcaaacataaaagactatttctcttgatagtctccaaaagactatttctcttgatattctccatttgatattaagtacatttggtgcttaatgaatgcttattggattgatgaattgataacctccagagaggtcaaattaaggatttaaatgagtctgcctgaagtatgatactcatctttaaggcataatctgtatatgtacctaattcatagatgggtcagtgatttctgaaagccatatcatgtgaagtcattctgtttactgtcagcttggtgactgcgggtacagacctggatccacagccatgccttcctattatccagtcttagattcttttagactcttcttggcctattgccaaagcttacctttcagttgttccccacatgctccttgcagttcagaagaccctagggctcagatggacatttgtcaggctgcctgttgcttactctgtacttgccgcagggtaggaaacaaagtggttgcttgttcctggaaattctttatactaggtatcatcttaagaatttgcctggcttgccttctgcaagttgcccaaccctgaaggtggggctttggtattgtaaaatgttgcctgaattctgcctctgatgttagttgactactttcacctttccagatcttggtatcttcatccaacttaccttctaactttgatcctctggtgtttgctgataattttcgagtttttagaattcttagttcttgtttcttcttaatctctggccattggcttttatgcctaccatatggcttttcaatcctcttattgggaatctcaactttctaacttaaaggccaggtgcagtggccctttggatacccctccaggaaaggcattcccctgtgatatgctgacctaggtcaaagtaatttactagctctgcagaaagtagttttgggaattactttaaccttcaatggccagaggacactgctcattattgaaaacttattataaatattcattagaatgtcagttactataatgagacatcaatttgttgagtgacttgagtcacccaaagggacaaaagcagcttctcactttcaatgaatttaaaccgttcactttcaactcagacacatcatagacacactgggtttttccttggcagtactactaattcctagtgagattcatcttgctttgttttaaaaaaattttatttttgttttactttgtcttacagaccccctgtgaattgggcagtcctgtcatttgtggcctcttgtagtcaattcggttacccaataaaaactaccacttatctgcatctcaaacctgggtctttgtactctcttaccaaaagagtataaatacaagtttgtctatatttcgtagaataacatagtatttttactctgggctcatcttttcctgctgttggtatttaagcaacaagtaccttgctgagttgggcatctaggccattatggatccctggagtttagctgtttcctgggtaattttctgagatcctatttttggctggtctgcagcgtgccttgatgtaagttgctgttttccggaacttcctgagggcctgatatgctactgtaggcagttctgggttgagtgggtttctaggctgagcgggtttctgggagcagctgcagattctatctcagttcttgacctgatgttgacatttgagtaaataaagagctccctttggtcaagctgtcacaggccagcacctgtcactgtctttcaattctccattcatgcagctgtgctggtaaagctgcccgttttcctaaagaaatctttttaaaaaacattatgttccccactgcagatcataatgtgaggaatgtagatagtgtgtgtacaggtagtgtctgctttttataataatccagtagattcttgaagaccacgtacttaagtagattaccttgcatatgccctgtgtattgctgctgttcccaggaaacaagtgggtaaggctggcatggggagaagggcaaaggaggaatggtccagaaattacatatcattagctgacattcactgttgaaggggtggagatgacacagacacatagggtaggtacttcctgcacacatatgcacacatactcaatgcacatgggtgctgtaggttctgcgtggtgtttgttcccagccatgcatctgtcattttcatcccactgctgtgtttagagttagggtgataataagtaagtctgccatctgacaatcacttgaggataagcatgggagctgactgcaacagacctttcattattttatgtgcaatgtaaagaacctgagaatcaagacacctttattgctgtggcctctctaccagctatgatttggtttgggtgtccggaggcagaggctgacacttggaggtttggcaaagggagtcctcagggttggagtaagtactaaaaatgcttcccaggttatcagctgttttctacactcatctggggacagacatttcctcggcctcacccctgccctgctgtgatcttgtgctcaagacagctctagtctttcatttacagaaaggatgtagaaccaaaacaattcttcattgcattgtaggatgtttagcagcatctctgacctctacccagtagatgccagtagcatccctccccgttgtgatgatccaaaatgtttttagacttcactaaatgtctcctgggacagggattaagggagcttgaggtgtcaaggatgaggttaggaggtctgtcttgggcagctgtatatatggtagtgtcattcactcagatgagaaacactggtaaaaaaaaaacagcatttgggggaaatcttgagttttattttagacatgttgagtttagagtggctttgaggtttagtccagagatataaatttgggtgagtaggtggtaattgaagctgtgaatgtggataagattgcctagggaaagaggatagagaagaaggcctaggaccaagcagtgagaaattctaacggctggttagagaaggatgagcttgcaaaggaggcagggaaggagtgacaagacaggtaggataaaaactgggatgtcatagatggcaaagagaaatagtatcacaaaaagaagagagttatcaatagtatagaatactgctgagagttgaagaagatgaggacttaaaacatgttagctgtgtttagtaacatggaagtcagcgtttttcaaacctttctttagcacttactcatgcccctttgacaaggaaggtgtgaagtgctcaggcaggagtgtatggaaacaaaaccagggctgaaatcattcacttatttattcattcaggtatcatgtcattcatgtacagcattatctacttaggtatcagcctgtgtgccaggaactaggcacttttttcataatagagaattctgaatccagaaatctgatggctttctgtttttagatgttttctgggtcatttgttaagaaatgtagaattttactatcacattgattcagaaatgatgttcctaacccttagtcaaaaattttgctaagattcatggtgggtgaaactattgcccttacttccctcacttctggtggaaattcatcctgatggagccaagcctatgaaagagagatgagtgtagaaatacatacccataaagacataggaatgtactagttgtctagaactgtaaattgccattagtttggactccacctttacaaatttgtgattattacagactctggaggagttgaaagtcctcttcggttaattatggaaaaacagcttgttaagcaaatgctaatgtaagaagatcacaatgtgggtaggcttaacctagtcaaaggaggaagggccttcaagtgtatttacatatcaacagtggatatgttaattagtgtgcatttttaattcaggtcagatgacagcattgagagtaacagggatgcatttctctaaaatactttctttgagatttttcaagttcaatgtgaagagtcagtagttgggtgtgattagtcattacccaagtccaaggtgctcaaaaaaggttagtgttttagtgtctctgtcatttgacagttaatattatgaatagttgtgcccacagtcttagaactccttccatgacattgtccctccatactgacacttctctttcctgcaggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataaggtcactttatgtcaaaattatttgagtactatgggacctggcgcagtggctcatgcttgtaatcccagcactttgggaggccgaggtgggcagatcacttgagatcaggaccagcctggtcaagatggtgaaactccgtctgtactaaaaatacaaaatttagcttggcctggtggcaggcacctgtaatcccagctgcccaggaggctgaggcatgagaatcgcttgaacctggcaggcggaggttgcagtgagccgagatagtgccacagctctccagcctgggcgacagagtgagactccatctcaaacaacaacaacaacaacaacaacaacaacaaaccacaaaattatttgagtactgtgaaggattatttgtctaacagttcattccaatcagaccaggtaggagctttcctgtttcatatgtttcagggttgcacagttggtctctttaatgtcggtgtggagatccaaagtgggttgtggaaagagcgtccataggagaagtgagaatactgtgaaaaagggatgttagcattcattagagtatgaggatgagtcccaagaaggttctttggaaggaggacgaatagaatggagtaatgaaattcttgccatgtgctgaggagatagccagcattaggtgacaatcttccagaagtggtcaggcagaaggtgccctggtgagagctcctttacagggactttatgtggtttagggctcagagctccaaaactctgggctcagctgctcctgtaccttggaggtccattcacatgggaaagtattttggaatgtgtcttttgaagagagcatcagagttcttaagggactgggtaaggcctgaccctgaaatgaccatggatatttttctacctacagtttgagtcaactagaatatgcctggggaccttgaagaatggcccttcagtggccctcaccatttgttcatgcttcagttaattcaggtgttgaaggagcttaggttttagaggcacgtagacttggttcaagtctcgttagtagttgaatagcctcaggcaagtcactgcccacctaagatgatggttcttcaactataaaatggagataatggttacaaatgtctcttcctatagtataatctccataagggcatggcccaagtctgtctttgactctgcctatccctgacatttagtagcatgcccgacatacaatgttagctattggtattattgccatatagataaattatgtataaaaattaaactgggcaatagcctaagaaggggggaatattgtaacacaaatttaaacccactacgcagggatgaggtgctataatatgaggaccttttaacttccatcattttcctgtttcttgaaatagtttatcttgtaatgaaatataaggcacctcccacttttatgtatagaaagaggtcttttaatttttttttaatgtgagaaggaagggaggagtaggaatcttgagattccagatcgaaaatactgtactttggttgatttttaagtgggcttccattccatggatttaatcagtcccaagaagatcaaactcagcagtacttgggtgctgaagaactgttggatttaccctggcacgtgtgccacttgccagcttcttgggcacacagagttcttcaatccaagttatcagattgtatttgaaaatgacagagctggagagttttttgaaatggcagtggcaaataaataaatacttttttttaaatggaaagacttgatctatggtaataaatgattttgttttctgactggaaaaataggcctactaaagatgaatcacacttgagatgtttcttactcactctgcacagaaacaaagaagaaatgttatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctacatattcagtgataaaattactaaactactatatgtctgctttaaatttgtactttaatattgtcttttggtattaagaaagatatgctttcagaatagatatgcttcgctttggcaaggaatttggatagaacttgctatttaaaagaggtgtggggtaaatccttgtataaatctccagtttagccttttttgaaaaagctagactttcaaatactaatttcacttcaagcagggtacgtttctggtttgtttgcttgacttcagtcacaatttcttatcagaccaatggctgacctctttgagatgtcaggctaggcttacctatgtgttctgtgtcatgtgaatgctgagaagtttgacagagatccaacttcagccttgaccccatcagtccctcgggttaactaactgagccaccggtcctcatggctattttaatgagggtattgatggttaaatgcatgtctgatcccttatcccagccatttgcactgccagctgggaactataccagacctggatactgatcccaaagtgttaaattcaactacatgctggagattagagatggtgccaataaaggacccagaaccaggatcttgattgctatagacttattaataatccaggtcaaagagagtgacacacactctctcaagacctggggtgagggagtctgtgttatctgcaaggccatttgaggctcagaaagtctctctttcctatagatatatgcatactttctgacatataggaatgtatcaggaatactcaaccatcacaggcatgttcctacctcagggcctttacatgtcctgtttactctgtctagaatgtccttctgtagatgacctggcttgcctcgtcacccttcaggtccttgctcaagtgtcatcttctcccctagttaaactaccccacaccctgtctgctttccttgcttatttttctccatagcattttaccatctcttacattagacatttttcttatttatttgtagtttataagcttcatgaggcaagtaactttgctttgtttcttgctgtatctccagtgcccagagcagtgcctggtatataataaatatttattgactgagtgaatgagttttacatggccttatgaattaacggtgagtctaaatgttataatcatactttgagagggagaaagccagttctattttctactttcctcttaagaagttcaaaaattcattttattaaaaaaacaggaggtaaaatatatacacagccaaatctagtgaaagaaaatctgatgaatataagttcatttacgttttagaaatttttgtgcagtgaggaaaaccagtactgttagaaaagtcatgccaactcagccactgtcaggagtaagttgattttccattgaagtccccaaattccctcttaatggagtattggctatatcttaaacatatctttagtttaagacttctgaaaatgttgtctttgtctaaaatgttaaaatcccatcctactactgacctgctactcttttttctggggtgattttacccccaacaaattctataaatgccttctctggctctgattcaaaaagtgctcacaaatggaaatgctggggacagaaaatttcaacttcttcacctgtcatactcatatcatagctgaacactctaatagcacacacacacacacacacacacacacacagacacacacacacacacacacacccctatcatcttctgggtaggggaagggaaaggcgcttgaacaacagacacaagagctggtctaataattcatgtagcaccttctgtttccttcgttgaaattttactctgaaggtgactcagagtcaattaaattggtgtgcaatgagttcatctctaaactgattcttttctttggtgaaatgaagcttattaaacttaataaaggtaattaaacttgaaaaagatgagcttatatgtctcttactactccaagaaagactgaactcagctggttactcatggatagttcaataagacaaatcaaatcaattggaaaggaacgagatgggtaaaaaaaaaaaagccgttaaatgaatctgctcaataagcactcctttaccatgctaataaaaataatgtaacccagttctgtaaaaaggttctagtactttgaaactcaagttcaaaacaaaataaaatgcaaacttcgcttcacctaacacctcccacaacattctagctacccaactgggtgaatattgtaattgcccacaaccccgaattcactttttccctccagtatgataaaacagattgattcccttttaaagcaataccctttcttctctcccatcttgtcggtatcagagataatggataggtgagaaaaaattaaagaagcttctggattcattgtaatggggacctaaccatcacactatgcagcagcaaatgggatggtctggaaagcagaccagaaccttgtctggtaactttgcttctaatgtctgtctgtgtttcctaaactgaggcctaactcttgactttttgacagtggtgctcataagaaagtttggggctgggcacggtcactcatgcctgtaatgtcagcactttgggaggctaatgcaggaggatcacttgagtctaggagttcaagaccagcttgaacaacatagggagaccctgtctgtattaaaaaaaaaaattagccagacgtgatggtgcaggcctgtagtcccagctacttaggaggctgaggctgcagtgatctgggatcataccccttcaagaacacatgtgaatggtggggcctctcagctttctctgatttggcaacccagaagaaatatgtgctttctctttgaagattcacaggatcctagcacttggaaacctaggccactgtccagagcagaaggtcacacaatttctcagtgtgacttttgttcatttcagggtgttgacactgggcccaacacttgaaaattgcttgagatgataaattgcttgaggtgatcaaagaatatatcagctcttcaaagctgacctcattcttggtgcaactctcagggccagaatgtgtgcttcccgaagctcattttcctatctgatttgcctgttgaaactctgtgaaagacccttgaatgctaggaatttgaagggacaaaaagttgaagaaaggtgaatggatttcagggtggaagtggactggattttactctcacttcatcaggcagagctatctcagtgataaattgaaactctcctctggctccaaagaacaaatcatgagctgggtggaaatgtcagttgagaagaagagcagcaaacagctttgttttcctatagttgtggttttacatggtgatgatgacacacgaagatgaaaatgtgcagcatgaactccagttgttatctgagtgagcatctctgccaacactgaaggatatgtgtgggtgtcacctgaaaacaaagagaaagacagagagagaaaaagaagaaaaggaggccctgtttcggaaagaagagccagttaatcaaagatcagcagtgacaagtggcgctgtttatttcatgagctttatatgtgatttccttccccttgctaatctcgtctgaatttattctctggactaaatatatttgcatctggtgactgaggaaggggtggaaaaggtgaccttgaatgggcatcagggtagttaccatagttatttagtcatttcttcagtctcttgggcacacacttagcttcccaaatggaggtttctgctaacttttgagaacctgtgacatattacacagggaagacaaacttcaggtggttgttggggaccctcttttatccccaaccctatgcaatgcttgtttcatttgctttatgtttctccttcctctcttctacttcattcattctagaactagttaatgggcacctgcccagcactaagatgtgggctaggtacagggatgtggcagtgtgcagcacagatattacctccacacttccgaagtgtagagtgtctgctttgtatattacttcagttttttttttcttttcctgccccctatatcctgcttctaggggtaaccacttagtcttgattttggggcttagatcttaatgtggctacttgatagcctttgttggtttgcctgaaattcatttctttgacatgttcctatttaacatctctaactctttcaatgtcatagatcaggaatcagcaaatttttttctgttaagggccagatagtaaatattttaggctttgtgactatactgtctcttatagataataagttttgccactgtagtgtgaaagcagccataaacaatatataaacaaataagcatggctgcattccaataaacctttatttatggatattgatatgtgaagttcgtgtgattttcatgtcatgcaatattacttttcctttgtttttttcccccaaccatttatagatggaaaatccatttttagttcatgggctgtacaaaggcaggtagtgggctggacatggcttatgggctacggtttgctgatccttgacttagatctaagctgcaaccttagctataggcttatttttgagttccagccaccttctacatttttagggccagaaggaattggtttgaatgtgtgtaaaggcttcttgggagtgctgagagtcaagcatctcttttgaaagaaggacatggatcaataaagaagaaggaagagctttcatctaaggaaagccatttgaggtagaagaaatgggaagttataagcaaagggaatgagaagctgtttcaggaagacagagtcttctgtatattattattattaattttgacagagtcttgctctgtcacccaggctggagtacagtagcatgatctcagctcactacatcctctgcctctcggggtcaagcgattctcatgcctcagtctcctcagtagctgggatgataggcacacgccaccactcccggctaatttttttattttttatttttatttttagtagagatggggtttcaccatgttggccaggctggtctcgaacgcctggcctcaagtgatccacccaccacggcctcccaaagtgttgggattacaggcatgagccactgtgcctggcctatattattgatgaaagcctaaacatcttgggagctcttgttactcttttctcaagtcctttctactcttttccctcttttctaggcatcacatccttgtaatctccaaggaaacaaatttctttctttcttttttttttttttgagatggagtctcgatctatcgcccaggctggagtgcagtggcactatctccgctcactgcaagctctgcctcctggttcatgccattctcctgcctcagcctcccgagtagatgggactacaggcatccgccacccaccaccacgcctggctaattttttgtatttttagtagagacagggtttcaccatgttagccaggatggtctcgatctcctgacctcgtgatccgcccaccttggcctcccaaagtgctgggattataggcatgagccaccgcgcccggccaggaaacaaatgcacagaaggaagggggcagaaaatggtctgtgtccaatgtgatgaacaggcttgacttccctgctaattcttccctaagtagtacatccaaatccaactctgggtgggtagagatcagaagcagctgtctcagaattggcctcctactttctacctatctcatgtttccagtctgcatttggctgccatttatgagtggccaagagtaacccctcatgaatctacattaaggctcagcatttcacaagtagctgatgaaatcagtattactcagatcagaaaggcaccgacctaacccttaccatcccttgcccccattcctcactccagtcttgttatacccaaggtacaaatcgttcctggaagcagcccagcatatgggggcaccctaagccacacacccagtcacaccatctgggcaatttaaaaatagggccaaatggagcatttagactggtctgtccagccaagatcaggaaattgcctctaaaaggtcagatgattaagattattgtaccaacagtctaggatgtcagtaatgaaaaaaagcttctggcagaatgaattttcctgactttacacatggtgttccagttctgagttggggtgaacagctttgggaaatcccaagatttttctactccagaaaatagtgctactatgtacatttatgcactgtgtgccttgcacaaaggcccctagtgaagggaatgaagagggctgaaatctagtcaagctccccttatcaagctctgcacctgcttaatgaaggagagggcgccttctctaatgcccgcatgtatgggctattgaggccctgatagaatgctagcctttctgccatttggttactgagctttatagaaattatatccccattctcaaagcaggaattttctaggatgagtaatagttaaaacaaaataaaactacccctcccccacaaaatggaatggttctaaatatcacaaaaatttatctcctcggtcccttctttagtcttcccttcaccttagctctgcatgttttaatttagttggttggtttttcttgacttacactgggtgggtatgtctttggagagtaatgagagaagaaacttcctagttcgtgtcctagtttggctcttagaagaaaaacaaaaaatgtttttgtgacctgaggaatactaggtaatatagcttggatatttgtcctctccaaatctcattttgaaatttgatccccagtgttggagatggggtctagtgggaggtgtttgggtcttaggggcggatccctcatgaatggcttggtgccattcgtatgggattgagttcttgctcttagttttggggagatctggttgtcaaaaagagtctggcatcctattcagtgcctcccttctcccctgcctatttctctctctttctcactctttctctctctctatctctcacttcctgccatgtgatctttacataccagctccccttcccccttctgccatgactggaagcttcctgaagtccctgctagaagcagaatagagtgctatacttcttgtacagcctgcagaactatgttccaaataaacctctttttgttataaattacccagcctcaggtattcctttatagcaatgcaaatggactaagacactgggtttggggttagttttggggatgtacctagaactcttcagttaatgtagtctactcttatttcttagttatcagtacatgaggggaccagactaaataacctcagagctcattcctataattgttttcatactccatattataactctcctagaattatcttcccatcatgaataccattgttttgggtttctccactatcacatttctaagtcttacagatataaatattttatgtttgagatttgtcaaccaggattgtttgaataaatgtataattctctacaactgttaagtttactaatttatcaaaattgtttccatcactttttctggagaaaataatgaattctaaagtttagtttaaagttaaaataatgaattttaaagtttaatgaagtttaaggtttaaaaaatgatgtaatagtttactatgtaaatactatgtaaactattacatcattttttaaagcttgtcattttccaaataaacttcttatacattattgaagtcttcatagtgaactacatcttgcatgtgatgggtgctcagaatatcttaatgagtgaatcaatggatggatggataaatgaatgactatctttcatttgataaatatccgcaagctattttggtttttgacaaattagatgaaacaggtattatgaaaagacttgggaaaattgaggacaaattagttaactagatactatgaaaagacttgggaaattcatatttttaaaattattgaaatgtattaattaatatgcattttaagacattgtttaggcattcagaagcaaaaactgtttatccttccttggcaacaaacagaactctaattgtgttcagttatctactctccatgtgctctggggagttccagggagtggataaggattagtttaagccagaatggtagtcctaaccttctcatcagtgattggtttaggcatggacacatgataaaattctgaccaatagcctgacgggtctctgataaagtttctttttgctcttttttttattttgagacagtctcactctgttgcccaggctggagtgcagtggtgccatcttggctaactgcaacctcactgcaacctccagcttcctgggttcaagcaattcttgtgcctcagtctcctgagtagctgggactacaggcatgtaccaccatgcctggctaatttttgtatttttagtagagacaggatttcaccatgttcgccaggctggtcccgaactcctgacctcaagtgatctacttgcctcggcctccaaagtgctgggattacaggtgtgagccaccgtgctcagcctctccttgctctttaaaaagagatgtttggaaacaaagtttcctttctgctatagaatgttatgtctgcaagcagcatctgatatagcctctttgcgaccaggggaggaattggcctgagaacatgctaaggcaggaagagcagaaagaggggaggaacctggatcttggtgacattattgagctgcagattgagccgacttgaattctccttgcttccttccttccttccttccttccttccttcctcccttccttccttccagttcttgtcatgtgagacagtaaataactttattgtttaagcccttttgggttagattttctattacatgaagtttaaagcattctgataacttcatgtttattgatgtgtataaatactaatatattctattatttgggggatacaaagaatttgactcaatagtatcttgttctattgacatgttcaattattaatcactgataaccctgaataactaaatgttattaccacatttaggacaatatccacgtccactgacatatgaaatttgggcaatttgcttctttgggaagcattataaatcacagaacagcagaggatacaaagacccccacaagagatcatcaagattttcttcttcccttctttttgtcatacacattgctgagaaggagcacctccaggaaggaaccaaattatttgtatttttctgttatttttagttttgagacccggtctcactctgtcacccaggccagagtgcagtggtacagtggctcactgcaacctctgcctcccaggttcaagcaattctcctgcatcagcctcccaagtagctgggattacaggtgcccaccagcacgcccagctaatttttgtatgttttcagtagagatggggtttcatcatgtggccgggctggtctcgaactcctgacctcaagtgatctgcccgcctcagccttccaaagtgctgagtttacaggcatgagccaccaagtccagccagtatttgtattttgaattaaagtatgtatgtgaaaaatgagaacactggctcacttcctggtaatataaaatacaacatatcagtaaaatcttccatgattctcctagttcagtgatctctttctacccctgtgttacctaatgctggcctaaactccagcggcctgtagaggagattggtttttgtagttgtaaaataatattttaggctgggtgtggtgcctcatgcctgtaatcccagtactttgggaggctgaggcgggcagatcacgaggtcaggagatggaggccaacatggtgaaaccctgtctctactaaaaatacaaaaattagctgggcgtgatggtgcgtgcctgtaatcccagctacttgggaggctgaggcaggagaatcgcttgaacctgggaggcggaggttgcagtgagccgagatggcgccactgcactccagcctgggcaacagagcgagactctgtctcaaaaaaaaaaaagtcacgt

SEQ ID NO: 1509 - DNA, 3804 bp, Homo sapiens
taaagtcatcaaaacaacgttatatcctgtgtgaaatgctgcagtcaggatgccttgtggtttgagtgccttgatcatgtgccctaaggggatggtggcggtggtggtggccgtggatgacggagactctcaggccttggcaggtgcgtctttcagttcccctcacacttcgggttcctcggggaggaggggctggaaccctagcccatcgtcaggacaaagatgctcaggctgctcttggctctcaacttattcccttcaattcaagtaacaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctgacacggacgcctatccagaagccagccggctggcagcccccatctgctcaatatcactgctctggataggaaatgaccgccatctccagccggccacctcaggcccctgttgggccaccaatgccaatttttctcgagtgactagaccaaatatcaagatcattttgagactctgaaatgaagtaaaagagatttcctgtgacaggccaagtcttacagtgccatggcccacattccaacttaccatgtacttagtgacttgactgagaagttagggtagaaaacaaaaagggagtggattctgggagcctcttccctttctcactcacctgcacatctcagtcaagcaaagtgtggtatccacagacattttagttgcagaagaaaggctaggaaatcattccttttggttaaatgggtgtttaatcttttggttagtgggttaaacggggtaagttagagtagggggagggataggaagacatatttaaaaaccattaaaacactgtctcccactcatgaaatgagccacgtagttcctatttaatgctgttttcctttagtttagaaatacatagacattgtcttttatgaattctgatcatatttagtcattttgaccaaatgagggatttggtcaaatgagggattccctcaaagcaatatcaggtaaaccaagttgctttcctcactccctgtcatgagacttcagtgttaatgttcacaatatactttcgaaagaataaaatagttctcctacatgaagaaagaatatgtcaggaaataaggtcactttatgtcaaaattatttgagtactatgggacctggcgcagtggctcatgcttgtaatcccagcactttgggaggccgaggtgggcagatcacttgagatcaggaccagcctggtcaagatggtgaaactccgtctgtactaaaaatacaaaatttagcttggcctggtggcaggcacctgtaatcccagctgcccaggaggctgaggcatgagaatcgcttgaacctggcaggcggaggttgcagtgagccgagatagtgccacagctctccagcctgggcgacagagtgagactccatctcaaacaacaacaacaacaacaacaacaacaacaaaccacaaaattatttgagtactgtgaaggattatttgtctaacagttcattccaatcagaccaggtaggagctttcctgtttcatatgtttcagggttgcacagttggtctctttaatgtcggtgtggagatccaaagtgggttgtggaaagagcgtccataggagaagtgagaatactgtgaaaagggatgttagcattcattagagtatgaggatgagtcccaagaaggttctttggaaggaggacgaatagaatggagtaatgaaattcttgccatgtgctgaggagatagccagcattaggtgacaatcttccagaagtggtcaggcagaaggtgccctggtgagagctcctttacagggactttatgtggtttagggctcagagctccaaaactctgggctcagctgctcctgtaccttggaggtccattcacatgggaaagtattttggaatgtgtcttttgaagagagcatcagagttcttaagggactgggtaaggcctgaccctgaaatgaccatggatatttttctacctacagtttgagtcaactagaatatgcctggggaccttgaagaatgcccttcagtggccctcaccatttgttcatgcttcagttaattcaggtgttgaaggagcttaggttttagaggcacgtagacttggttcaagtctcgttagtagttgaatagcctcaggcaagtcactgcccacctaagatgatggttcttcaactataaatggagataatggttacaaatgtctcttcctatagtataatctccataagggcatggcccaagtctgtctttgactctgcctatccctgacgtttagtagcatgcccgacatacaatgttagctattggtattattgccatatagataaattatgtataaaaattaaactgggcaatagcctaagaaggggggaatattgtaacacaaatttaaacccactacgcagggatgaggtgctataatatgaggaccttttaacttccatcattttcctgtttcttgaaatagtttatcttgtaatgaaatataaggcacctcccacttttatgtatagaaagaggtcttttaatttttttttaatgtgagaaggaagggaggagtaggaatcttgagattccatatcgaaaatactgtactttggttgatttttaagtgggcttccattccatggatttaatcagtcccaagaagatcaaactcagcagtacttgggtgctgaagaactgttggatttaccctggcacgtgtgccacttgcccagcttcttgggcacacagagttcttcaatccaagttatcagattgtatttgaaaatgacagagctggagagttttttgaaatggcagtggcaaataaataaatacttttttttaaatggaaagacttgatctatggtaataaatgattttgttttctgactggaaaaataggcctactaaagatgaatcacacttgagatgtttcttactcactctgcacagaaacaaagaagaaatgttatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctacatattcagtgataaaattactaaactact

SEQ ID NO: 1510 - DNA, 663 bp, Homo sapiens
atgctcaggctgctcttggctctcaacttattcccttcaattcaagtaacaggaaacaagattttggtgaagcagtcgcccatgcttgtagcgtacgacaatgcggtcaaccttagctgcaagtattcctacaatctcttctcaagggagttccgggcatcccttcacaaaggactggatagtgctgtggaagtctgtgttgtatatgggaattactcccagcagcttcaggtttactcaaaaacggggttcaactgtgatgggaaattgggcaatgaatcagtgacattctacctccagaatttgtatgttaaccaaacagatatttacttctgcaaaattgaagttatgtatcctcctccttacctagacaatgagaagagcaatggaaccattatccatgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcctga

SEQ ID NO: 1511 - DNA, 50295 bp, Mus musculus
  misc_feature (15336)..(15740): "n" at positions 15336 thru 15740  can be any base
  misc_feature (47723)..(47935): "n" at positions 47723 thru 47935  can be any base
gctacttaagagggccctgcttaggtgtctttccgagagccatgtgtctggtttttctgaggaagacaagtctactgagaactgaagtcgggtcctactgtggtttcacagggttagagctgataaaacaaaaccctgggttacagcccagtaactcagtactacccggtactcagtactacccggtactcagtactacccggtactcaggggttaagatcgtttttattgaaagtgaagttcatagtcttgtttgtgagattcccagaaatgtggggttcacttctgggaacagagtctagccatactcaaagggtgtacacgctcaggcccgaagctcggctcattgctaattctgcattcttattcaaaaatatctctctataaaaggaatgtggtttccttgttaaaaccgtcaatgcaatggtgttaatttcccagaaattttggaccggagacttcagactccagagggagggctccctctccttccaatgtctcttcaaccgtgtggctttttatactgcctgtcctatcccaggacctcctggctggggagcccacagcatctgctcactgtatggagagcagggctgtaactgcccaccagtagggtgctcaggtgttcatgggatacgccctgcatacatatgggtgccttaccaggtgtccaagagagatggtgaggtttgagagccactctgagacaaaggacagatagagatggtcacagatctggactggctccagatgccatgcacaccccccacgaggcagcatgagggtgtgagacaccacacctcatcttagagatcacagggattggagcccaggcaggcaaactcaggtctgtggtccaaccctgacatatcttttggaatcagagtcacccatggccttgctccagagtctggggagtgagactaaaccgtactactccaggggggatgctgttgtgtagaaggcagccctaagaagaggaccctgggagatccatcccccccggcccaatgctactcgagggtccttcacaatggggctggagaggtgtcccagctttgcagtgtgagaaaggccaggccaaaggaaaaggaaggaccaagaatcaggaaggacaggtagaaagtgctagaaaacagattcaacccagaacctgcagttaggaacctgtggacaccctgacctagttcagcttctgacctctggctcagagagatgacaagctggtgtccgtccattagtcaccaaacacacagccaggaaggtgaccggattctggaaagcctggaggaattctctggtgtgactgcagctctggaactttctagatgcttctagattactaccagctcaggctggaagacagtttcccttcccacctctggtgggaaagaaactgggaacaaaacttctagttccccttttcacaggtggagaggcccacctgtttccattcttgacttgggtgttcttctcaggcttgcagttatacagatagggtcatgaaaaggtcacaggcccgagttctcactccttatctgaaatgctcttctccctggcagcaaaaagccctcaggatgtcagtcagtgtggacagacccgagacccgcttgctgcgtgtcattgtccacaccccccatcctcactccacccgacccccagtctccctctctgagccccacctgtggaattctgctggctcctgtggctgaagatgctgggcctgtgacaggaggtgcccgtggtccattcctcccttctcggagagctcgctcttgcaaagctgggacaccagtggccgtgagatcgcgtctctctgagttgagcggggagtggatggaccagctccatgcagcccagccactgtgatcatcttgtcctggactggacatgccaaggggcactctgacacttgccaccgccatgtctctagcccttcctcctccctgataccctggagggacttccccgggacttgcaaagcctttgccccttcaagtcccttgcttatgaggtctagatttgaaaactcttgttgcctcaagtcaccatcttgtgccatcttgactctatcagctgtacatggtacaagtgtgtatgtgccagcgcacttgagtggaagccagagagaggggggtgctctgtcactctacccttgaggcagggtccctcactgggcctggagcaaggctggcagccagggagccccacgatctccccatctctgcttcccacagcactggggttctaggtgcccgtgtgacttttatgctggttctgggagtcaaactcaggtcctcttgtttctgtaacaagtgttctcacctgccgaaccatcttcccagcctgtcgtcttgacttctgtgttagggcttgcgtctgtgaggcacccaggtctccagcctttgtacacagggttgaaattctcagtggggacaatgttaatgcttttgcacgtgacatcaccatttcaagcccagacacacatagctggcaggcagaagtttctacttactcctgtcttgtaacagggaacattggtctgtgcaggctcactgccacacccttcttcctagctgcctatgaccacgccctccaccctccaccctcctccccatcccaggaggcggctgttcatggatcctccactaagccagtctgcccatggcatcttgccattctcccctaatgtccgccttcctccctagcagatgagaaaccccctcttagagagtttcgcgctcgcccagttgggactctcacactcctctgtaactcataaacagggttggtagccccgggccaggcacattttccacagaggatacagaggttacccaagggggaggtggcgagtgtcccagctctgaatgataccctcctagggtctcattgctctcagccgagcgtagcgcagccctgagaagagagagagtgtgtgtgtgtgtgtgtgtgtgtgtgtgtgtgtgtgtatccacatttggtcctaagccagcagttctcagtcccagccacacatccaggaagtctcctggatgacaggggtcctgccctctgttgatggggggtcccatcccctgtaggtattacatgggcagtgctgtgtggtttagagtgagactttactgagtccatttttagagcccaaagggacagctctcccttcctgctccccactctcatcacccaggcctggggtgcctttgaacacactgaaacaggtagtttgccttaaaaaccagcacctggccgggcggtggtggcgcaagcctttaatcccagcacttgggaggcagaggcaggcggatttctgagttcaaggccagcctggtctacaaagtgagttccaggacagccagggctacacagagaaaccctgtctcgaaaaaaacaaaccaaaccaaaccaaaacaaaacaaaaaaacaaacccagcacctgagcacctcaggtatgtagattctgtcctggctgcagggtgggaaggcgaggccctgtcctgcctggtgtccccaatctgccacccttctctctacaccgaggagcccacagggctagacacctggatgcttttagcctcgtctgagcagtggaaatttgtgggcctggtgggggtttggctgcatttggtcggggtgaggtgaagggcctgaaggatggggtggcagcgtgctagagttgatctacaaggtagggtggcaatcacactgaggtaagacagttggctgcagactccagggtcacacctcaagttaagatagcatacagtgtcacagaagacacgaggcttacgaaggctgacacgggttttgtgagtttgagacaaggtcttgctgtgtagctcaggctagtttcagaactcaatcctcctgcctcagctggaatcacagatgtgcaacaccatgccctgcttaatgttagcttttcgagaaggaaaaaggcccgcagttgggtgctgctctctgactggggtaggggtggggcttctcagaaagaaggaaatgggcccatgctgcctagggccacagacttgctctgaactcagttacctaggaaaccaagagggggcagggcttgctgagttagcggccaggcctccaggcctcggagagacccaggctgggggtggaggagtttcacctgtggtagtgaatgaacggggagagtgctccctggaggtggcgatgtctgggagaccatggaggccaactgaggaatagggttcttaggaaacagtgctggctgaggttggatgtgccagggtgcaggggtactcagacccaaggaggagatctactgtagtactggaagttgttgggggggggggggaaggagggagacaggaagtagacaccaccgaggaatcgaggaatggttggttatagggccaccagctgcatggggcgtggcaggaaggggctgctgtaaaattgcaaaagctaagcattagggctggggggacagggccctggaatctgaagaggaaggtcccaggactgaggggtgcaggcagggcctgagcagtaggacctagtatctcaggcatgtgggttctccaggaagaacatggcctgtagagggaggaggggtgtggcctcagagaacccactggagagatggatcaaagctgggcaggggttggaaccagaaacacggaagaggcagaagggaggggagatcacgcccggaagccaaaatgagatgtgaaagggaaagagatcccaggatggtcccgcaagggctgcctcaggctgggtgtgactggagatgagccagtggggaacctcccagagtgagtcctggtgatacatggtgggcagaagccagatggccagccaagaagtgagtgggtgctggaaagaggggaacatgagtgggccaaggggctgggctattgagagtggacagttgggggaggcagggggtcagagagcctgcaactctgctctggagattgggctggcatcagttcacctgggcccagacaggacctgaacacccagaatccattgcaagccactgttttcagtggtaagatgctctctaggggcctctcccccctccctccctccctccctccttaatcctgcttctggccttccctcaaggccatttggcagtgtctccccacctcggggacgtgtagccttgaaggtacatgtataggaccccaggacacccatacttgccacacagcaacacttgcaagtaccagccctgcctcttctccagcgctagaccctcagaggggtggacggggggaggggtggtgttgttcttggcattcagttggaagcatctgctgtactcctgagctgttgcctgggtggctggaagaccgtgggcaggaaggtgagcattgtgcctaaccagaagagaacaggatgcacactcgtgcgtgcgtgcgtgtgtgtgtgtgtgtgtgtgtgtgtgtgtgtgtgtgtgtatgtatacacgtggaccacgaccacacgttcatttgtctccttttcctgctggcttggcactgcatgtagagttgagcgtgggtgtcctgtgcttcctggcaggtgtcaccctctgaaataagtctgtacgaggctcaccattgctttcaggggaggtggagacacctctggtatcatcgagaaggaccttgtgtgctgtccccagagcctgggagcccttgcacggactcagcggggggtgcagtggggagtgggctttttagctgccacaccttggccaggtgcctggaaagagggaggggcttcatcagttttgggataaggcttggtagatgtgagcccggcttggaagtaagatcccaggagccctctgaggatccagagggatggcttgagagtgaacctgccctgctgcctaacctttaagttcctgtgggccacatgaacttcctatggctgtgaaagtgggtttgtgcaaaccgtgtagcttgtacccacagacatttattgtgttagggttatgaaggtctgaaatctaagccagattgaagccagagtgtggaaaggtgggttcctgtagggcctccagagatctgtccctggcctcttcttgctctggtggttcctggcacctctggcttgctctgatgatctctgcctctgtcgcattgtggtcacctcatatgctaatcaggcctcctctgcctctctgtggtccgggacacctgtgattgtggctggctcatctgggtcacactctatgtcactctgtattcagacccaaaagttgccttgatgagtaaagtcatggcactttcgggctgaggacaggtcattggtcagcctggtgtgtcttaagacgtgatacttctaaggcataaaaatgctaaaataaattgggtcaaggaaactaaaaatgcatctacttctttaaaaaattgcttttaaagatatggtttcctgtattgcccaggctttgttccaaggctggccttgaactctgatcttcctgcttctacctccagaacattgagattatagggatttgccaccacaggtgggttgtgtggtgctgggaggattgaacctagggcttctcgcgtgctagcagggtgtcctaccaactcagctgtgtccttagcccaacttccaattctttttttctttaagcacatgtttttccagctgggagtggtatatacctgtcatcatggcatcggggaaactgaggttggaggacccagagtctgggctatcctgggcttccaatactcgtgcaatgtaaagcagtccccccacccctggtcgtaatataaatggtcttggttctgaactgcctgcggggtcttttcatctcatagagtgggaaccccacatcctaaggagccagcacccttggtagccagtaatctgctcgctctcgctctctgaatcattttttaaagatttattttatttattatatgtaagtacactgtagctgtcttcacacaccagaggagggaatcaggtcttgtcacagatggttgtgagccaccatgtggttgctgggatttgaactcaggacctctggaagagcagtcagtgctctttaccactgggccatgtctccagccctctgaattatttttaaagtgtactcctatgtgactttagaataaataaacacagcttggcgcgttagctgttggaaggctatacatggagcggaagccaaagtgtggatggagacccaggcaccggaagggcaggagttgaagtagcctgggtgtctgtcacctcctcctctcttgctcttttctgcttcggtacccccctccttctgaatccagctgatgggaccctggtttgcttccttcccaagtcttcctcacgcccaagcttcaggggcctctacgcagaaatggctctgagctcctcagccctgggtgtctggcaatgcacagtgagccaggccagcagctggctccccctgggttgggctccttctcccatgccccttcaagccagtgtgaatgagaagggacatccaggagcgagctgatggtgtctttggcacagtctacatggtgtggggccaggtattcattgagttgattccttacgacaaactcccctctccctgacagtgaacctggggacacggctctgcatctctgtgatttttattttacttttttgaagcctattgttccacatagcccagactggcctccaactcaccatgtagccgaggataaccctgaactcctcctccacatgctgtgttgggattacaggaatgtgccaccatgtcctgaatatgaagtgttcaaaccaaggcttcatgaatgtcatgtaagcgctttactaactagctacttccaccttctgaggggggggaggaagggagggagggggagggagagagatcaggtctcaagctggagagatggctcagcagttaagggcatttaccgttgttccaaaggactgaggttaccccagcatcacagggccgctcacagccatctgtaactccagttccagggggatccaaccccctcttctggcctcctaaggcactgcacactcgtagtgcacagacatacaggaagttaaaatacccaaatacataaaataaaaataaataaatattttaaaaaggacaaggtcagccaggcggtggtggtgcacacttttaatcccagcactggggaggcagaggcaggcggatctctgtgagttcaaggccagcctggtctacaacgtgagttccaggacagccagggctgttctacagagaggtcttctgtagctcaggttggcctctcatgaacctgaggctggccctgaactcctgcacctcctaccctctactatacgtggctcctcaatacccttttaaaacctttgattggttgaccgactttttttttttttaaaagtatttgcgtgtgcataggtcccttcacaggagtacacatggccccttggagcttgcgtcccaggcacttgtgagctgtctgacatgggtgctggagaccaaactcccagccctcctctggagcaactgaatgtgcccttaaccacagcccctccagtccctcaacaggaagcatggctttcatgagctgggttctctccacccctaaatgtggcttgtagatctggtactacaagtggccaggctctccaagaagacttctgagtcagtggctctgaactgagagcagtaatggggtacagggtagagcacccctctagccagctcatgggactgtaatgccccagtctagggccggtctgggcaatgtggtgccagagaaatcagaggctctctggattccagtgtcttagcacggaaaggaagaagtatgtgaaatatctctgccattttcacgttggtgacatcttgaactgataatattttggctctgtgagatcaattaaatcgggccacgtggtccctcctgtcgtcctccccccacccccagtggtagcagaagtttaaggttccatctgtaacttgcatcttgggctttgtgccagcgggtctgatggcacttgagtggctatcaggctgcttccttggggatggatgggatggcctgcttgggaaagaagcctcagaaagccccaccctgcccccttcatgctctggaggacgcctctcccccatttggtgctactgaatgagactctgagctgcacaaagtcaccatgtacggagtgccatgtgctacgcccaggctggcaatctggaaagctcactggagctgagcacaggggctcccagagagctggaggattagtgtgtccaaggtaaaggttcagaagagacgaggccctgtgtccctagaaaggagaggcagtagggcagttgacggtccgttggtcagctttgacatgggttgataggagtccctctactgaactgctggggccgggctgggtgataagggaggggtggagggggagcgcttcctggtttgaatggacctgctgatcaactgtgactggagttggtgtatcaactccagactaggaaggcagattcctaagatgcggcgacctggggaggcctggggctcctatgttctgctggtaggtagggcagagtcacgctgaggatggaataggagagtgtgcacacacgaggctctggggcattcgttcctgcagactgggggatggaggtcacatgggagaaatctgtcactggccctaggcccctccagagttactaaaggctcctctccccttgaactaattgcttctgctcaaatcttacccccagcactcccagtgtgggagctggcctggggccaccgtggccatgcctgagcctgggagtgactcattccaggtcagaggttatagggtctggcagatcccagcatcccagcatccaggcccagccccagccccagaagtatccgctcctattctttggaccccctggctcatcactctcagggtcccagaacatcatagggcctgcaaggagttgggggaggagactactgactcattgcccagcccccacggaggctcaggaacagtgggaagaagcaggcgccagaacacaaccggagtccctgaggctccagaacagagtcagggtgagccagccccagcccagccccaggttctggcttcctctcttgcttctccctcctttggttgcagccagcagagcccacttaagtaagttggtcgagctgtctcagctgcccagaagcctatgggggggtgaggggattgggagagggcggggcctaccaaaacactgaaggctgacagaagaccaagatgcatgcctgttgtctgacgggttggggtagtgccaggccagggtaccatgtgcaggttcaatgtaccatgtgcagggtcaatggaagacccttctggctgggaagagggtgccgtgattctggattggcacagacttgggcaaacatcggttaaaggctagggctgcatggctccaaggaccatactgtaactctctacgtaacagcgcctccgcggataccctgtcattttcctcttatccgcagacttgccctgctgctgtcgcctgcagccggtgcacctctccccgcctcctcgtcccctcgccctgcccctcgtagcaattccccagcaagcctccctccgcaggccgtcctgagccctcctacctctctgccccacactctgggaggctccttgttccgaggccacaaagcccctttgatcctctgctcggctccgagccatgtgacccggtgggcgggccgcagctctccagcgtccaggcagcccgactttcagctgctggggtgagtcctcgctctttgttcttccagcccctcacagtttgctccgggggcctccaggtggtggggcccgcctggccgccccgatgggtgcattgggactgggatccgggtagccccggggcctggaactctggttggcagaccggccctgggttcctgggagaataggcggcgggatgccgggtctccacgcgggaaccagattttcgatcgcagaatagaagaaaaaggggctttgtgtgaccacagctatctctttgtgaatgtttggccaactccaccgagtggtgaagagtgtcttggagcacgttgcccccgcaaggggctctctgacttctagccggggcaagagcagaggtgtattgaaggcttcttgcaaaaatctctccacacagagttatcagcttctaatagtgggcggtttccaacgctggctggaaattagttcctgcgggctgttacaaaggtggcatattagagaccacaggggtgcactgtggtgggataccaccatcggacccttgtattctctggcttttggtgatgtgctgagcccaggagggtgttgctgggtggggtgggggtttggtatgcatttgttttgctagagaatgtgcaatgggggtgtctgccttctggagccttgtgttggaacctgtgctctgtgtaagagccaggggcaagcagtgtcctacagcaggctctgcagccaggcggagacgagaacctgggccagcacagaatggtcacttgcatccaagcacagagggaaagagggaaatgccttcccctcctggagaccgcctgagtttccgacctactgtgcgcacccccacccccaccccactctaaggaaaagctgccggctcttggtcagaagtctgtagagaagatctgctccccaagagaagtgtgagattccttttcttagagaaaaaatgtatcacccggaagcagcccagtagtgggttctggccgctctgtgctgggcagagttggaatttggttcagatctcacgtggaaagcccagaggacagtgaagacgggatctcctgcaatgacgtaggccccccctcattcactctctgtttctagcatcatggggcccttgggtcgctcactttaccttagtttcgcttggcagccaggcagctcctttttagcaaataggaaaactgtgcttattaagccctctggatgggcagccagcctccaccccaggcctgctggggaggcggttcacccttctcttcttgggcctctttcagggtacgaggtagaggtaggaggcagctttgaacttatggctgccccactgtctcagcctcctggatgcagggattctaggtgtgtacctttaaaactttggcctctgggaaggaacctgagttgtagctgacctggctgactctttcggtttctgggcattctttattggtttaccccaggttctgttacatctactggagcctgttcatatgtctaccgggtgggccctgtggtcatcatggtgacagctcagccggtatgcacaagaacctactgttcgtggggtgaggtggtagccacctcggtggaagccagctccagaaaggaggccaggttcccagtgtggattgtcacaagaatgagataagtctccatgccaggtctaagtgggaccatcttgggcctgtggcgtcctctgactaccagatccactgccctccagctctgggacatgggtcaggagtcccctacccattgggcaaccacagtgctcttgcctgtcatccccgccccctcccttccctgccacaatatcctccccagcttcctgttgtgtcattgctcctgtcagatagggtggctctgccggggctgaggcccctttttacagagagggccccacagcctggggcaggcagcacagattccctgcctgtgtcaaaggtctctaggaagccagcattgaagctccatttccggtcttccattcctccacacagtaccgtctccactggctttcccacaccaccccggaagtttctaggcttcctctctcacttgctggccctgtgtgtgggaagaacagctttattttaatgcatgtaggcaaaaccccagtggccactggcagaggctaggtgggcctccttgtccttaccatcccccttcctccatagactaagccgatgttgccagttgagctttaggaaatggtctgggagtggtgtcccacccagagggtcccacttcctacagtttggtcttttgaaaagtttccagccaactctacccttcgctctctgggtaggctctgaataagctctgagggctctcccagactctctgccttccagcactaagctttgatttgtttattgagcaccggctccgttccttgggcaggtagggacctgccctccaggagcggcagagccttggactccttcccaaggaagacttctcagggtggctgctgtgcagcgtagcgtcctgtgtgttctgtgagtggggtggggctgggggctcctacctgcatctggggaggtgggcatttctgtactccacacctgagacctccacctgccaggtctctgcagccacagctgcagagtctccacccagcccgcttggctgcatgctgagcccaccttggtgcctgagggttgggtgggcctacctggctcttcctttccattctctgtcacgcatcctgaggagcacaccatccaggctgtgagcctaggaaagagagatttgcactaaggactgtggagcctgatcttgtcttcctgcagccctggagctgcttaatctggttctaccacccccacccctctgcagcagagctcaccaccactgtccccaagtcactggcaccggggttggggtgtggggcctgggcatcctttaaggcaggatgcagctcagtgcagaagcccttgaaagacacagaggcttagagtttgtgagaaggtcatcaggaaaagatgctgtcgtgactttattcccagcacttgggaggcagaagcaggcagctttctgtgagttcaaggccagcctggtctacagagtgagtctcgggacagccaagtctatacaaaaaaccctgtcttaaaaaaaaaaaaacaaaaaaacaaaaaaaaaaacaaccaaacaaaaatgcttgctatcagccttcacagggtgagttctatctactccatgtggtagccgtctcctacaggctgtcccgtaaactttacccatgtgccatgccatgacacatgtgcctgtacacagacacacagacacacacgttaaaattgtgttaaaagataagctattggctggctgtggagcaagggtggctggtttaagcactgtcctaatctgtgtacagtgcatggatcttgcccagggctccaacccctcctaattgcttagcatcttcctgaagccaagatttgggggggcatcattgagcacctcaggctgctggctggccacatgaggactgaagtcctcgcacccttgtctttactcttcctgcttctgacagttgtatgtcccccatctcaccatcttactttgagtttttgagagagggactttcccaaaactccctatatatccaaggatgacctatacttctgctctttccagggactgaactcaagacttcatccacgttaggagagccaactctacccactgagctataactccagtctcctttttggtcatgtgaggcgaagtctgattctgtaactcaggctgaccttgaacttaacatgcctcctgcttgagcctcccaggtggcaccgtgcagggtttctgccttgcttttgggtgctaggtgccaagcacaggctggtcaccagaggtcgtgggacagttgtccttccacagtggaatgtactcagagctcagtgctccaggatctcttatcttatctcccaggcctcactccaggtgcctgtcaccactggtggaggagataagacagcctggtccaactggggagtgaacccctttgctgtcctattgggggtctgggtatgcaggtctggccctgggcgtgctgaggctggccctcctgttcagtggtgattttagtgtcctctctgttctcagtggccactgagatttattgatcgctgtgaccccattctggatgacctgggtgcttgattggttaatgtttgaatgactagggaccagctttgtgtgacctcagattttttactttagtccaaatgttttctggtttcaccaaggccagctcaggggccttgcagggattccgttctccctgtctttctcccatgtgagaattttaaggaaagaggacagatagggtctctccctctccctctcctgaggaggcgctggggctggggagttggctcactgggccaaaggcttgctgcaccatcatgatgatagagttggatccttcagaatctacagcaaaggacaggtgtgtgacactagtaatcccagcctaatcccagcaccagggaggaggcaggtggagtctcgctcctggccagccagcctggttgaatgggtaagctctgggtatagcaatgagaccctatgtcaaaatacaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggacccccgtgggagctaaaggtttggggtacaggagcgggtcttctttgcagcactgagctggagaggtgcctcctactgcagcagcgggtaggatgtttgttgtgggttctgagacactgacgtctgtacagcggtccggtccgttgactgggagtgagccctgtttctggtggttggcggtggaggaatggcggagagggatgccggtagccactggggagcagaggactttgcatcctggcacagaggagctctgtgactagtttatacccaccggctctgaataagtatttgctcttccatcactgctgctgggttgagtggagccaccacaagctgacctggtaaccggtgactgtaaacttggtagttgatggctgaggtctctgtaggggtgcctgagccttttctggtgtgtgtgtgtgtgtgtgtgtgtgtgtgtgtgtgtgtgtgtgtgtgtgcatatttgaggggatatgcacagatgtatatggagtccagaggtcaaccttggggctacctctttgtattttgacatagggtctcattgctatacccagagcttacccattcaaccaggctggctggccaggagcgagactccacctgcctcctccctggtgctgggattaggctgggattactagtgtcacacacctgtcctttgctgtagattctgaaggatccaactctatcatcatgatggtgcagcaagcctttggcccagtgagccaactccccagccccagcgcctcctccttctgagaggagaagtccagcttaatgtacacacttgcttagaggatagctgcagatgagatccccgcagtgagccaccctgggcggagccaaagccctctgcaaccagagggactgattgcgagtctccacctccatgtgggaaggttggccaggctccctggggcccagtgaacctccgtggcatgtatttaggagggtgttacttcctcctcttggtgacttctggagcctggccaatgcaggagggtagaggctgatctctgggagttggaccgttggctgtcagttcagctgcttgtgtaccaagtcccctcagacaatggaagaatcgtgacgttctccactgtgtagtcttcatccagctttaatgggtgccccttgactcttataccttagcaccctaaggatgctgaggactcctgagggcaggcaatagggtggctcagctcccagagagtggagcatcctgtgtaaagcctggaacctttgtagaagtagggttagcttaagatggaaggcttaagttaagaaagggtgcctgctttggctgtgactaaggcctgtttagaagatgaggtggaacatcgaggaaagagcagacggttaaacatactgcagggcggttgggagacccactgtgctcattcatgatgggagacctattatgggtcaggttgggagacctactgtgctcatgatgagagacccaatgtgggtcaggatgggagacctactgtgctcaggatgggagacctactgtgctcaggatgggaggcccactgtgggtcaggagaccaaggtcaaagttctggtctgcctttgctattggacatgcagctggcatattgtgagcttctggcatcttgctggctttgagactaactcactgcaagcttttaacactgaagcacttcatgcctgtaaccctaatacttgtgaggtagaggcaggaaagacatgagtttgaggctggcccgggctacatagtaagatctagtcccaatgtgctcccccaaggatatatgtgatgtcaggacacagacatttagggaagtggacctccaggttctaccttgggctatagctctgtggggttttcctggggcgagatgaagatggtcccacccatctgcacaggatttggagagtagaggtctgagtgtcctgggctgcggctgctgtcgagagccaagcattgaagataggtcttccagaagtttctgaatcttgggtaatatgtcccagagcttaaagtagaggcaatgcctggggccctaagatttcaacagtacttgagccaaggtagctctggtttgaggcaggagggagggaccgctcaggatttggcagtgtggacgtgttcaggggacaggggagaacttgggaagtgtgggtccctggatcatggagatgttacaagtaaggaagggtcaggggtgtcccccacacccatgtgccgccctcacactacccaccctcagacattgcctgcttcctgctcgcctggcaacagtcaggctgttcccaggccgacgcttagctgttcctttccaggtgttgtggccaccttcccaggcccctccatggttagctgtggacactcacacacacacacaccgccgtgtgcatctcctgtccagtcctgaggctgccctgggggccacagcgacatcctccttccactgacccacagatgcacttcacagtacccttgaagcatctgtccacacataggatgtgccatcgtgattgtgacccagccttggtctgggagaactgtgcagcccccagccaggcccacccactgcctttttttttttcaaaaggaggggcatagatgacctcactgtgggcttcagcatctccatctgtctaagtcagcagagatctctctcgtcctagttcacaggagctgcccctgagaggcttggaggtttgggagtggatagtgcaggaagttgcaggtgcccccagtgtgtcagcccctttgtccatccagaggtcttcctccctttggggctgtgtggccctaacaggtgggctttaccccagtcctgtgtgaaggaggttgtgacttcctgggaacgttcagcacccaggtttgagggcccagcagcccctgcatttggcttgctcagatctcgatacaggtggccgcaggactgagaatagagcaaagaggactctacacgtgaggggcacgggaggaaaacagcaggcacaggatctgcacccaggtcctggcctctggcttcgggattcccttgccagtccaggcccgggaaggcaccagaaagcagaagcaggaagctgcatgctcttgtcttccttgccggtaattggtgggcctgagggactatgaattggattcctgatacacaaacggtcaggagagtagccacaggctcacaatgaggctagccccttccggtctcttcctcacactggaggcacttcttgcctcttaattctttaacggacaactaacctgatcaagatgcctaaatggggtgcggtgaggtggggatagacaccgtcccctgcaaccgccaatcctacaggcctaagcccggagagacaagcttccgaagggacgtggaatgtatgcaggcgagcatggtgcccccggggccacagtttatggagaacatttctggactgttctgttaccccaccaccaccacacaaattaaaccaaaaattaaatgttagccaccaatgctttaagcaactgcaggaaatgtggagtcttcttccctgcactgcccccatccctctgtgactgtatcctagcactgtgtctactctttagggacagccggccagccaacttggaagccctattgggcacagcttccagaagtttgccagcccccccccccctttgtccccttgtccttgggagaaattaccatatgaatgtcgttccttcccagcgcctgggttggagaggccctgggagaagactggctcccaggctgccgttccggtgttggctgaggaccatccacggcatgccagttttcctggacatcggttgtctacatcccataatagatctagctcagtcctgggtttgagaagaggtggaagaagaggctgcaggtgtagggatctcagctgggaggaggctgtgggacccccagccacttgggaccccgcccttgtacctcctcattaacctgtcctgagaaacgtgttattctgggccttcttgcgatgttgctaattactggaggaatccagcgggcgcgagggtatggggcagtgcagttactgtgaatgaatggcttgtggactgtagagagtttggcctgtcgatgttctagcagctctgatggtctggcttgagtcaggcctcactcaggtcgggagtttccattgagttcctggttgcatctcagacactaggttcactttgcaacctgtgtgagtcacgctggtgtttgggccaccaaaacatgctgtcttgtatccccccacccacccactctggctacaaaatattgaaagtatctcaggagatgccacctggcagtggagtttcttctagacagcatttagagatggtagcaagacccagtccttgacatgggccgtaataagcggtctgaatggaacagaagtgacatcgccagtggaggcccaggtgagggccctgtcctccgtatctatatctgcccctcgctctgctctgtttgctcagtctgagcctggcattaggacaagatggaaaaaagataggactgaagcccaggcaaggccagcctggcccctagttgcatttgacgcctgacctcagtggaccctgatctgagtatcctgggaaagtccttccttctgtccccttcctcagctctacatggcttctataggtgacaatatccagaaattgttaaagtcacatttgggtgccgggacagagattcatcatgcacacacacacacacaccccgtaccgaagaaagggaatcggggagtacctccaggcccccattgagttatccagccaggttcacagtgacctcagatgttagaggccctgctggcatgaagagtcacggggtgcacttactatagcctgtgcaacttgctaaaacagggaagcccaccagcatagattagctgtcctgggaagaccgaggagcagggcagagtacagcagcagggaaagaatgttctagacaggctgactcttttttttttttttttttttttttttttttttttttttttttttttagacagggtttctctgtgtagccctggctatcctggaactcactctgtagaccaggctggcctcgaactcagaaatccgcctgcctctgcctcccaagtgctgggattaaaggcttgtgccaccactgccgggctagacaggctgactcttaagagccttttctgaagagctgagaggagtttggaaggcgttcatatgtcggagagtgaaggggtggcatgtgcatttggctaacagcagctgcatgcaccatgttctgtgtctgtcaccctccaccttcacaatggtcttaggggacaaggattatctttgtgtgcacagtgtcgtacagctcagatatttgctcaatcccactgttccatggtacgtcagaggtgggagaaggtaaaggggcccaattccgtgtcaccctgggtgctggggacaccggccattgatttgaagcaaagacaaggtaggactaggatatgtgtcaaaactgtccttccagggctggggagatggctctgagtaaaacgcgacccaagtttggtttctggaacccaggtaaaatctgggtgcaggcatgtgggtacctgtggcattagtgtaccgccaatgggagatagagggataactaacagcatacacagccttgaataagacaccctaactggatttgtggtgataaaacagaggggggaccattgtggtatagctggagacagcattcccaatagtgggggcaggggcagggtacccagagttcatttacacttccagacagttcttgcatatatagacttggacaacagtagctatagataccaaacacttagtgcaggacctggtatatggagtcttgatacatgcctgttgaactgtgatgagcatttgtctatctgtcacctctccatccgttcatccatctacccacttgtctgtccatccattcacctgtctgaccatccatctacccacctgtccgtctgtctgtcccatccatccatctattcatccatctatccgtccatctacccgtgtctgtccatctacccattcgtccatccacccatccatccatccatccatccaaccacccatctgtctatccacctatccatccatccgttgtccatttgtcagtctgcctgcccacccatccttactctctgttcaggcagcattacatgacactgcttggtcattcatttcaacagtgcgtcataggctgccctgaggcatttgctctacttggttggttgcttctccttagagaactaggtcatggtgtgaggatctttcaacatacactggtgccgagggattcgtgttccctggtggatggctagaattcttgggtttcaggatctccccaggacagggatctgtagctgcaagagtgagtggctcatctcagttcttctgcctgtccttgttggactccataatacagtcacaggtttcttcttccttaaggtcctgtggtcacgccctcttgcaccagccaggaccagcttctctctacctggcccttaagaccctgccttcagtctcgtcctgtcccatgtcatgccctgacccccacccccaccacaacaaagtgaatggggcacccggaagcctttggcagtatcagctgacctaggcagaaaagatctgtatctctggggtcaggcctttgtccacgggatttctggcggcagggggtaggagggtagaggggtagggcggggtgtctactttttgttatttcaaatgatttcataagttgggggaacctttgaccatgtttcacccaccccaagctctggtgtatgtcagcagctgacagcagctgataggacaggggtcaagggattgggaagcagctctgtcgcctccccccccttaggggacatccctgataagaggaaattcttgtaataaatggccagtgtccacagtggggtgatggagtggcctctctcccacccccttctttctccatagacatttgtcaagagcaaagggaatctgtggcccagcagcctcgatggcccctgctgcagtaggacatgccagtggcgtcctgggtagggctggatcttcaggtgcagctgttgctgttggagattcctgggggtgggcagagtcagggctgccttccccgatgctgctatgtaatagatgaccccaaggatgggcccaagcagggtggtcagtggaccccggaaccggaaccgtatttaaatccctgacccagaactttggagggctctgcagaggccttagtgtgctgttggaaatctgctgtggcttttgaggaaatgaatgagaagggcttgcaggttgcagcctgccctgagcaaaggttgatgtctcaataggcccagcctagtgagaaactgctagctgtaaatgaagaacagaaggggtctcctcgaggggggtggggcgcccctggacttggtccaagtttgcctctgtggattggggccaattgaaaccacgttggcagaagtacagggctccttgagagtcctccctacaatagaggggaggttgggtgagggaagcttggcaaacagccaaagcagggaccctactcccttctttgggatgcctagggcccctgcctctgcacacctccccaccctgccctcatcgaaggaaaggaggagtggatgggatgaagtctcaaacttctctgtccgtcccaggcccttatcggacgcaaggtcacaagcatctcccagcagagagcagcttgcggaaaccacatcagggcagtgttaagtcccctcttggaacttggactggggaaggcactccagctgggagaggtgggaagcgctccctttgcaaatccctctctactgaggccaaagccaaggccaagcctttgtgttgggtttccaagtgggggtccgggggcggtgcaggaggagtctcagatttctggcatccatgcttttaaccagactccaaggagacacttcctgccccaaacaaagtgtgaagtgtaattcgatttgacttacttatcaaattagatgagccatgtgcacttttaaaaagttcggcttttgaaaccgggcacatgaatttgcaagatttgatcatttatatgcagtttccatctttggaacaggacagggagcctcttgtgacatttatggggagcgcagggtcctccggtgagtcagcaggggccagggcactgtgaaggcagggtgaagaagatgggggaagtcccagctccccagaaagcagccttccacatctctgcccacccatgtgctgacaacctgggtcgagccgcccagggagtcagctgctagagccttgacccctctaacgtgggctcctcagacttatgtcccatgctccttgactctgtatccctcctgcatttgtccatctctccagccacagaagctgctgatctagatcatctgtgtggtgtgtgtgtgtgtgtgtgtgtgtgtgtgtgtgtccatacgtgtgtgtgcgcagatgtacaagcaggtggaaaccagaggaatatgctgaccttcgtcaatcacctttttttgtgtgacagggtctctcactgaaggtctgtcagttcagcttctggaatgcctctctgtttccacagcctccagctctggcacatagagtcatcattggctcttacaggagtactggggatttgaactcgggtcctcagtaattccataacaagtgtttttatccactgagccattctcccagcctcaagtcctcacttttttgtggcgtaacattcctgtatcggggagtctgtgggggtttgtcgtggctccatttaaaatcttactctgtaaagcttcctccgtgcacctgcctgagcctgccctttcacccactggtcagtttcttagcacagtgtatctgctgactgaccttgttgtggatctgatctctgaggacataggaatctgccgccattactgtcgctctctctccagggcgagtcctgctcctctggcccccagctctgcacgggccagcttcccacatggctatcttactttattttatttttttcctcacctttatttccccagtgggctcattaggctcctctctgcccactcctgcctacctggtgcagagaatcacctctgagcctttgtgagtccccctgtctcctcgcggggcctcctggaggggagtttttatactacacggacactgatgtctgtcccaggtgtggctccaatggagagttctagtctggcctccttgttctaatgtgtggcctctcatgtgccaggagcgccctggagtcagccctacttgaggctcagtagctggtggtaaagaacatatccaccctttgcccttggggtgggtttttttttccaaactttactgaattaaagtgatactaccccaggaaacctgggaagggccaataacctgtccagctagctgggtgggagaccccgacaatcctgggccctgccttcagactctgggggtttaagttcaaggccccaacacagggccccctactctggaggcagtaccttccgaatgatgagggtgtggtgcattttgggatgctcatcttaccgcagatccagggctgatcttgtcacactggctgtagcctgggtgccagttccctggctgtccttggcaagcctgttagcctgagccttctttctcatggccagttgggtcaaggtcagccttggtctcatcctctctgggagcccctcctaaattgtggcctacggccctgtcccagtaaatgtgaagggtgatataatcttgtcatctttggcaggccctggggtggggggagaatgtgttacacagtgagtaagtctgcagatggtggtggttggacccaccacccactggagaatagctgggatttacagcgggtgtctggggcaggaacaggatggggtagatgggcctgcacacacagtaggacccacggtctaccaaaagtagctttagctacttaccacccctcagaaactcctctggctgggagatgactggctggctggctacttgctcagagcattgtgtgccccgttagcatccgcagaatctcagcttgagaatctcagcttgagtgtcagtgtctggggctcaggcatcctgagctgcacactggcaggtggcctggccggcctctctgtccaactaggctataaacagctgcccggtgtgccccccacccctcgcatcagccatgaagagtggtctccagccgtgtttattcatgatgtcatgtaaccattgctcctgtctaattcggtgcattttatcaccctggagggaaacgtcatgctggataaagagtttcttctcctcctactgcctctgtggatctgccttttccgagtgttacatagtgtcagtcacaccccggagtccctgtttctttagctcagtatgtatttcaaggttcatttgttgtctgccatatccgtaatctttccttcttatgggagagctgtgttccctcagattcacttgctacacttattaatgcagctgtgaacaacttagcgctctctctctctctctctctctctctctctctgtgtgtgtgtgtgtgtgtgtgtgtgtgtgtgtgtgtgtgtgtgtctgtatgtgcatgtacctactccacagcactggtgtggaggtcacgggatgacttgggagtgtctgttctctagtcccagagacaacgctctcatgactggcaggcgtttccagccttgctggtggttagctttctcgagtagtcatttctgcttcttgctgggctaggactcaaggatgcccctgagcaggctgcagccttgggtggctgaggagggagggtgtcagggaacacactcctgaccagtaggcaggtgtcagagcacagaactcatgtccaagacctagtgttccaggagtgagcagtccagaaaaggtcttgcctctgctcatgtgaccatccagtggcatttcaggaaagagtcagcgtgtagacctcatgtcccctctgtaaagtgggagtgccaggctgcctgatacacgtgtcaggctcacgtaggtatctaagactgagatgagctaaaatggattcttaccgtgcatctttgctgaattagctcgggagtcacaggcagatgcacttggctggttcctcagaaataaaaatagaacggctcacatctggatgtatgtcccaaaccatcgaaagaatgctcttgctaggcatggttggtgtatgcctgtaatcccagtactcagagggctgaggcagggggatcattgagtctgaagctagactgtatataagagagagcctcagggaaggggggagagagggagagctagcctaagctctcaagattagctctaagggtgttaattattctgtatgaaataaggcaaaagccagagatcatctaaccccatggtggattctgggaaggcctgtggtcgctcctggagctccaggtctgggatcccaggcaactctgggtggaggggtctacctcctaaccgggcaggcaggtggatggggaggccctcccaggaggaagggtcacaggggtaggccagagatgtccagagcccctggagagcatggggctctactgtgttcttattatttctcaagcaggccctctggcaggctggatgtttagcttggtttgggcttctgctgtgaaccttaatacatggagaagggccacctggggcccgaggtgtgccttccttgactgggggcgattagggagagttgggggacagccacacctcctttcactgttgagcagagaggtagggggagggcaaagtgagtctcagactcataaacagatggaagcaattttcagtcatgtgcgcaaggcctgaacccctgcacggcaaggcagggccccgtgtcgttctcccaggaagcgggccccaaagccacaggttctagggccagatgttacaaggtctttgtttatttaaagatgcccgaaacacaggagagtatttctgagtggagagctgacagacactcttgaagccttgtggaggggactgacctgggttggggatgctcctgatggcaggcactgtcccttaggactgtctgtgtcattgtttgggggcgtctggaccccgtggcagctcctgctgtgtttacaagcattctcttgttcaattgcctcccctctcccaccacccctctcccgccacatgccagaagtagagttgcctgcaccctgtggaggccgaggaacaggaagttactgaccagtaaactagatgcctgtgggggtggtccccacatctccttcctgaagctagctttgcaagccatttctcctgtcctttctgccactcaagccttgagaagatgctgagaggaagtgtgtccggctttgctcccgctggacatgctagtaaaacggagagaaaagctgccaggccagagatggtcagggttgagcgagctgaggacgtctgggacgagtcagcttgagtttagtggtttccccggacgtggagagacagtttaaccaaagcctgaaaaagcccctatgctacagacccatcattttgctgcttcctggcccctgctcacttggaatggtgcccccccccccccagcacctttggtcggttcccttcctctctgagggaggagaaggcacaagtattcattgagcctctttgaggttagcgtgcgtgggaacagacataaggaaaggaaactgggaagcaactggtgacccctctgtcctggctgtgtttggggggctgggctgtggggtcataagttgagactgctgacattttccatagaggctgaaagaggtgcctctctagggcttatcagcaatgcatcagctctacctcgaccaccccacagcggcctgggtttcagagccgcactggcaggctatctcagaataacagttaggtatactgtaagcattttgttcaaccagaccgggtggaaccagccttgcacacccctgcagggtgtgagcacctacggtctccatctgaatcatcccccaggcttgggctctgaccatgcatgcactcagccacaggaggctctaaccctgacctactgaaggaagctgaagtcttcaagtttaacccctagcctgtccacagacctacaaaccaaatctggcctttgcgtgagggtgagggcacttgctgtcggccgtagcctgtttcctgcctatcctgcctggggactgtatgggtgggccacctgggagaagagacacccccagtgaggatgagtcaggtctggaagaggcaggtagaaatcagatcacccctcccctgggaactgcctgtggtcacctgttggaccgtgaagggccctgagtgctagctacagttactgtaagctctgagcagaggcgaagggcgtgtgccttcaaccctcaggacttggggccaacagaatatggaacaaagtccttgctgcccacctggaaccaggggagccctggttggcagagctggcagagacctgaggcagatggctgagtggtgtggaccagttgaatgctactgtaggggatttcagttctgagatgctatgcaggagtttcatgggcaagtcaccgacccctgcagccttggtttcccatctgagtgccatgctggctgcagatcccattctcacgtctctgtttctccctccccagactccgaggtgactcccagctgtgttggcgacatggctgacaaccctagagatgccatgctcaagcaggcccccgcgtcacggaacgaaaaggcccccatggagttcggctatgtggggatcgactccatcctggagcagatgcgcaggaaggctatgaaacagggcttcgagtttaacatcatggtggttggtgagtgttacaggccattcggggggctagcctcagccccagctgagatcttgcctccctttgcctcccgagttctgggattaagagtgccaccatatctggcctatcagctctccagggtagtgtctgggcaaatgtgtgccataggctgaggtcctaaaccaatagagtcagataggcttccgactgcagggcctctgtctggtgaattgtcaggatgtctgttctgcccagatcttcacacagcctacacatctcttaggggctgttgcagctacctaggcccacacctctggagtcttggtgtcccttcttgctttgggtggccttcctaggaccaggaaggagctctgctgagttaaaccaggccccaaatccccacattggggtttaaacccaaccctggacttccactgaggaggtgaagcctcaggcagggctatccaaggatgtcctggtcatagtgtgatgtagccatgaactgtgttcttggagagccttccaaccggccttcccttctctccccagggcagagcggcctcgggaagtccactttaatcaataccctcttcaagtccaaaatcagccggaagtcggtgcagcccacctcggaggaacgcatccccaagacgatcgaaatcaagtcgatcacccacggtcagcaccacggaggctgggtgtagggactgcgtcttcccagggtgtggggtcagagcatagcactagagaggtcacgtgaccccgtgggaaaattgggactgagtaatagtgggctggattcccatgggcccaccaggctgagctcccacagacatctgaggtttctttatactaagagtcatggctggcaccacccagaagaggtcacttgctccttggcatggcctcagctgttatcacagccctttctgggacgtaccaggctggccaggcaacctgaaggcttggggtgacccgcctgacttggggtgctatggtttgtgcagatattgaagagaagggggttcgaatgaagctgacagtgattgacacgccgggcttcggagaccacatcaacaatgagaactggtaggtcactgagagaaccttcctctatcagtaaaagccccactggtcttggggctccatgataccactggaggccagacccccctgccataagattatttcaaactctaaagccgtgcatttggggtctaacattctagatcaaaatggggtcacccggctcccatctggggtgggtttcccaccccagggcaaagatcagcatggggagtatggcagaaaatctgaaataaggctggtttgtctttgcaaccaccagcattcctgtatgaaatcagaggctggtgtcaagccagttctgggaattagcctgttataggggcctgggagggcgggcttagagaggacgcgggcaggagggagcattcagggtgcaggctaacccggctctccatgcagctggcagcccattatgaagttcatcaatgaccaatatgagaagtacctgcaggaggaagtcaacatcaaccggaagaagcgcattcccgacacccgtgtccactgctgcctctacttcatcccagccaccggccactcgtatgtcccatgctgggccctttgtcttgatggtgggaatccccagttcccatacaagcaggattctgtctgggcacagggacaggggcactgagtcagagctgtgtcagcaactgtcatggggcgtctgtgcctacagaagttctccatgacctctagactgggcggttccacgcccactctgccttcttccctttgtgcacagagctgaggacagggcagactctggggtgttctagaatccggtagtcagtctctgcagatggaatgagactctcgggctgtacatgtgcctgcccccatttcccgtccttgacaaagatgcttttagggcctgggaggcttcggaattccaggtgcctttcagaatctccctttggaatctcccggggcagctagactgtcagtggtctcagtgatcagggttcttggcttcctgtgagtctcatctgttcccagtacatccgtgttgttcctctccttgctggatatcctggtcgcttgtcctgactccgtgtagggtgcatgtctagtcctgggctcagagcagcaggagccggaggtggctcgtttagaagagttgaggagtcacagatttggtgctgctagagtgtgcacactccccggctgttcctggctcatccctgggtgtaagagcgtgggctttgaagggacttttcatcttgcaccctgtctagagggcaaaagtctcactggggtctggttggaaaaacccaaatatcgttgtctgagcttgccagtagtggctgtctccagtggggtccacaagagccagttctgggaattagcctgttataggggcctgggagggcgggcttagagaggacgcgggcagaagggagcattcagggtgcaggctaacccggcatgccattggcctcagctggggctggcttgtttggggttctgtagctgctccgagcacagcctcgggcaaggccaaggctgacagaggagacatggctgacatggcttcagcagggagagccagaggcagacacttccccagtggtgaccctctggactagggcccttcctccagccgctcagtcccaggggacagtagtggcttctggccatcattgcttggcttctgactgaagcttcacttcctgcaggctgtctgggcctgaagatactgctatggggaagatgccattccaatgagaaaatggtgcccaggcttggggtctgccagcctctgccccatccctggatcagaccctgggtctctgcagccaggctgacctgggaacagccagcctgtcccagggcctggagcttctggataccgtccctcgtgtctccttttccctggcattgaaaaccccacggcatgacagtgttgtgagccgagtcactctctgggtggacggtgtccagggccagttggactctgaagatcttgtggatgagggagcttaaagccagctttacaccagctccccaccctcagctccatgaggggagagtgctcaccctactaaggcccaaccttacccctccatcaacatggcccccactgggacccctaaacaaagtcttttgcactgttctgtttcaggctcaggcccctggacattgaattcatgaagcgcctaagcaaagtggtgaacattgtcccagtcatcgccaaggctgacacgctgaccctggaggagagggtctacttcaaacagcgggtaggactcatggcctctacccagccccttcccctccaggactgcccagacaagtgacaggcttgacaggggcctgtccagccctgggatatatgataggaaaggcgcctattcagctcttcacagcatgtgttcagccttgggggagcccctggcctttgtggatgtggggctcccccatatccagccgtctcagtggggttcagaagggagtagatcaagcagatgcaaatgtgtcagggccattggacccagcattcctgagttttattaagtgggacagtccacctcagtggcttcctccttctctgccatggtcagggccactgctgtctgggtgatagggctgtacctgcaggcgtctgcagtagggtaagccctgggcctcttctgtgtgaggtgactttggagcctcttgagagctccagcctggggttgtaagagaggcctcaaatccaattgcagaggctaccagggcttccttccctagctgtgtgttggggattttcccagcatgcataggggagggtagtcagggatgcatctgctggagaagagaccaggatgctccccggtgttttgagagcctggatctgcttgaacagataagacagtcagctattccctgggccaccctatattgacagccacgtgggctgtcagtaagtcgtcaagctggggagagtttcagcaggcaggtacaccctgggctaccatgctcatcctgagagggttttcggaaagagggcgcagcaagcctgagttgttttctaggggggagtggaggggggagctgcacagaaagcgcagggagactcaggacaatggctgcagggcccctcgggacaggcgagtgcttcttgatgcctaaggcttcagagctggtgatcctcggcgggggtggaactcaggcggtagagtgctctcctaccatcgagagggctcagggtttgatctcagcaccacatggaactgagcatgataactgtcgcctcccaggattaggaggtagaggcaggaggttcacaagtttgaggtcattcttgtttatgtagccagtttggggctagcctgagctacagactttgtttccaaaacgtggtggcagtggggctggaaagacggctcaggggttaagagcactcaggttcaattcgcagcacccacgtggcagctcacaaccagctccaagagaactcagtgtgccctcttctggcctccatgggcacttagcatacatgtggtacacatgcaggtgacacacttgtatatataaagtaaatgtaaaatgaatctttaaataaattagacatcctcagggtgggcccactcagagcctgcctttgttaggggatcatggctcaggcacctgagtggctgatagcctgattcaccctgtatctcccagatcactgcagacctgctgtccaacggcattgacgtgtacccgcagaaggagtttgatgaggacgcagaagaccggctggtgaacgaaaagttccgggtcagtgggtcaatctgcctctgggaggtcaggggcggtggacagatagacgggaggcagtctgtccactctgggtcctctgaaggcaaggcctgcagttttccaggcccaagacacagggtgttcgagggtggcactggccctgccgatcactgtgactaactcttccgtccctctttcaggagatgatcccatttgctgtggtgggcagcgaccatgagtatcaagtcaatggcaagaggattctgggaaggaagaccaagtggggcactatcgaaggtattggctgctatgctgctgcagtgttgaagctgtagttgggcctgggccgtcacccattgcgctgtgggtccctgtctcttgtaaggacactggctgtagtgtgcacctcatgtacaccagggtccctgaatttaatgactttgccagacttttgttactttgtcccacgcactgagggctggggctctgaactttcctggggtccagcaccccaggtgggatgggtccagggattttcttggctcttctctctactcttccaccctctttggaacggaggatggggaagggcagagctgcctggaagatgaaaacccactttgttccttgtgaccagtgtggtcaaaaggccccacagagaagcagagagttgaggctttgatttgggggaaatcccagttctctagggccccagtcttgcacccttcataggtgcaggctagacctctgtcctaaggtctaggcaaaacaggatggagcccaggatgacctggtactcaagtcctcctgcttggcctccggagcactgggatcataggtgccacaccccagctgctggaactctccgaggagcagtttactctaaggctctggtctggttggtgcttcctggctctgggcatagaggcctccagccaggaccaccctccccatagtggattaccatttaaccctttcagttccccaggtccctcccgctcatccttgtccagtgccaactcaaccttcctttaacacagttcctcatgctgtggtgacctccaaccataaaattattctcgttgctacttcataactgtaagtttgcaactgttacaaatcgtgaacatctgacactagcaggatgcctggggttgtaagtttgcaactgttacaaatcgtaaacatctgacacgcaggatgcttggggttgtgacccgtaggtggagaaccactgagtcactgggctagtaaccattggtcaggtgcttgccttgaattaaatgagttccacactctgccccccagaaaccaggtttgctgtttctgtgctgtttctgcgggatctatgatcttagtctttgagatgtggagccaggagggtcagggactccttcattttcacccaccctacagtgagctcggagccagcctgggctcccggagacactgtctaagaagaaagagcaagggagggaaagcagagtaagaaaacagaatgaatggacagccagggctccatactgggaggtggtctggcatgccacgtgaagccttgcactggagaccctggagttggaattgttgcctggtctttctgaggtgaccgctgaagagggcctgtcttccagcccctcccttcccctactgtgccctcctgtgggtctgccaggtggggtgtcctggggacagtctctgggtggttttggtgcccgtggcctcctgtagcactcccctcaatgtcaggtgttgaccccagaagtgactctaggggcctctctgaagctgttctctcaatagcttgtcctcagcttggttcccctcagtcgttccttcccatctttgatgtcttcctcatcctctaaatcctctccaggaatatgcaaggcaaggtttggaggagtaaagtttggggtaaaagccctgggactctaggagaggcattggatactaacgtgtctcttctggcccctgatggccaacttgggtactgcatgcactcaatgagaactcatttagccaggttagattactgttcccagctaaggatccaggcagcctctgggtacgccccctggtggtcgttcccacatccagcatccttgtaaagtgaacctggtgcaagttcctatcagggaccctgtgagttcataacttactaagtcccatccaatggggcctactcctaatccttggtacgcaccatctgaagtgtctgttccatccttggaaggtggccagagtactacctggaggatggaaagctacttggttcctcaaaagcgtcacaaagtcagaatacatccttggctcatttggtcttttgtgcccttaaggtccaagccatgctgatctcccgtttaaatttctcttacatttatttattaacttatttactttattggagggagagggcacgcacatgccaaaacacggatgtagtagtaagacgacagcttgcaagagttggctctcaccttctactgtgtggttctgggaatcaaactgcagtcattgggtttggcggcaaatgcccttatctactgagtcatttgctcattttattgagaaactgggtcagagaagccaacagaactcaccccagtccagaacacaaggaatgaggggtttatttgggctcacggttccagggtgcagtccatcatgctggggtgtcatggcggcacgacaatagactgttgatcgctgtgtatccgcagtcaggaagcagataaataaatgctggaattcagttcactttcttttttattcaactgggaaaactcggcccacaggatagtgctgcccacattccctgtgggtcttccctcagctgagcctctcatagacacactagaggcgagtctccctgttgactccgaaaccatcgagtggctgtcaatcatcctgcccagtgggcggggctttctggaagctgttggctttcccggggaggagaggaggggcttcctccccactgatcatctctccttctcttttccttagttgagaataccactcactgtgaatttgcttacctgcgggatctccttatcaggtgagtcagctctgaaggccccttgggaggaccggctctgggggttggtggtggtagatgggcgggaaaggccccaccctggccgcctgatgtcagccctgttctcgggaactgagctgaaaacaagctaacagaaacctgggaatggatgaagaaatgaggattctttctaacctttcgaagtcaccaggatgagaggggctccatccggtccccagtgggctaaacatgctagattcagctatggctactgtccacacagcacagcctggactatatgtcccaaacaaaactaacaaactaaaagaaaaaattcatttgtgtgattaatatacattagtagaaaaagtcctgccaggcaggactgtctgagggcctggggtggggattccaggaataaagccttccgggctcctcacctttcccactccccttcccaaagtaaagaggaggggaggtctgcagtgtgggccatagatagaagttgcctggcaggctttaaggctctggctcccacctgcaaaaagaaactttgtttaaaaagtcagtttaggaatgtcagggtaggcagcgctggggactgtggtcatctgctgcctcctgctggccacagcatgaatttctgtcttggagcacgaatacccaagtcctgctcactggtgaagaaggccttgagaccttccacagctttgtgtttttagtgcccagttctccatccttgtgcaggcccctgactagccaatgtgaacacagagacgggggtacgggttagaatgtgaggccacagaaggtctaaagttaccagagagcgagtgaacgccacctggttttgctgggtatgcacagagagcctgcaggatggctctaagagccaggaggggcaggcggttgtcatcccaggcaggctaagtggtcaccccctcccccccaatgctggccatgttccctgcaggacgcacatgcaaaacatcaaagacatcaccagcaacatccacttcgaagcctaccgagtgaaacgcctcaacgagggcaacagcgccatggccaacgggatcgagaaggagccggaagcccaggagatgtagaatgcgtcccgcccctggaccccacccccagatcttttcatcatccctggcccacccacctaccctgtcttattttatataattatctccttgtcacctgcctccatccatctcttcccacactttgccaggtaacaagagagggtttacctcccaagtgtgctcttattggctgcagcagcagggtgggcggggctaagcctgggcttgcctctgtgctctatttccacccgggctcagcccctgaggggttagaagagctatgtgtccgtcccccgctctgagttctaagctgaagcctgtgggggccaagtcctagggggtgcagaggagcccgttagaccacaagaccccatggccgcagcctcaagcaggttagagactgccccaaaggaggatggagctggccgggtattcctgaaacctcacctgcccctccgggggcgtttcttacagcgccctcagctgcctgcccctcaagggaactagaggcgtcacagccaaagttgccaatcacttagacaaagtgacaaccgtgcccctcgagcttgtcccagagcagaaagtgccttgatctacaagagccagtcacctcttcccagatgtccctttgggtgaaaagcagggacgtgctggagagagggaggtatcttttctccctcgcccttgggttctctctcccctgtgctgtagatatcgctactacactgggctttaattataaaagacgaagcgtgaaagatgctccccgatgttaggaagccccgcccccaatgtaaggaaggtcaaagcaagaagatgagtcgaagccatgagggaggaagccgtggaagggaggcataagagtgtgtgggagctctcctgcccaggtgccgcggaaggcatatccgcgtggtcctcagtttgggccaagatattctggttacattgatgctccgctgcctcaccctgtcccaccccacacaccccaggctcaagccttgatgattcagtgactgtactgggtgggagccagaaacctgaccattttgttgtctacatgagcctagactagccctgtgccccagaacccatcaaaaatacccctaaagagggaaagatgagggggtcagagatggatagccaggctcactcatcttctctcagagggaacattagggaccatccatgcacagctgaccaaagccgtgtccttcctgcctgcctcccattctcatttgcccctgaggagaaagtttggtgaggtgcgttaggttggacccgcttggggaaggtgcctctacagacccagggctagctttctgcagcccagaagtgcagtgggaggggtggggtgcagacagatggagacgaacattgtttcctgctttgggcgtctactccctcatccaagcatggaagggcccctcgtcatgccctgtggccgaacagttcgcttgccagcttgccaagttcttttgccaaaatcaggactttgaaggaaatctccagcacgctggacccagggcactccggccttcaccagcccaagtgaccctggggatttagcagcaacccggtcatcaggatgactttgtgcctctgtaaccaggtattgaaactgttcgtctcaccaggccggtccacgtggccctctgctgggggcttcctggtgggggggcagaaaagtctctctctctctctctctctctcttttttttttttttgtataaataacaaagtgttgaaatgtatttcctgaaataaatgtttcaaatacaaactttttttctggagttctctttggcaagacctgtctggtccattaaaggtggtgaggggagcacgggagtagaggctcccagtggaaggaagctataggactgtgtgagatccagaattaggaatcagcagcccagtggtgaaaagttagccacacccactgcctgtaatccagcttgtgggacatctgacgccctcttctggcctctggtggtacctgcacacatgtggcagacacatatacacataaatacaaatctaaattttattatgtgagaccctggtaactggccatttataataatgttattccaagagaactaaaccatgtgtggtcccaggaggctggctgagccaaccagttttgtgtacaggaatcaggaaaggggagggtccctctctgtgtgctttaatgtccccaagctcctgtggcaagtgactgcaatccagacaccctggaacaatactagtgtacactctcaccattcggaagcccgggaccgagtgttggcatggctccatccccagtcccctgccacccctgctcctggggactgcgttatttcaggtccatgcactttgctcttgagggacactcgtttcagcccaggataatctcatcttgattttaattacatctgtaaagatcctgtgttcaaataaagttttattctaagcttctgtgcaggtgggaatctggggcgatcacctccccacattcccttcctgcgtctcaggggttccagagctacagggacagcatgagagaacaacccgaggctcgtttgcatccaccaagccgagtgagtggtctaaggagtgaccctacctctctggcctgcccacactcttccgaaggccacctgaagacaaacgggcttcatcagccaatgagttgtgctcagcggcctcatggaaccaagcatcaagttgttgattttggctgttgatggcactggtagagggggtctggtccatggaggcagcttgcttgagtcccccagttctaagttccttgacaagtacacctcgaattcctccttcctcaagactgaactgttctctgtgcatcgccagtcccctccagccccaggtgcttaggcagtcgtcagctcattaacctgactggccaccagcccagctcacccgcacctccaagccagtgatgggggaaacctcacctcccactcaagcagacactgtaggaccagagtggccagccgttctcatctgcccaggaacgtgggctttcttgtgcctcctagctagcaatgagggaattctcacctttctactctccacagtaccggggttacaggcatactaagaggaaaaaagttcaggtgctgggacccacattcaggaactcaagcttatgcaatgtgggctccagccctgaatgtaaatgtgggctttccatggaactatcagagctagaaccaaagggaggagggaggggaagctggacaaaggacaaggtggcttcatggtgtgggaccccatgccagtgactttcttccctcctatccaactccagtgtcacatgtagccagctgggacagtggcataattcagaatggactgtcactaaggcaggagcgggaagaccctgcagcaggccctgctcttgatggcttaggcctctatgagatttggggtatcctgcagagtctgaaaatgccaggcatccccccccccattacaggcctcagggtttaaaggcaggaaacagaaagcccctgggagccactggagtgaggcctgctcagtgcagacctctcaggctggtcaaagtctgaagcgcttgctcagagagcaccgtgtgaggctctcttgggttttgtttgcaggtatcccttgtgtgtgtgtgtgtgtgtgtgtgtgtgtgtgtgtgtgtgtgtgtggtgtttgtatgcatctgtgtgcatgtggaggccagaggacaaccttagttgttttgtttatttacttgagacagtctgggctagccggccagcaagccccatgggtctgcccgtttggccactttgctgctggggttatgtgtatgcctccatgcctggctttacccgcttctgaggatcccaacctaaggtcccgtgctcccataacgagcaccttgctgactgagccatctctccactcaaaagatcaaagtttctttatttaatgtgtgtagatgtcttacctacatgtatacaggtgtgtgcctgatgcccgaggaaaccagaagagggggtgggatcgctagggctggagttacagactgccccgtgggcgctgaggatggaaattgagcaactggttaaccacggagccgcctctccatctctgtactcgcggttttttttttttttaaagatttatttattgattatttgtaagtacactatagctgtcttcagacactccagaagagggagtcagatctcgttatggatggttgtgagccaccatgtggttgctgggatttgaactctggaccttcggaagagcagtcgggtgctcttacccactgagccatctcaccagcccctctgtactcgttttaaaacaccactttctggctacaattctagccttatttaatatagaaaatgcagaaaaaattacacaacagagaaatagccccattcacacccagtaatgttgcctatcctgacactggggcacgggcctcagactctggggagcgtggtggtgaccccagcatttgagacaccgaggcaagaatctcaggggtttgaggtcaccatgggtatggctgtgcaccacagcccccaaccctgacccaggcccctgtgtcttctgcccagaaggactcctcagccaggggcttgcccttctatgcctctctctcctctgacctcttggaaggaggggggagggagaaatcttgtccccatcctcacttcattcccctgcctccctcccacccctgcactgtccctttagcccattggggaccagtgtaggattgaggtgcagttcctgagttcaagtggaaattccttccagatgctctgctgcccagagcgcagacaggaggggcctatgtagcagctgagtgcccatgggaaggatgctgtctggccccacaccaatacagggcggcagtcacccaacatccgttgctaggagcccttagagagtcctggtgcagagggttgtctgccttgatgcccagtgggtccatcaggcctgaagaacctctctctatgccgcctccaaacctggtttcctgctgccaagggccacagccggaataagacctataaagtggtgttagtcaggcatgctctgccagcctgccttatgccagcttacgtcatcacccacggcggccaggtacagggcatttccactggggggaggggcaccccatctggtctttctgtctcctggtctttctgtctgtccgtctctcccatattaccacgccgagaaggcctattactctctccttttcccagggaatgtcttgcattagatctgttgcgtgatgtgatctcttaacggtgcgccttgaccctggaccagccaacagtacattttctctaccttatcctaacagtaagaccagaattagaggcatcacacacagactatgtgtgatccctgcactctgcaaatggaagctggaggccagagaaccagagcccagactggctatatacaaaccctgtccatgaaagactaaagtaagacttaataaagaaagatgtaaaataagactcacatcactgataactcatacagtacctgcacactataaaacatttgaacagtaggcatgggaacagcaaatagtgacagtgacttccagttatatgatatatattaaaataaaaaataacatataataaaatataaaaataaaaatgtatgcatgtatgtgtgtgtatgcatgcctgcgtgtaggatgtgtgtgtgtgtgcgtgcctgtatgtagggtgtgtgttgtgcatgcatgactgcatgcatacatgtgtgtgttgcatgcatgcatgcatgtgagtgtatgtactcacggtgcacatggagagaggacaaaacaggagatcaagagtctctcagtgccctgtgacaggtctctcattgcgcgagaagcttgccattttgattaggctggccggccagtgaacagtcaggatcctcttgtctctgcatccagaagtacaagcagggattccttctagagccaaagacaggaaggaggttctcctcctctctcctgcctgctaaggtttgaatgtgaaatgtctctcacgggtttctgtgttggaacacttgttctccagcaggtggcgctgttctgggaggttatggtgcctttggatgtggagagggtgaggcttgaggtgcaggctggcccttcttcctgatctatagagattcaaggaagctgcagcacaagccttcctaccacactgggcagtatctccatcaactacaagccataaaaacaaaacaaataaaaatcctcccttaagtctcttctatcagatatttggcaacaatgataaaataactgtaattctttgtgcttcctctgctcctgtccagccttcccttcctggcttagggatagccagagcctcctactgagtgagcgcctgcgtgctgacagtgaattttaggtcagaggtgtgatggttagtcctcattgtcaactggatttgggaccacctaggacacagatgtgtttataagcacatttctaggatgtggacagcgccaccccatggactggcgtccttgagtgaattaaaaagaaaaggaaaactggtgagcccttccaaggaccagcatgcattgctccacttcctgcctgtgagcaccatgtggccagctacctccatctccttccaccatgatagactatcacctctccaaagcgggctgaggtcaaccctcctctcctgagggttcttgcatcacatatttctgtcacagtagcaagataggtagagctgagacacaaaaccaccccagcggtgcccttcctagattgcatacggaagcattcctggaggcacaggttcaagctgggccagtggacaggcggccctcagtagtgccggagggtccctcctatatcaatgtgactcagagggcagagtagaagtggggtgtctctttctgctgtgtggccttagacaagctctgttccaccaacagggacatggccactaaggcattgtttgatgccaatgaggaaggagggaactctgtgtttcattgctgtgataaagagtccaaggaaaacagctttgaggaggaaagatggattttggctcagaggttggaggtgtcaagccacaagcccgtagcaggacagattctgcactaagcctagggccacctggaccttgcatcgactcaccaggttcaggtctctccctatcacaatgtcaccctttcttcagccatggcaggtgggccttcttagcatccgtggagcctgagcatgtgtgttcgtgtgtccaatccagggctttcccttacatactggagaggcacagcagcactgtcctgctctgcaggatcagatggacccagatcacatctgaaacacagtttcctagggcaccgggacttcaccaccatttgctagtgggatctttctgcacccagcgcagctcctgagcacctgggatgccactgggactcatgcaagttgtcactgaatgagcaccgagcgctctgcggaaagatcatcttcctttcctttcgtataaggtgcttataaagaatctgaagaaaatagggcatgaataattaaggctgcccagagcaaagggatcttgatctgtctgcttgaattaaaaaaccatcactcggaggggcctggatgccagagagcatctgtaagatgtctttacccacagtgccactgcctgctcttccccctttcactccctccctcttcctccccttcttcctgtctctcctggacaccaaggacatcagctcttcagacagccctgccacccagactatcaccatggcctcttctctctccctggttaataccttcatcctaggcccaaagagaaacggcttgacctctgtagaagggtccttttgtgggagacggggtccaggctgggatgctcaggagtcccagaagcacagtcacctgtccagccaaggtgggcaaggctcagaactagggtttgtacctctgtcatggacttggggcttggggacaggcctgtcactgacttttgcctctgcctctttttacagagttgtggctgaatctgtaggatttcttgtccttgggatggcagctgccagggggttcaggggaggctgggtacggggacgtaggatctgtttgtctgtctagtttgccatgctggggggtggggggtggatctgcggcctttgcaatatatggtaggcaagtgctctcccctgagcaacagcccagcctctcgagctcttcagatgtttctatccctgttgaaatccccatctgttcacatgaagacctgtcctctcctcactgttcccccaataggtcttttcacgtatttttagttacttcagtgagctaggaccttgtctgttacagtttgaatgtgattgtgccacaggcccctgtgcttagtcccctgctggaacaggagtctgggggttgtggaacgcttagaaggtggagctagccgcaggagtggccacagctcttactctgagctctctgatcagctccatatagcagctgtcccctcaccctggccaccaggagccacgagcagccatgtcttccccaccatgaccgacttattatttatttatattatgtagccctggttgtcctggaactctccgtagatcaggctgtcctcgaactcacagagatcctcttgcttcagtctcctgcgcgctgggatgaaagctatgtgccccccactgctatggcagacttcttaaactgagtcaaaagaaccttccctcctttcagttccttctgctgggtattgtattgcagcaatgaaaagggaaattaacgttgacaaataacccccacattcctacctcatgatctcatgatcttgttttcttgctttttggcatatcctgcaacttattcctctgtccccaaatcatgccttttaaaaaaaaagtcaaaaaatggaaaataagcctctctccctgaagttagtgtggaggagagaaatggatgttgccagaaactctgacgtgggtagaatgttcttatacgcggggctgtgtcagaagcttggaggtgtggtgctgtggatgaaaacagccccagtggctcatatatttaaatgtttggttcacagttggtgggactgtttgggaaggcttaggaggcgtggccttgttggaggaggtgtgtcatggagggtgggctttgaggttttaaatcctatgatacttcccgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctccctccctccctcccctctgactcctgctgcttcaggtatcagttctccctgctgctccagcaccatgcctgcctgcctcctgccatgccccccaccatgagagccacagactcgccctctgaaactgtaaagcaagcttccaaataaatgctctattctataagtccccttggtcatggtgtctctccacagcaacagaacagtgactgacacagaggatgtgatcgtggctcccggaagctggtgtagccacacaggtaccgttgctgtagagagatggtatgacctcctgacatgccagatgttacagatgtgaactgtgaaattcacactagggtcatcctgttcacacttactgtctgcctgaatgaccttaagatgaccttgaaaatccccccccccctccccaagtccactggctgcaagggactgctgatcttgtgagttcaagatacatcaaaatcccagccagccagcatccacctgggctggcaggctccacagctcccctggagactccataggattcactaccagaaacctggccctgatctctgtgtcttggcctccattgtaataggggcctccgttgactccctgcccagattcctccagaatgttctggcttttgtcagttcaaggctggccctggcagccgtggaagcagggagtgtgtgtctaataaagtcagcgctctgtaatttagcaattactgaaacccacacttgtaatttagggggtttcttgtaattctttgtagtctttatctctctttgaacaaatgtgcagcttaatagcttcctccatcctgttccaagggttggtatttgccacccctcccccactcagctccagttcatgaaagtgtctagattgtgtggaagccactttccagaatccaaaaggttaatttaaaggccagccttccccccaaccccagtgctggctcctgacagtcaagcagtatctccagggccccgagtttggcactccagctgttggttgggtagatggcgtgatccaccttcggcagggtctgtggttgggccattcccattgctgacctctgaccctttgctcaagcagttactaaatactttggttttgagactccgttgggaatcagagccatcaaggacgggctggacctctctctccagaggccttcagtctagtgagaaaaggatggctggctgtctaggacgtcacaggtcccaaccgagctggcacccgggaccatggcagccaagggaaccaccctgtcagaatgagctgtaagaggagggaatgggagtctggtgcggaggaggaagagggacaaagcctgaggaggagccctacagagggcacccagtttttagaaactgtatttgaaacagctttgggtcgaggatgtggctcagttggtagagtccgtgcctgagagtcttgacttggttcccagtgttccgtgagtgtgacaacacatgcctgcagccccagcacatgcctgcagccccggcacatgcctgcagccccggcacatgcctgtagccccagcacatgcctgcagccccagcacatgcctgtagccccagcacatgcaagttgcagatggtctgtcctctggaatcataaaccaagtttgagacctccttaaattgcctttggtcattgttggaaacaaaaaacagggggtgggggccagtggggcggggggagaagtgggggaggaaaaggggtctaacatccggccagagttcctgtgctctgggcaggcagacacaggcagagctgctggacacttttccattcggtcccgggtgagcatgcctgacccacgcagcagggggtggaaaaggggcagctcctgactggggatcccaagctaccttgctaaagccccagggctgtaggagagagggaatagggaaggagttcccaacactggcaagagagtgcacagcggatctagatggaacagagactctcaatagtttaaaagctttattatagaaattcaggggaaagagagaagatagagagagagagagaaaggctagagagaaagagagagagagaaagagagaaagagagagaggagaagacaaagagaaagggaagaggagagagaagtgagaggtaagggaacaaaggagtaagagagtgaggtgggggcctaacagccctttttatggtcttcactgttgctaggtaactgaggaggagtttggcctgaaggtcagaagcttgggccattgcttatgtgactactgaccatgctggatcaagtgtttttggtccctgagacatctccctgacctggaatgagggatccacttgcctctgcttaccaggccagatgccttgcttgaa

SEQ ID NO: 1512 - DNA, 2942 bp, Mus musculus
aattcggcacgaggcgccagaacacaaccggagtccctgaggctccagaacagagtcagggtgagccagccccagcccagccccaggttctggcttcctctcttgcttctccctcctttggttgcagccagcagagcccacttaaactccgaggtgactcccagctgtgttggcgacatggctgacaaccctagagatgccatgctcaagcaggcccccgcgtcacggaacgaaaaggcccccatggagttcggctatgtggggatcgactccatcctggagcagatgcgcaggaaggctatgaaacagggcttcgagtttaacatcatggtggttgggcagagcggcctcgggaagtccactttaatcaataccctcttcaagtccaaaatcagccggaagtcggtgcagcccacctcggaggaacgcatccccaagacgatcgaaatcaagtcgatcacccacgatattgaagagaagggggttcgaatgaagctgacagtgattgacacgccgggcttcggagaccacatcaacaatgagaactgctggcagcccattatgaagttcatcaatgaccaatatgagaagtacctgcaggaggaagtcaacatcaaccggaagaagcgcattcccgacacccgtgtccactgctgcctctacttcatcccagccaccggccactcgctcaggcccctggacattgaattcatgaagcgcctaagcaaagtggtgaacattgtcccagtcatcgccaaggctgacacgctgaccctggaggagagggtctacttcaaacagcggatcactgcagacctgctgtccaacggcattgacgtgtacccgcagaaggagtttgatgaggacgcagaagaccggctggtgaacgaaaagttccgggagatgatcccatttgctgtggtgggcagcgaccatgagtatcaagtcaatggcaagaggattctgggaaggaagaccaagtggggcactatcgaagttgagaataccactcactgtgaatttgcttacctgcgggatctccttatcaggacgcacatgcaaaacatcaaagacatcaccagcaacatccacttcgaagcctaccgagtgaaacgcctcaacgagggcaacagcgccatggccaacgggatcgagaaggagccggaagcccaggagatgtagatgcgtcccgcccctggaccccacccccagatcttttcatcatccctggcccacccacctaccctgtcttattttatataattatctccttgtcacctgcctccatccatctcttcccacactttgccaggtaacaagagagggtttacctcccaagtgtgctcttattggctgcagcagcagggtgggcggggctaagcctgggcttgcctctgtgctctatttccacccgggctcagcccctgaggggttagaagagctatgtgtccgtcccccgctctgagttctaagctgaagcctgtgggggccaagtcctagggggtgcagaggagcccgttagaccacaagaccccatggccgcagcctcaagcaggttagagactgccccaaaggaggatggagctggccgggtattcctgaaacctcacctgcccctccgggggcgtttcttacagcgccctcagctgcctgcccctcaagggaactagaggcgtcacagccaaagttgccaatcacttagacaaagtgacaaccgtgcccctcgagcttgtcccagagcagaaagtgccttgatctacaagagccagtcacctcttcccagatgtccctttgggtgaaaagcagggacgtgctggagagagggaggtatcttttctccctcgcccttgggttctctctcccctgtgctgtagatatcgctactacactgggctttaattataaaagacgaagcgtgaaagatgctccccgatgttaggaagccccgcccccaatgtaaggaaggtcaaagcaagaagatgagtcgaagccatgagggaggaagccgtggaagggaggcataagagtgtgtgggagctctcctgcccaggtgccgcggaaggcatatccgcgtggtcctcagtttgggccaagatattctggttacattgatgctccgctgcctcaccctgtcccaccccacacaccccaggctcaagccttgatgattcagtgactgtactgggtgggagccagaaacctgaccattttgttgtctacatgagcctagactagccctgtgccccagaacccatcaaaaatacccctaaagagggaaagatgagggggtcagagatggatagccaggctcactcatcttctctcagagggaacattagggaccatccatgcacagctgaccaaagccgtgtccttcctgcctgcctcccattctcatttgcccctgaggagaaagtttggtgaggtgcgttaggttggacccgcttggggaaggtgcctctacagacccagggctagctttctgcagcccagaagtgcagtgggaggggtggggtgcagacagatggagacgaacattgtttcctgctttgggcgtctactccctcatccaagcatggaagggcccctcgtcatgccctgtggccgaacagttcgcttgccagcttgccaagttctttgccaaaatcaggactttgaaggaaatctccagcacgctggacccagggcactccggccttcaccagcccaagtgaccctggggatttagcagcaacccggtcatcaggatgactttgtgcctctgtaaccaggtattgaaactgttcgtctcaccaggccggtccacgtggccctctgctgggggcttcctggtgggggggcagaaaagtctctctctctctctctctctctttttttttttgtataaataacaaagtgtctgaaatgtatttcctgaaataaatgtttcaaatctcgtgccg

SEQ ID NO: 1513 - DNA, 1005 bp, Mus musculus
atggctgacaaccctagagatgccatgctcaagcaggcccccgcgtcacggaacgaaaaggcccccatggagttcggctatgtggggatcgactccatcctggagcagatgcgcaggaaggctatgaaacagggcttcgagtttaacatcatggtggttgggcagagcggcctcgggaagtccactttaatcaataccctcttcaagtccaaaatcagccggaagtcggtgcagcccacctcggaggaacgcatccccaagacgatcgaaatcaagtcgatcacccacgatattgaagagaagggggttcgaatgaagctgacagtgattgacacgccgggcttcggagaccacatcaacaatgagaactgctggcagcccattatgaagttcatcaatgaccaatatgagaagtacctgcaggaggaagtcaacatcaaccggaagaagcgcattcccgacacccgtgtccactgctgcctctacttcatcccagccaccggccactcgctcaggcccctggacattgaattcatgaagcgcctaagcaaagtggtgaacattgtcccagtcatcgccaaggctgacacgctgaccctggaggagagggtctacttcaaacagcggatcactgcagacctgctgtccaacggcattgacgtgtacccgcagaaggagtttgatgaggacgcagaagaccggctggtgaacgaaaagttccgggagatgatcccatttgctgtggtgggcagcgaccatgagtatcaagtcaatggcaagaggattctgggaaggaagaccaagtggggcactatcgaagttgagaataccactcactgtgaatttgcttacctgcgggatctccttatcaggacgcacatgcaaaacatcaaagacatcaccagcaacatccacttcgaagcctaccgagtgaaacgcctcaacgagggcaacagcgccatggccaacgggatcgagaaggagccggaagcccaggagatgtag

SEQ ID NO: 1514 - DNA, 96595 bp, Homo sapiens
  misc_feature (47135)..(47940): "n" at positions 47135 thru 47940  can be any base
tcccagcccagcttctctgtagatccacatctggccaatctcctatgtctgggactcttgccctccccagaaggacgaaggctcttctcgaggttgtgtttgggactgggccagggatgacatttctggcaaaagcttaaatgacaccatgatcaacgctttggtcagctcacacactttctttccttttaaaaaaaaaatggaattcttagagctacaaaacaaaaatgtaaagaataaggtaataaaacacctgtgtactcaccatcccgcttaagaagtgagacattgcaggtgtagccgcagccctgggtgaccctctccatcctagccccactcctgctgcggtgcccgcccctctggattgggatctggccccgggcaggcacatctgtgctgggcagtggtgtgtctgagaagcctaggtctccttttttttttttttgagatagagtctcgctctatcgcccaggctggagtgcagtggcaccatctcggctcactgcaacctctgcctcctgggttcaagcgattcttctgcctcagcctcctcagtagccaggattacaggcacccgccaccatgtctggctaattttttttgtatttttagtagacacagggtttcaccatgttggtcaggctggtctcatacccctgacctcaggtgatccacctgccttggcctcccaaagtgctgggattataggtgtgagccaccgcatccggcctggtctcctcttgcatacggtcatcagcatcgtgtgactgagcagcctaggtctgtctcctcttgaatgccgtcatcagcatcacatccttggtgcctcactggagtcagtggctgccctgcctgtgcccacaacgtgacggcgtggagacttatccatgtagatccacgaagccttggttcacttattttggcagctagcgagtgttcctctgtgtggggaggcagagtttgcccgtcccgtggcccactggtgacatcgccgaaggtcttctctgttactagtgctgccgggaacgtgtgtttccccaggtggatttggctgggctgtggagatgcgcttctcagcccttctagatgttaccaccacgccctcccgagtggccttctggtaggctctcccatgttcgctcattttctgtgcctcaggcagccgcctctctgactgagcgtccagctgacttttgccctgtttcccacggtgcacggagcatttcatctcagtggtgcctgagcttccctccctctggccctcagaccccggctgggatccttggagccaactcctctgcctgacatcccgtgtcgctaggtcctgctcttccatcttccaatacctctggggtgtgtggccttttccccagtgcccccatcatcccttctgtcctaggttgaaccgtgtcccccacaaactcatgtccaccaaaaacctcagaatgtgacctgggagttggagatggggtctttgcagatgtaagtagttaaggatcttgagatgaggtcattctggattagggtgggccctaaatccaacaactggtgtccttaaaagaagcagagaggccacagacacaccggggagagccacgtgaaggcaggagcagatgatggagtgacgcagccccaggccagggagcgtctgggaagaggcaaggaaggaccccccccccaccccaccccagagcctccctagggagtgtggccttgctgacaccttgattttggacctctggcctccagcatgggagagaacccgcttccattttttcaagccccacagctgtggtccattatggcagccacaggacactgatgcacctcccacctggccgctgtggatggacgaccccgcccgcaggaagtctccctcaagcactgcaggtgtctctgccctcacaggggacgcctgcacaagtaggtgtgaaaaaagggccctgtgggggcagggcctgggctggtgctcgctgcctcccttcatcctatgctagttcccatgcctcttccggcaggagtgcctggctccacctggtgaatcagagccaaactctcctgacaattggctgtcacttatttaactgccaccatccccaggagacagaaaatgccagaagggtggggcctgtgcagtgcctcctcgctatttccccagggcaccgtgccacgttgcctcaatgcacagagtagctgctcaaagtgtgtcggacgaacaggtgccccatgcccagccatgcagacaaaagtgtgccacgtggagggagctggtcgtggaagagaccaccagcatcttggctgcccgaggaccttgcccctgggctcttgcaggcacccctagttcattacttcctctctcacccatagctacccgctcttcctctatttctctgatatcagccttgccacccacccaggtttgcaagcaggaaatctcagagttgaccttgacctctgcctccccagcacccccaggtctcaacaggctgccaagatctcatcaactcgccctctgcatactgacccttggacaggctgccccggtcacggtcatgtcttggttgggcctccatcatccctccttggaccagcaggtgccatcctccccacccctgccctgctgtggctccttcccctccacggccaacatttagaggacgattaccacttccctccctgtgtgctggggaccgggtgataggatccctccacccgatcatttccattagacctgggccgggtcttcttactcacagagcccttagtttccgcccccaaagcctcgagggtggattcgtgctgccgcccagcctggccctgataccgctttccagcctggagccccctgcttctgcgctcctggctctgagtgctcgggccccccctggatgggttgccacttgtcctctggaaagcagggcttccatgctcctggacctcctagctgactcaggtgactttgggccatcttgtcacaccccttctatcagcttggccttggttatttctgtgtcctccatagcctcggaccagagccacggcgggatgctttcctggtgcgtggcaggcagtcaggaaatattgctggactgaccttgataggagatgcttgggagaattgcccaaaaaactagcttaaaatgcaaatattggccttcttttgcgttggctaaagagtagcatttctccgtttgcctcccgggtaagaaattgatggcgaatgcaatgtctctagggaggagaagaaggtgacaaaaagggtctgtataacggggcacacgctaggcatttgtgactatttaagtttaaattataacataaatgcgaaactctttgccttggtagcccttccacattgcaagcgttcactgccacatgtggctgccatattgactacggcagatacagaacattgacatcattgcggagagttctatgggggggcgctggtttagatcatcttcacgttggatccacaaattcattgtttatccagtgaacggttactgggcacctactgagcaagcaggatgaaagacacccgctctcgggggagtcttccgttggctgcagagaagcttaaactcaggggacctggggcaaactctgcaagggcccttggcctctgcacccccagacctccctcgctctgcaggggcagtcgggggccccctctaggaatggagcgccagctccagctcctgtcaggctacagcccagatggttggctgagcacgagcatgtgagagtggaattgggcccaaccgggctgcttctccccgttgtcttggtttccttccacgctgacctggaaggactcctaaagcaacaggcctgcccaggcggtttgcaccagtaaaccctgcagcggccccaagggcagagatagctggattgtatttatttaggaacagccaaagtctgaggcacaataaaaagtggagaaagattccagagaggaatgcagctggcctcagcctgggaatccgtcttgcttgggaggctgtaggcgggccaggctggggccagcctggagggtcttggctggctctgctggcaggtacagtagcagggtcagcaggagggagtccaggacggagctccttcatttttaattcagggaagcaaacttcagtggttgagtctgaggatgagcaggaaatgaatggaaaagtcttttttttttcttttttctttctaggcagggtctttctctgtcccccaggctggagtgcagtggcacaattatagctcactgcagcctcaacctgccaggctcaagggatcctcctgccttagcctcctaagtagctgggactacagttgtgcgccaccatgactggctaattcttaaaagaaatgttttcaggctaggcatggtgacccatgcctgtaatcccagtacttttggagccgaggtgggaggatcacttgagctcaggtgctccagaccagcctgggcaacatgacgagaccccgtcttgactaaaaatacaaaaagttagctgggcgtggtggtacagccctgtagttccagctacccgggaagctgaggctgcagtgagttgtgatcacgtcactgtcctccagcctgggcaaagggagtaaggccctgtttcaaaaaaaaaaattttttttttttttgaggtggagtcttgctctgttgcccaggctggagtgcagtggcatgatcttggctcactgcaatctctgcctcccaggttcaagtgattctcctgcctcagcctcccaagtagctgggattacaggcatgagccactgtgcctggacttttttttttttttttttttttgtagagatgggatttctctatgttgcccaggctggtcttgaactcttggcctcaagtgatcctcccactttggcctcccaaagtgttggaattacaggtgtgagccaccacacccagcaggaaaagtcactttttaaagcgagaggttgtgcgtcctctatagcttggcgctcatcagcatggaggatttactggaacgtgtgttaggtgaggggacatggaagatggcagcaaatccgagcccagagcatcagaaagcatgctttcagccaaagatgcgttctctccacctccgcgcagcacccttccccagtgtgtactcctggagcaaggtggggccgatcctacgaagaccctttcccgaaggcccctgctgcccacatcagtgtcacctggaccgcctgctcccttttctggatggctggaccagccccagggcctcctggcctggtgtggggagcacagtccaccctggggaatgcctggtatgtgtcccctccccactgggtaccaggggatgaagctgtgcttcgtggaaggggacagaggcgctggtgcccaggatggtgcacctggggcggctgaactggacctggcccctactgggcccctgtggagcccagattgttgtgagaaggggtggggaaaggcaggtgatccgcacctttcacttttgtttcacatgggaacaggggcttatcctgcacacatattcagtttggagtatgaatttccatgaagaggaaaatctctattaggctctgatgtcaggattgtccgtgagggccgggccgtgttctggggcaaggacaggagtggagggggcaaccagggaaggcttcctaatggaggaggcatttgatagcatcttgaaaaagaagcagttcctaggccaagccagagactgaagaatgaccacctaacttcttttttttttttttgagatggaatctcgcgctgtcgcccaggctggagtgcagtggcgtgatctaggctcactgcaacctccacctcccaggttcaagcaattctcctgcctcagccttctgaatagctgggattacaggcatgcgccaccatgcccagctaatttttgtatttttagtagagacggggtttcaccatgttggtcaggctggtctggaacccctgaccttgtgatccacctgcctcggcctcccaaagtgctgggattacaggcatgagccactgcacccggccacgaccacctaacttctttctacaagatgccccctggctgacgcaaagcaggttgagtgagtgtgacacttccttcctgtctgtgggttccggcctttccagagcccggccagtgctattggagacaaagtggccttcgctcttccttcccgccctgccaggcccagcctgtgccgctgagccccactttgcaattaagaggagctgtgaaccagtgatgctgatgtcgcagaaaagtggccaggggtctatggggggtgaaggacagggatgccgccctgagaactgtctggaaggggcttttgggtaacagtgcccactccagggtgtgggcaggctggggtggctgggagctgggctcataggctggcacaaccagagtttcccaaagccgtgggcctgagggccctgccttcctgggacagcaacctttggtccaatttgggaaaaggtgggttaaaccaagcccggctccctcactgtaggattactcagtgcgtttagtatgcaaatgtgcctctgaatctaagacaggaccacagaaacctcttcagtgttcctctggagggagggaccgcgggggatccaccgcaggggcctgggtctgcactggcctggtgaagtgcccccttagtgcttacaccatgcgcggtgagaggttggccctcgcctcccccaccctctgctggccttacctcaccacctctgcactcgcctcccagccggctcatgactaactcctgcctcttcagagccaatcggtgctgccaggttttccatttcaagtgatcccccgcctgggccaaaatgtttggattttcaggcacggaggggagatggacctcaggccaaaccatgctgggtaaaactgagggtcaaggctgtgctcagcaagtgctccagccctggccgtcaaacccatagtgtgcacagcgtgcaggaggtggctgggtgaatgaactcagtcatagcccggcccctcactcggggctgttcccaagttcccaccgccagccaggctgggtcagagcctcgtggggccttcctgggcttccctgccccacagcaggagttcgtatggagagtctcgagtgaggttaatgggttttcttcctcttctttttttttttttttaatttgagacagggtctcactctttttacccagccagggtgcagtagtgcaattatagctcacagcagcctcgaactcctggcttcaagcaatccttccgccgcagcctcccaaagtgctgagattacaggcacgtgccaccttgcccagctggggtttctgctttttactttttctcttgtttctaaactcaatacaaagaaagatattacatttataatcagaaaaaccaacaaggaatattatttcaaaattggaaaagggattaaagaaacaaaccaagaaacctctgcgattcctgcccatcggagtcagtggttgttagtggttggcttaacacaatgttttaggaagaaatagaataacagaaagcaactccagtgagctgagccctggctccgtctgtggcgctgcatcagtttcctgcagctgctgtaacgagtggccacaagctggctgggtcacaacaacgcccagccatcctctcacagctctgcaggccacacatccgagatcagggtcaccaggctgaaatcagggtgtccactgggcatagccctctggaggctctagggcaggggttcccagccccgtgtgtcctattaggaactggcctgcacagcaggaggtgagtgactggcaagcgagcgaagcttcatctgtatttacagtcactccccattgctcgcattactgcccaagctctgcctcctgtctgatcagccatggcattggattcttataggagagtgaaccgtattgtgaacggcacatgtgagggatctaggttgcgtgcttcttatgagaatctgatgcctgatgatctgtcaccgtctcccatcaccaccagatgggaccgtctggttgcaggaaaataagctcagggctccaactgattctacattatggtgagttgtataattatctcattatatattataataataatagaaataaagtgcacaatcaatacaacgtgcttgtggccgggtgcagtggctcacacctgtaatcccagagtgaaactctgtctcaaaaaataaaaaataaaggccaggcacagtggcttatgcctgtaatcccagcactttgggaggccaaggctggcggatcacgaggtcaggagttcaagatcagcctggccaatatggtgaaaccccgtttctactaaaaatacaaaaattagccggacacggtggcaggcgtctgtagtcccagcttcttgggaggctgaggcagaagaattgcttgaacccaggtggcggaggttgcagtgaactgagatagtgccactgtactccagcctgggtggcagagcgagactctgtctcaataaaataaaataaaataaaataataaatataatacacttgaatcatctcaaaaccatctccccactccctggtctgtggaaaaattgtcttccctgaaaccgatcccaggtgccaaaaaggttgggggccactgccttcatcgcctgcccctttgagcctctggtggctgtgggtgtcccttggcttgtggctgcatggcccttaccttcaacaccagcatctacagatctctccgggccccatctccacttggccatccctgtctgtgtcaaatctccctctgcccccgtcttgtatgagcaccgagactgcctttagggaccacctagaccatccagggtgctctcgccacagcaagatctgcaactgaatcacagatgcaaaaactcttgttccaaacaaggtcccatttgcaggtctagggattaggacatgctatccctggggccattattcagccttctctcgtgactatgatccctcccttcctccccagcctcccacctcggctgagatgctgtccccacctccctcactgtctggctgcctgtggggctgtcctccaggctctttgggaggaggtggttgcttgatgtctcccagaaggctgggaatggtcctccccaccccccaggaagatgtcctttctgccaaggagattgcatttggggtcctatcccaggcagagagcggacgggactgtggcctgaagtggcacttcagggcctttggctctgtcatctagccgagggctgtgcatgggcctcacctggtcacaggtaactcacctggctctgtggggcagggattgtaaactcagaggcctgcggggtgtgtcgaggtagaggggtgcaaatattgtaaatttgttgggggccttggggagcagcacagactgaaaagtgttttgtctgaagagcagaactgtcttataccagccctgtgcggccaggcaggaaggcttccgtggtgcggccacgcgtcctccctttctcaacagaagctgacagtctggagttttcagagagattgcctgagttctcagccttggcacaaacacacattctctttaaacaggcttgggccaacagaaccagcctccgtgtctcgggtttgaatgaacccttgaggtgaagcttaaagacagagaggatgcccctgatccccaccccagggacccacattgtaaacccccacctgctctgctgagcccttggcctcagcatggaccctgaccatgtgctggtggggaccccccaggtaagtaagcagcctctgaggaccccggatgaacagtggggaacagcactgatcccccagtggggccccgagttcccggagaggaagactcgctccctcccaggggacggctagagactcactgactcatgcgtgtgtggtaggaatcttccaggaagtccccgtcccgttcgccctctctgcctgggcggggacggcaactgcctctgtcactgcagactaatgggacggaggggggtgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcaggtacgcagacagccccctccccatcggccgccccccactgccctggactcggggctttatttatgcctgggggaataagcatgcaaagggcgcttttgctcatttttcacagaaatatttcttttctttttgacggttccaagctcgtgggatgaactccgtctcagaagctaagctctcctgagtctggcttttatttaaactcggctctcctctctcctggctacttccctttcattttccagtgtgccattcttgcatgtcatggccactgtcaatgctgaggctgttggcgccgaaaccttgggagggtgtgggggacctgcccccctggctcgggtctggggcggcggcgcttggacctggctggtggttggtttgtccactgtgtggtttgttttttgcttccagccaaagtctgtcttcaaggctgcctcggtctcctacctaaaatagcatttctgtgccttcctggcagttgattatagagggggaagctcccggcgctcagaggagcctggcgtgtgtgtgcacgtgtgtgtgcatgtgtgtgcgtgtgtccattcacgctggcagcccccttgccgcaggcacagacccatcagggcgtgaacaggcaaatgaagagaaagggggctcccctgcctttagttcaccccagctttccaggccctccctcccaggcccagcctccttggtcccttcactcacatgcggtgccgtggctgccatctcacgtggccagcgccgtcatcggtaattagcagtgatgacagtttctgccgctcatgccgccctctgagcccagcgctgggagacatggggtggctgagccaagctccaggctttgggtattctgaagtgacctacgggccatggagcgggaggtcgctaagagtgtcaacccctacgtgccttgggccctggtctgttggttgccactatgtgtgtgttggggggtccctgagaggcctgagagagggaggcccatctcggtggctcctctctaggacgtgtggtcccctccaccactgctcccagggccacatctttttttttttttttctttgagacggagtctggctctgttgcccaggctggagtgcagtggcgcgatctcagctcactgcaagctccgcctccctagttcatgccattctcctgcctcagcctcccaagcagctgggactataggcgcccgccatatttttttgtatttttagtagagatggggtttcaccgtgtcaaccaggatggtctcgatctcctgatctcgtgatccgcccgcctcagcctcccaaagtgctgggattacaggcgtgagccacggcgcccggcctcagggccacatcttgattgtcacgttgggactggtggagcgggtgtgtgttgtgccgctgagcacacccagtcgggcacagcaggcggacctcaggagggggccaggggagacggcagaaggcttgggtggcagtgaaactgcatcttatctgtttgagctcgggggctcaggcccgctgggacgggtgggtgtggagcccagcgtcctgctctccgcccagcaggagccgcagggcagggagcgctgagagggaccttcgtcaggcttgcacagtggagccgtcctcggagtgaccaccccaccaggcagcctgggcagaccacagtgggtcccctgcctcctgggccaccagccccaggaggacgtcactccacccgcctggctggcaggggcctcggggagcctcgggttcggccttcactttatagatgatctagccgaggcccagatgggtgaccagcaggggatctgagagctgagcagagaggcgtgggtttgggggtggtgctccctggggagctggaagtgatggcaccctcccaggctcacaaaacacgggcttttcatgaactgaacaaaacactctttgaaagcagccagtgctgtgccccagagaccactctgatccctgctgcccttggctgaggacagcacagccagggatgaagcggggacctcccctcgggctgtgccttgatgaaagatgctttctacaaaatcccattcggatgtgttttcatgtaagaaaacgtacatttttagaaactcagttgtaaactggctgccttccgaatgaacacgacagtcccggagctgtttcccttaatgaggttctcgtcctgggcaaactttagcgctggtctttaattgtcactgaactcccgcacagtccctggggaagtgacttccttcctgtccctgctgggtggccttgagcaagccacttggcagctctgggccgcagttccgtcatctgcaaggtgaggggtgggagcggcacggcccctaggcagcgcccccacctcctgcgggtttctgcgcgtgtcctgagttttgtgggcgcctcttccctcactgaggggctcttcttctctgcagggcatggctcacgccgcgttgtcaggctgcaagccactgcgagagctgctctgatccccaagcatgctctggcctgaggaggagccatggggaggacgctgtgcctgtgtgacagaggcctgcccggcagatgccggcccgctgacttccagacgtggctgtgggtgcctcatgccccactgggctggcgtgtgaggcgtgtccagctcaggctgccctacagctgcccaggaagggtttgtgggagggggtggtcctaccctggtgagtccacggtggtctgccagccccagggaaggcttaggagccccaagacctgccctcttgtccctccctcggcagtgtctggctccggtctggtttgtgaacgggggcctgggtactctcccgccctccctgggggctgtggccttcccctgggaaggtgctggagggtttgtcagcagggccggcatgagtcatggagtggtgactggccgctgaggcatggaaggccactccttccagccaagggtcggagctttttttttgttctggaacggctttgtggcttttacaaattaagcagttttatcttgttccaagagcttgtatttcagcagggagagagtctccaagaagggaactttccactggggagctctgttgggctgggaggctaggaacaggccacgagggagggctgcaggcaggggaagtggccgtctgtgcatggtcatgaatgcaggcccggggtcctggagggggcttggccacgctgtcgctggacgtctgtccccaccagggtccatctgatgcagtacggcacagggtaaagcccagctcctcttacggggttcctgggtcatcagtgggcggggaaccgaggcctcctggagggcggtgcctcagccctcacccctccctcctgtccctcgctgtgctgtccccgatggcctctgccatcccctgggagttcttacccctggacgctcggtgcctgtccggtctcaacctctccagctctgcttttccatctccgaggtgagaggcctggcctgacgcgctctgcacccgcttcctgcccagccccgtgggaactctggtccctgtagtggtttcctggggctgccatcaccaggtgccacaaactgggtggctcaaaacaccagacatttcttctctcgccgttctggaggccagaagtccgaaatcacggcatcagcaggcctggttctttccggaggctccgagggggagcctgcttctcgcctctggcagcttctggcggctcccgaaacccttggcgttccttggctcgtggccacaccactcgacctctgcctccgttgtcacggggcctccttctgtgccctaaatctccccctgtctgtctctcatacggacagtctttctcggatttagggcccactgggtaacccaaaatggtcccatctcaagatccttaacttcataacgtctgcaaagaccctttttccaaataggccatgttcataggctctggggtggatgtaaattttaggggccacctttcatccccctgttgtccccgtgtgtctggatgcacagcatggttccatgtcccagactccttgctggacccctctggccctttggggtggcctttggccttttccactcgtttctgtgctcctggtgaggtgtcggggtcgggcttagcccctgcaggaattctggggacagcatggagccggcaactccccaccaggcgtcttcctacctgcccagagctcatggttgtgaggggtctctccttgtggttttgatttgcaattccccagtggttagtgatgttgagcatcttttcgtgtttattgctcatttgcacatattcttgcagaaatgtctgtccaagtcctttacctgtgtttgatttggatgattgttgttgctgagtgttaggagatctgtagattaatatccagatactaatcccatatctgacctatgatttgctgccattccatggattgccttctccccacgttgttagtgccctttgatatgcaatttttttttttttttttgagatggagtctgactctgttgcccaggctggagtgcagtggcatgatcttggctcactgcaacctccgcctccctggttccagcgattttcctgcctcagcctcctgagtagttgggattacaggcacccgccaccacacccagctaatttttgtatttttagtagagacggggtttcactgtgttgactaagttggtctcgaactcctgacctcaagtaatccacccgtctcggcctcccaaagtgccggagttacaggcgtgagtcaccgcacccaggctgatatgcaaatattttaaacttctatgacgttccactttatctatttgttcttctgttgcctgtgcttttggcgccatatccaagaaatcattgccaaatgcaacgtcaggaagcttttcccctgtgttttcttctaagagttttgtggttttagctcttgagtttaggtctttgatgcaagttgagttgatttttgcatgtggtgtaagggctggtccagcctcatgctctgggctcttgattcacttctcttcttttctcacgcccagctggttccgctgggtggcggggaggagtggggaagtcccgggctgggcctgcactcgatcatcccctctcaggccagccagggagtctcagctcctgcccaggacctggctggacgtgctccctaccgggaaagcctgggccgtctttctaggctgatggcagggccagcccggggcgtcctgaggcctgccctgcggacatgccccttgttctaggtggtgtggctgcccggcctgcgtgtgagaccagctgtctgtgcttcaggccatggaggctgagtgtttccagcctgtccccttgctcggctctccctctggggaagcccctgcagcccattctctgcctccgcttctgccatctgtgcctttgtctgcttcctgtttggaggtggtcatccctggggccacccctcatgatctggacacaagtctccatcctgaagccaccacccaaacccctgtgcctcaaacccctcccacccaccacatggggttccactgtgaccaactcagcagctgatgaagcttcccttggggctctcctagcaacggggagctggctttcccggaggcctggcctctccctaagtggaagtggggcgtgagggtgtcagcctttttctgctgcctggtgctctaggttggcttgtcacccctggaagcacttgccatccttatacagcaccccacacccacctccccgcctcctaccccttcttccaaggggtcatctctgcttccctccccacccaacctcacccatgtggtccgcccagcaacctttgacccccaacatgacaaaataaacctcccttgccggtcactcattcattcattcagcattgggtgctccctgtggacttggcgctggggtcccgtggaggacaaagccagacacagtccttgccctcatgggactgcacaagtgcaagaccacatcagtaaacgtgaaacacaggaagtgacaggtgtgacaaaggggaccagtggcaggacagaacctgcggttcgtaggaccaggtcaggagggctgcctcggggggacaccttcgggctgagcgcagaaggatgaggggagtaaaccaggctcaaacccagcaggcagaggcgatcgctgcaggcaaccggcaatgtgttcaaaggccctggggcgcggggggctgaggccggcagcacggcaggaagtaagactggggttgaaagagactgactgtcatgttgtgaaatatacacttggttttcatctccatttcctggcacacaactcctaaaatccttggaatctccaaagtgatgtctttttggatgctcatgattgacagaccagctggcagcttcaggatggttcccagggaagaccaggtagaatcacaaggttcagcaccaccccgcaacctccaggtaggggagaggggctgaaggttaagcagatcatcagcggccaatgattgaatcaatcatgccttcgtaatgaggcctccgtgaacactcagaaggatggggttccgggagcttctggatggttgagcatgtggaggctcctggagggtggagcgcctggggagcacatggaagctctgcgtccctcccccataccttgccctacacatctcttcccctgtatcctttgtaatatcctttataataaactagtaaattccatgagccccaggaacatgtgtaaaagaaaaaaaaaagaataaaccatagctgctgtagcaagttaatcctaccagcactggctctcatctgccgaccttacctctggcaatgcctccctctcctgggctcctgggacccctccggccccaccacccctcctgtagtggtctcgctggctgctgccctcaggttagtttatttttacccggcctgctcccaccaggggctgaggcctccctgctcactccagcttcctggcccgtctcttgctctgggcacccccccactccgaacggccagagcttctgaagccgctcgctgtgtgcccccgcctggccccatgcatcccgcacggtgctccccagggtctcccactggcaagggcattggcatagattctggggctgccttggttcaagcccaccctgactgggagcctgagggtccctgagggggtcctgaaggccagggcaggcaaggctggcatgctctgggcagtgggggctgggtatgggaggggatcgtgggtggggagattcctcttaaccagcggcccacgtttggagactgatttgggctccaggctacgccttgaaattgggacagagagtggcgcagatctcagcccggagactccctctgcctgtggacgccctcatacctccatccgtggagccaccctcctctttttttttctaaatggggaaactctgacttgaacactgaataaacaacacaccctcgaaatcagcgaagaggcactggctctgaaactttgccatgaaagcttgaaaatgctctttggaccgatttgctggaacagacgggtgtgatggggctgcggggtttcaggtggcaggaggcgtccccgtgcctagggcatcccgatgctcagagtttccccgtgcccagtgtgtccctgtatccagggcatccccatgcccagggtgtccccgtgcctagtgtgtccctgtatccagggcatccccatgcccagggtttccccgtgcccagggtgtccctgtatccagagcatccccatgcccagggtgtccccgtacccagggtgtccccgttcccagggcgtcctgtgcccagggtgtccccgtgcccagtgtgtccctgtatccagggcgtccccatgcccagggtgtccccatgcccaggcactgcctctccccactttcctaatctccctccaccaacaggtgtcagctgtgaaatgcctgctgtgtgtgtcctttggttgagttcatcttgtgctcttaagttcctgttagacacaggcaggctgctttagttcttctggcaaatgttttgttgttgttgtttgatacggggtctcactccgtcacccaggctggagtgcagtggcgccatctcgcctcactgcaacctccgcctcccaggttcaagcgattctcctgcctcagcctcccaaatagctgggatgacaggcgtccgccaccatgcctggttaatttttgtatttttagtagagatggggtttcaccatgttggtcaggctggtcccgatctcctgacctcaagtgatccacccagcttggcctcccaaagtgctgggattacaggcatgagccaccgtgcctggcccgtctggtgaatgtttattgaggcctactatgtgcagcccctctcttaggtgcttggcctgtaatgaggagcaacaaagacacagtcgctggtcgcttgttacttaacagttggaactgagaggcagtccacaaatgagcaaatccataggtggttttagatgaggactgtgaagaagctaagaacaggttgctgggggtgcatatctgtgtgtgtggcgaggggattaatggaagccctttctgagtggtgacactgagctgaagctgtaatgaccagaaggacccagccaggccaaaatccaagggaagagcaacctggcaaaggaaacagcaggtgtgaaggcccgaggctggagcctggggaaggtgggagtggctggagtgtgttttcagagacgggccatggtgacaccaatgcgacaggcagggccaggtcgtgccgggccttggaggccctggtgagggcttgattttattctcactatggtgggacctcagtgccctgtggctgctgagaatggccaggggcaggcagggaggcctgctagggaggaggctgctgcaggccctgcagctggagagggaggatcaggatctctttagagaggaagttggagagggaggatctctttgattgctggatggacccacctgcctggctgcccccgtcagcatccagcagaggccactggatgctgacaggtggccggccctgcccagccttgcactgccctgtgctgccctggtggctgccggctttaggaggagcgcttttggtgtctgagcccagtggtcctggctgtggtttggtacacttggccgtgggtgaggccaaggtggtttggatcctgggaaggttgggtacctggcagcctcaaggcaggagctggggtgttggaggaggaagcacgctcatccctcgttccttcctgtttcgtgggatgctgagtctctgggcagggacatggtgagccctggtgtgatgcacttaacacctgctggtgcccccatccccaagcaggaaccctggtgcctggtgcctgaggactgctgtccaccgtcccaccatccttcaggtttcttcccagcctctgactcggggcaaggttcagatatccagaacattcttggctggctcttggagctggggtgaggcagaacctccctcccatatttacagcaccagccaaggcttcggggtttggacaccatccctgggaggggtgagcaggacaagtgaggtctccagacttggggtggcttcggactggccaggcaggtgggtgggggctgcagtccatgcccccgctccaggcaacacagtcgagctgcagcccccgctccatccccagctggggctccctgtgctcaccttctgcttccttcctctccctcggaatggggggtggacactccaagactagcctcccagccactctccctgcctcctgcctcctctccttcgggacagacccctgtgatcgctgggtgttcctgatgctctgtcccctctgcgtcctgtgccgtgggtgagagagggcttcggggggacttccccctcttggagcacctgctgctccgggtgcctctgggggcgggcccccacctcacattgtggagctggtgtaggaaggaaggtgccgggagccagctccaattcacgtgctggctgtggccctcaaggtgtggatggcaggaggtggtgagacagggactcattgatcatgggactgacaccccctcatgttgatgtgggccctgagccataatctcaccagctcctgagttttggcgctgctcttggcgatggcgtggactcagccaggctctcgggcagcctttcctggattcttcctccgttctcccctgggcagtgtttctgttcacctggaaaggatgggtaggacttggagacaacagggattcaaagaagtcgggagtgggggcacctgtgcagctcaccctgcagaacagacaatttggttaaagcctaaagcctgctgtcaggagcctcgcttgcctctcagagagcacatggcttgaccatcacggggactgggggagaggcacaggcatgcctgtccggcagcagaagggaaccccgggcctgggcctctccattctgtggcgttgtctttcctcagagttgcactgtctccctcactgtccctgcctggccccagtgctcatgtggcttgtggccctcagtctgggcttggtctcccgcaattcaccctgcccagccccacacagcttgtccctccagctgggaatcggagctcacctggagtcccaggcagcagattcgatgcagtgatgcagggctgtcagccatgccagcaggccctgctgctcacagagggatgggtattgctgttgacaataattaaagaactacggcttcaggctgggtacagtggctcacacctgcaatcccagaactttgggaggccgaggcaggagaatcaattgaatccaggagttccagaccaggctgggcaacatagcaaggctttgtctttacaaaaaataaaaaataataataataataaaaactacagcttcagaatgattgacttcagcatgtttataaagtcaagggtcttcagtgtcctgggcctatgtcactgcgtcagagggagagaggaagaggctggggtgatgggcactggggcttatgctcctcctggaatgggtggtcttggactgtgcctgtgtgatatgtttgtcgagcgggggcggtgtccactgaggactggatgttgaggtgtgggtggggggaggttatgaagcactgggcatttcccgtgcaccagtgccccgagattgcagagaggggacccgcccagcctgggcagggaggcgggtggcagcgaggaaggggagaggaactcgggtgcagaaagcctttcctccagcaggtggcgccgcaagctctcgagagtccagctcctgcggggtttgcattttcactgaatttgtgggcagaggctgcctgggtgtagtttccgccaactgtgactgctcactgcgggcgaggggaagtggagtgcagagaatgcaccggagggcagatgaccagcccccgcacaggcacgggggtgcctccttccccgcacaggcacggggggcccgagcccttggggttcctgtcctaactgggcggggaaagggagggttggaagctgagttagggggaaagggggtggtctcctgccatctcttttattttatttttcctatttttggttgataggtttcaatcttttttacatttttccaactttttgccgtaaaacttttcaaacatagaaaagatgaaagagggctgagtgtggtggctcatgactgtaatcccagcactttgggaggttgaggtaggaggatcacttgagcccaggagttcaagaccagcccgggcaatatagtgagatcccatctctataaaggatacaaaaaattagtcaggcatggtggtgcaggcttggagtcccagctactcggaaggttgaggtgagaggattgcttgaacctgggaggttgaggctgcagtgagctgggattgtgccaatgcactccagcctgggcgacagaacaaaaccctgtctcaaaaacaaaacaaaacaaaaccacaaaaaaaaaaaccatgaaagattctaaagtaaacacccatgcacctaccacctagattccacagcaaccattttgctgtttgcttcaccacaaatccctctggccaccagcatccacgctggttttgatgcacttaaaataagctgcagaaatcagcacacaacatcctgtcaacacctcagtttgcatttcattaactagagtccggcatttgtctgtgattatttttgtttttctttgaagtaaaatgtatataccctgagatgcacaggtgtgaaacgttccgttctttgaattttaacaaaggtatccacgtgtatcccagcctgaccagaacatagaacatcactatcaccccagtaagttcctcatgcccctccaggtgcatcacagtccccaccttccccagggcaaccacaattgtgctttttttccaccacgaaataattttgccagtttgagtgtttcttagagctacccatgttgctgcaggtgccagcgatttgttctgttttattgctgagtaacgtccactgtgtgaacattctgtgggtttttagtcattctcttgttgaaagacccctggctgtttccatctggaggctcttatgagtaaacctgttacgctggttcttcttgtacaagtttttctgtgcatatgggcgttcatttattctgtagaaacacctagagtaggtatagggtaggtatacatttagttttataagaaactgccagatcttttcccaaagtggcccttccatttcacactcccaccagcaatggatacgagttctagttgctccacatcctggccaacatttggtgctgtcactctgtgaaatcttagtcattctggtgggcgtgtagtggtatcatctcattatggctttaatttgctttggcctgatgactaatgcggttgagcacattttcatgattggctcttcatatatttttcctttgtgaaatgtcttttcaaatctgttgctcattttaaaattgggttgcttgactttttcttctggatactgatcttttgtcagatacgtgttttacaaatattttattccagtctgtggcttgcctgttcattttctttcctttttcaagaacaaggtctcgctgtattgcccaagcaggtctgaaactcctgggctcaagctgtcctcctgcctctgcctccccaagagccggttttacaggcatgagccaccatgcccggcctgttcattttcttagtggtattttccaataagcaaaagtgtgtcactttaatttttatgaagtctaatttaacaaactcctttctttgtggttctctctctgtgttctttgtaagaaacctttgcctaccctgccaaattgcaaagatatttatgttttcctttagaaggcttagagttatatagcttttatgaattaacttttgcatatggtgtgaggtagagggtcagggttcattttgttgtcgttttatgtgtttattcagttgttccaaacttcatttttttttaaagcttttattttgtattttcttggtgacttatgaggtcgcacaattttccaagatccttgttggtcatttacgtattttcctttgtaaaattatctgtccacgtcttacttctttttaaaaattatgttgtttcaagatcgagtgatttctgaagccttcattttataatgcttgaaagaatgaacaccttgttccccagctacaggcttctgctctttgtcctgcagctgcacagtggggtaagacttgggttttgttttgttgctgctttgttgtttcttcatttgactgtttccccatgggtctcatttaaaaaaaaaattggccgggcacagtggctcacgcctgtaatcccagcactttgggaggccgaggcgggcagatcacgaggtcaggagatcaagaccatcctggctaacacggtgaaaccccatctctactaaaaatacaaaaaattagccgggcgtggtggcgggcgcctgtagtcccagataatcgggaggccgaggcaggaaaatggtgtgaacctgggaggcggagcttgcagtgagccgagattgcaccactgcactccagcctaggtgacagagcaagactctgtctcaaaaaaaaaaaaaaaaaaaaatgttgtttcatatgttttttatatattctggatataagtcctttatcagatatatgtatcataagtttttttttccacattgctcctttccttttggttttcttaatgatgttatttaatgagcaagagtattttgttttcataaagtccaatttatcaactttttccagtttcgatttatgatttttgtgacctatggaggaaatctttgcctacactaaggtcaaaagaagttctcctattttctagaaattttatagttgtatattctatgattccttttattttttaattttttaaatttttacattttttaacctattatagccgtcaggatgttgtatgatccattttaaatcagtttttgtatttggtttgaggtcagggttaattctcgtttttctatactcatatccagttctagcaccgtttgttgaaaagacataccttactctattgaattacctgacacctttgctaaaaatcattgactgtatatgtggccctatattagtatatgtacgtatatacatgtaggccctgtgttgactgtatgtgtggtcctatattagtatatgtacgtatatacatattggccctatgttgactgtatatgtggtcctgtattagtatatacatatcagccctatattgactgtatatgtggtcctgtattagtatatgtacatatatacatgtaggccctatgttgactgtatatgtggtcctatattagtatatgtacatttatacatgtaggccctgtgttgactgtatatgtggtcctgtattagtatatgtacatatatacatataggccccgtgttgactgtatatgtggtcctgtattagtatatgtacatatatacatgtaggccccatgttgactgtatatgtggtcctgtattagtatatgtacatatatacatataggccccgtgttgactgtatatgtggtcctgtattagtatatgtacatatatacatgtaggccccatgttgactgtatatgtggtcttgtattagtatatgtacatatatacatgtaggccctatgttgactgtatatgtagtcctatattagtatatgtacatatatacatgtaggccctatgttgactgtatatgtagtcctatattagtatatgtacatatatacatgtaggccccatgttgactgtatatgtggtcctgtattagtatatgtacatatatacatgtaggccctatgttgactgtatatgtggtcctgtattagtatatgtacatatatacatgtaggccctatgttgactgtatatgtggtcctgtattagtatatgtacatatatacatgtaggccctatgttgactgtatatgtggtcctgtattagtatatgtacatatatacatgtaggccctatgttgactgtatattatatgtggtcctgtattagtatatgtacatatatacatgtaggccccgtgttgactgtatatgtggtcctgtattagtatatgtacatatatacatgtaggccccatgttgactgtatatgtggtcctgtattagtatatgtacatatatacatgtaggtcctatgttgactgtatatgtggtcctatattagtatatgtactatatacatgtaggccctgtgttgagacactattgtgttttcttgatattttgtccattcctttgctgatgccacatcttgattaatgtggctttacagtaagtcttaatataaagtctctcaaatatctaaaatattactttgaatattctaggtcctttgagtttccttataaatttaagaagtagcttgttgatgtctacaaaaatgcagtgtgaattttggttgagattgtgttgaatctgtagatcaattaaggaagaattggcattttaacaatattgagtcttttgtatagatggtatatctccgttttaaaggtccttttgtatttcttttatttctctactgaaaaaaaatctctacagaattacattgttttgtagttttcaagaaaaagatcttgcatgccatttgttaaatttattcctaagaattttacttttggcactattttaagctgaaatagattttaaatttcatttttaattatttgctgctagtatgtaaaaatacaatagatttttgtatgtaaatcttatatcctatgatcttttccaaagtcatttattactctggtaatggttttgtaggtcttttaggatttaaatacatagttttacttctttctgatcttgatgccttgtttttttttcttgctttattgcactggttagagctgccagttcagtattgaatagtagtgattagtggacatccttgcctgtgccaaacttataatgttaactttagatttgtcatatatgacctttgtcagattgaggaaattcccttctattcttaatttgctgaaattttttaacatgaatgggtatgattttagtaaatgctttttctgcatctatggaaatgatcattgttttgtcttttattcgtttaataggataaattacaatgattgatttttgccccccgttttttttttttttttttttaaagaaacagagtctcactcttgcccaggctgtagcacagtggtgccatcgtagctcactgcagcctgaactcctggacttaagcaatcctcccacctcagcctcctaagtagcagggactataggcacatgccaccatgccaagctaatttttaatttttaaaattttttgtacagatggggtctcattgtgttgctcaggctggtctgcaattcttgagcttaagcaatactcccacctctgcctcccaaagtgctgagattacaggtgtgagccactgtgcaggcctgattttttaatattgaaccaaccttgcatttctggaagaagtccaacttgcttatgagatatcatcctttttatatattgctaaatttgatttgcccagtttttaaggatttttgcgtgttgattcatgagggatattggtgtggtattttctttgtttgttagtttgtttcggtaatgtctttgtcagcctcattttggcttcataaaattagtttggaagtgttcccttctctttgttttctgtgttttcataaggttgatgttgtttcttccttaaatgtttgatagaatccaccaagaaaaccgtctggacctagaattttctactaggaaaggtgattgtttgtttttaatcacaaattcaatttaatgtatagaaagagttattcaggtttttttacttccccttgtcttacttttggtaagttgtactttgaaggaatttgtccctttcaggtaagttgttgaatttactcatttaaagttgttcgtaatacaagcatacctagggtttgcttccagacctcggcaataaagcaaatattgcaataaagcacgtcacacaaactttttggtttcccagtacatataaaagttatgtttaggccaggcatggtggctcatgcctgtaatcctagccctttgggaggccaaggtgggcggatcatttgaggttaggagtttgagaacagcctggccaacatggtgaaacctcatctctattagaaatacaaaaattagctgggtgtggtggcacatgcctgtagtcccagctgcttgggaggctgaggtgggagaattgctcgaacctgggaggtggaggttgcggtgagctgagatcacaccactgtactccagactgggtgacagggcgagactccatctcaaaaaaaaaagaaaaaagttatgtttacactatactatagtctattaaagtgtataagatcattatgtctttttgctaaaaaatgctaataatcatctgagccttcagcaagccataatctttttcttggtagaaggtctgcctcaatgttgatggctgctgaccaggtggtggttgctgaaagttgaaggtagctgtggcagcagtttctttgtttcttttttctttttctttttttttgagacagagtcttgctctattgcccaggctggagtgcagtggcacgatttcagctcactgcaacctctgcctcccgggttcaagcaattctcctgcctcagcctcccgagtagctgggactacaggtgcctgccaccacgcctggctaatttttgtatttttagtagagacagggtttcaccttgttggccaggctggtctcaaactcctgacctcaggtgatccacctgccttggcctcccaaagtgctgggattacaggcgtgagccactgcacctggccggcagtttcttaactgaagtttttgacatgggttgactctttctttcatgaaagatttttctgtggcacgcattatgtttgatagcatcttacccacaatagagcttccttcaaaattagagtcaattctttcaaccctggccacggattgatcaaataagttgatgtaatattctaaatcttttgttgtcatttcaacaatgttcacagcatcttcgcctggagtagatcccatctccaggaaccactttgtctgctcatccataagaagcaactcctcatctgttcaagtttgatcatgggattgcagcaatccagtcccatctccaggctccacttctaattctagttctctgctatttccaccacatctgcagtgacttcctctgctgaagtcttaaaccgctcatccatgagggttggaatcaacttcttccaaactcctgttaatgttgatatttcaacctcttcttgtgaatcacaagtgttcttaatggcatctagaatggggaatcctttccagaaggttttcaatttactttgcccagatccattagaggaatcactaactatggcagatactgctttataaaatatatttcttaaataataagacttgaaaatcaaatttatcccttctccatgggctgcagaatgggtgttacattagcaggcatgaaaacaacattcatctttacatacatctccgtcagagctcttgggtcacaaggtgcattgtcaatgagcaataatattttgaaaggattcttttttcctgagcagtaggtctcaatgatttttttttttttttgatggagtctcgctgtgtcacccagaatggaatgcggtggcatgatctcggctcattgtaacctctgcctcccgggttcaagtgattcttgtgcctcagcctcctgagtagttgggattacaggcacacaccaccatgcttggctagtttttgtattttttgtagaaacagggtttcaccatgttggccaggctggtctcgaactcctgacctcaggtgatccacctgcctcagcctctcaaagcattgggactacaggcatgagccactgcaccgggccctatttgttttttttttgttgttgttttttaattgagacagagtctcgctttgttgcctagactggagtgcagcagcgctatctcagctcaccgcagcctccgcctcccaggttcaagtgattctcctgcctcagcctcctgagtagctgggactgcaggtgtgcactaccatgcctggctaatttttgtatttttaatagagatgaggtttcaccaccatgttggccaggctggtcttgaactcctgaactcaggtgatttgcctgccttggcctcccaaaatgctgggattacagctgtgagccaccgtgcttggcccttttttgtttttttgttttttttcaaattgagacagagtctccctctgttgcccaggctggagtacagtggcacgatctcggctcactgcaacctccgcctcctgggctcaagcggttctcctgcctcagcctcccaagtagctggaattacaggcgtgtgacaccatgcctgaataatttttgtatttttagtagagatgcggtttcaccatgttggccaggctggtctcgaactcctgacctcaagtgatccccccgccccggccttcaaaagtgctgggattacaggcgtgagttgccgcaccaggcctcaatgggtttttaatattcagtaaaccatgctgtaaacagatgtgctgtcaagtagggcctgttattccatttctgaagcatagacagaatagatttggcagaattcttaagggccctaggatttttggaacggtcaatgagtattggctttaacttacggtcaacagctgcgttagcctctcatgagagtcagcctgtcctttgaagctttaaagacaggcattgacttctcccctctagctatgaaaatcctagatgacatcttcttccagtagaaggtgggacatctatgctgaaattctgttgcttagtgtagccaccttcatcagtgctctgagctagatcttctgggtaacttgctgccgcttctccatcagcacctgctgcttcaccttgcacttttacattatagagatggcttctttccttaaacttcatgacctgacctctgctagcctcaaactttccttctccagcttcctcacttctcttagccttcataccattgaagagagttagggctttgccctggattaggcttttgtttaagggaatgttgtggctgatttgatcttctatccagaccactcaaactttctccatatcagcattaaggctgttttgctttcttcttcttcatgtgtgcactggaatcgcacttttaatttctttcaataactttttcttggcattcacaacttggctagctatttggcataagagatctcacttttgcctgtcttggctttcgacacgccttcctcactcagcttaatcatttctagcttttgatttaaagtgagagacgggtgactcttcctttcacttgaacacttagaggccattgtagggttattaattggcctaatttcaatattgttgagtctcagggaatagggatgcctgagcagagggagagagagcggggaacagccagtcagtggagcagtcagaacatacaacgtttattgaataagttcactgtcttatctggatgtggctcgtcatgccccaaaaacaactgcaataatggcattgaagatcactgatcactgggcgcggtggcccatgcctgtaatcccagcactttgggaggccgaggcaggtggatcacctgaggtcaggagtttgagaccagcctggccaatatggtgaaacctcgtctctactaaaaataccaaaattagccaggcgtggtggcgggtgcctgtagtcccagctactggggaagctggggcagaagagtcgcttgaacctgggaggtggaggttgcagtgagccgagatcacaccactgcactccactgcactccagcctgggcaacagagcgagactccatctcaaaaaaaaaaaaaaagggccgggcgcagtggctcacgcctgtaatcccagcactttgggaggccgaggcgggcagatcatgaggtcaggggattgagaccatcctggctaacacgatgaaaccccgtctctactaaagatacgaaaaaaatagccgggcgtggtggtgggtgcctgtagtcccagctactcgggaggctgaggcaggagaatggcgtgaacccgggaggcggagcttgcagtgagccgagatcgcgccgctgcactccagacagagcaagactctgtctcaaaaaaaaaaaaacaaagaaagaaaaaagaaaaaagagatcacagatcaccatagcagatataataataatgaaaaagtttgaactatttcaagaatcatcaaactcctacacagagacacagtgttaacatgttgttggaaaaatggtgccagcagacttacttgatgcagggctgccacgaaccttcaatttgtaaaaagtgcagtatctgtgaagcacaatgaaatgaggtgtgcctgtgttccttgtcactgtaatgtcggtaggatccgtaaggaaaacacttcattccttttattgtgactttatgttcgccatctccctctcatcagcagcctggctaggaggttatcaatctagatctttttaaagaaccagcattggactccccttttctggtgtccatttccttgagtttctctgttatcttcattacttccttccttgtacttgcttcagcgcattagtcagggcccagtcaggaaacaaaaaccacaccggcaatttgaatagcaacttgtaatataaagtgttcttaactgtaagaggtagttaactattaaagggatcacaaaggggtgacattgtgatataagaaagatgtatttgggctgggctcggtgcagtggctcatgtttgtaatcccagcactttgggaggctgaggcaggtggatcccttgagctcaggagtttgagaccagcctgggcaacatggtgaaacctcatgtctaccaaaaatacaaaaaattatcctggcgtggcggtgtgtgcctgcggttccagctacttgggaggttgaggtgagaggatagtttgagcccgggaaggcagacgttgtggtgagccgagattgcactactgcactccagcctggatgacagagggagactctgtctcaaaaatcaatgtatctgtctgtctgtctgtcttctatctatctatctatctatctatctatctatctatctatctatctagtctctgtcccccaactttgtttggcatgtagctcctaaaactcttgaaatctccaaagtgatgggtgtctttttgtttgctaaggaggcgactggtggctggaggctcctggacagcctggggataagggctggttgccaggggacccagccttgtgattagaaggctagaacttgcagcctttcccatccacctcctgcgaggcaagaggggatgaaggttgagttgatcatcaatggccaaagatttcatgtcatgcttatgtagtgaagcctccctgaaaacccaaaaggatgaggtttgtagagtttcaggttgttgaatacctgcaggtgctgggagggcagtgtaccctcccgtggaagctccatgccgcttccttcatacctttcttatgcatctcttccagttggctgttcatttgtatcctttgaaatatcatttgtaataagtcagcaattttaagtaaactgatttcctgggttctgtgagtcactcaagcaaattattgaacctgagaagggagttgtgaagacctcaaatttgtagccaagtcagacagaagttatgggtaacctggtgtcttaccacttgcgactgatctctgaagttgagggcagtcttgtgagatggaacccttaacctatgggatctgcactaactctggttggtgtcagaattgaactgaattgcaggacacccagttggggactgctgagtattggagaattgcttgggggtcggcgggaggaaaccacacatctggtgtcagagctgaagcactgagtgttgtgaatgagagtggagagatagagtttgttttgccttatgcaagaggactctaaggagtatagaaagagcaaatatgagaagcagctactttagaagaaaacataggaggaaagcttcgtgacattggagttggcaatgctttcttggatgtgacaccgaaaatacaacaaaagaaataaatgataaattggacttcaccaaaacttaaaacttttgtgcatcaaggaatactaccaatggcgtgaaaaggaaatccacagaatggaagaaagtatttgaaaatcgtatatccgataaaggactagtatccagaatatataaagaactcctacaactaagccacaaaacaaaaaaaaacaacccagtgaacagacatttttccacagaagacataccaatggccaagaagcacaggaagagatgcgcagtgtcactaatcatcagggaaatgaaaatcaaagccacaataaaatatgatttcacaccctttaaggtggctgttagccaaaacatggataacagcaagtgttggcaaggatatggagaaattggagccccgtgcactgctggtgggaatgtaaaatggtgcagctgctgtggaaaatatataacaattgctcaaaaaattaaactcagaatgaccataacatccagtgattccacttctagatgtatactccaaagaactgacagcagggacttgaacaggtgtgctacattcttgtttgtagcagcacttttcccataaccaaaagatgcaggcaacccaggtgtccaccagcggatgaatgaacagacaaaatgtggtccatctgtacagtggaatattattctgccttaaaaaggaaggagaggccaggtgtggtggctcacgcctgtaatcccagcgctttggaaggccgaggtgggcagatcacttgaggtcaggagtttgagactagcctggccagcatggcgaaaccctgtctctgctaaaaatacaaaaattagccaggcatgggggcatgtgcctgtaatcccagctactagggaggctgaggcaggagaatcgcttgaactagggaggtggaggttgcagtgagccgagaccatgccactgcactccagcctgggcgacagagcaagactgcctcaaaaaaaaaaaaaaaaaaaaaaaaaaaggagattctgacacatgctatagcatagatgagccttgaagacatgctaagtgacagaagccagacatgaaaagacaaatactgtatgatttcacttttatgaggtccctagagtagtcaaattcagagagacagaaagtgggatggaggttgccagaggctgggggaagggagaatgaatgggaagttggtgtttaatggggatagaattgcagtttgggaagatgagatggatggtggtgatggttacacaacagtgtgaatgtgcttcatgccaccaaactgcacacctgaaaatggttaaaatggtaaattttctgtgatggatactttaaggcatgtatgcaaacacacagaagcagttactaccactggggttgatggaaaagaaaccaagaactcggagcgtcctccacaccttgccacgtcttacgttcaggccttgttggagagtgtgtgactgccacagaaacctgcagcctactggtaacaaaaaggttcttgccagaaggtgtagaaagagtggatctgcaggatcagcttactgggtagccgagaaacctactagagggtatgggtgggcaggagctgggtgtctgagaagtttgctgaggtcccattgggctagagctggggtgctggagaaactcagtacagagcaggccccactgggcacacgccactggcagctgtgccttcagaggaaaaagagaccctggaaccaggaagagaagctgctacctcagcaaggcctggcagctccccacagtgttgtcccctgtggatagagcctgacatgactgtatttggccaaggagaaagactcataaggcctcggtccagtatcacggagcggggcctggcaggatgtatgcagagttaagaggcaatacatgggtaactggcatatttttccagattctttgttttttttgttgttttgttttgttttgttttgttttgttttgttttgagagagcatcctgctctgttgcccaggctggagtgcagtggcatgatctaggctcactgcaacctccacctcccgggttcaagccattctcctgcctcagccttctaagtagctggagatgcccaccatgcccagctaatttttgtatttttagtagagacagggtttcaccatgttggccaggctggtcttgaactcctgatctcaggtgatccacctgccttggcctcccaaagtgctgggattacaggcgtgagctacactgcacctggcccatttttccagattcttaaagcagatccttaggtctttttttttttttttttttttttttttttacttcttttctaatataagcacttacagtttccctctaagcactagcttcagcctacgtattttagtatgctgtgttttcattatcatttcatttgaaatattgtaaaatttttcttgtgatttcctctttgactcatgggttatttagaagtatgttgtttaatttgcaaatagtcaaggctcctctgagtatcttagagctattgatttctaatttaatcttactttggccagacaagcatattttgcatgcttttaaaatttgagacttatggcccagaatgtgtatcttggtgaatgcactgttttcacttgagaaaaaaatatgtatatatattctagacttcctgagtatagagctttataactgctgattaggtcaattgctagttaccagtgttcttcagattatctgatgcttgtttctcagatgttgagagaatggtgtttgctatggcctacctgtttgtgtcccccaaaattcatatgttggagcttaatctctggtgcagtggtgttgggaattggggcatcagggaagtattggctcatgagggcagagtcatcgtgaatgggattagtcccttctgccatgtggggacacagcaggaaaaggacatctctgaagcagggagctagctctcaccagacactgagcaccctgattttggacttcccagcctctagaactgtgagcactgcaatctgtttataaattacccagcctaaggcattttgttttaacatcctgaatgaactgaggtggtgttaaaatctccaactatgcatccaggcgcagtggctcacacctgtaatcccagcacttcaggaggccaaggcgggtggatcacctgaggtcaggagtttgagaccagcctggacaacatggtgaaaccttgtctctactaaaaatacaaaaattagctgggcgtggtggcaggctcctgtaatcccagctactcgggaggctgaggcaggagaatcgcttgaacccaggaggtggaggttgcagtgagccgagattgcaccattgtactccagcctgggcaacaagagtgaaactccgtctcaaaaaaaaaaaaaaagagtctccacctatgattgtggaattgcccatttctccctttaattctttcaggttttatatcatgtattttgaagctcctttggttaggtgcatacacatttatgattataatggtgtctcgatgaactgatcatttaaccatgatgaatgtattcctttatctcgtaataattttatcttggactcaactttattgatatttatgtagcctctccagccttcttaaacatgctgtttgggatgcataagaaggctggagaggcttatggagaaacttatgatggtttgacttacagtttttcaactttaccatggtgcgaacgtggtatgtatacagtagaaactgtactttaagtatgtgtgaaaccattgtgtttctcactttcagtacagtattcaataacttacatgagatagtcaacactttattataaaataggctttgtgtttgttgattttgctcaactgtaggctgaagtaagtgttctaatcatgttaaggtaggctaggctaagctagaatgttcggtaagttagatgtattaagtgcatttttgagatgatatttattttccacttatgatgggtttgtcaagacataactccatcatcattcaagcagcatcagtatgtctttttccaaacagaaaatttcaacctgtgtttatactgaaacagcatcttttgtagatagtatatagttgagtcttgctattttattcattctgacagcctccgccttttaattggaatattcaggctatttctgtttaacatagttatagatatgactgggtttagagctactaccttgctctttgatatttatttctttcatcttgctttcttggcttcttttatgttaattaagtattttttagaattctattttaatttatgttttttttttttttttttttttaagacagagtctcactctgttgcccaggctggagtgcaatagcatgatcttggctcactgcaacctctgcctcctgggttcaagtgattctcctgcctcagcttccctagtatactgggattacagacgcctgccaccacggccggctaatttttgtatttttagtaaagacggggtttcaccatgctggccaggctggcctcgaactcctgacctcaggcgatccgcccaccctggcctcccaaagtgctgggattacaagcgtgagccactgagcccggcctgttttgactttttaattgtatctctttgtattgctattttagtagttactttacagattctattgcacattcttagcttttcacagtctacttagaattaacattgtttttcttcatggaaaaaaagtgtaagaactaggcaatcctatgggttcatttaccactttccatcctgtatgtgatggttgttagatatttactacatccatacacattgtaaactagacaatacaataaggaaatttttgctttaaacagccccatgcattttaaagaaattaaaagtaaaacagaatcttttctatttgcccatgtatttgctatatcctgtgctcttcattccttcctgaagagctgagttcccatctggtctcatttcccatgatcttggagaacttgcttcacggtttttgtagtgcaggtttgcagacagctaattccctttcattttcacttatctgcaaatctttattttgctgtcattctttctttttttatttttatttttatttttgagacagagtctcactctgtctccccacaggctacagtgcaatggtgtgatttcaaaactcctgcccaatctcaactcaccaaccttctcctcccgggctcaaacgattctcctgcctcagcctcccaagtagctgggactacaggcatgtgccatcatacccagctaatttttgtatttttagtagagatgggatttcaccatgatggccaggctggtctcgaactcctgacctcaagtgatctgcctgctttggcctcctaaaatgctgggattataggtgtgagccactgtgcccagcctgctgtcattcttgaaccataatttcactggttatagaattctgagttgtcagttttttctttcaggactttaaaatatagggttccagtgtctttggcctccgttgtttctgtcaaggaatcagcattcatctagctattcccctgtagaccacatgttgtttttccctggatgcttttaagactttttatccaagtttgattgctcagtacctacctctgggcaaaaaagcctccagaaaccagaaacttatctagttttattcccctctgtcaggtgtagactctactccagcttctacctacttgagatattctatactgactccaggctgttgttattttgttctttcaaatattttgtccagagctataatgttttctgcagaattgaccagatagcagctactctctgtgaccaggagccttgatcttccagacttgctgatgggctcacaaagctcctgcccgtggccctcagttggcagtggcctctctgccttgaagttgccatgagtgtgtaaaacctacaggctcaaccttcctcattagtacagtccagaaaagtggaattcctggtctgggtggctatggtgccctagaccactggctagaccagggtggtgactgccagctggccgaatgtggggtctccagcctagcacccttggactctaccccaggagttatggctgtttcagggccaggggcctggcctcagcccctgtcccccttctcttctcctcaagttgcccagcatcaggtcccaaccagcatcttttgcagacagggtgggtcggctcctcactagaggggcagggttgggagggaagcctgttgagccctccttcctgtgcagcccacagccctggggttagctccagaggggtgcagaaaggagcccccaaaggcagaaactcacccttctctctgttcttgtgcttccagggataaaggagaggtggtcctagctggggggctaccagtggcatgcaggaggcccacatgaccactgtttgctggggcctttccttctctgtgagagagacgagagagaggagagagagtgtgagtcagggtagtgtcttcttccagtaacgcagacttctgcacgtgttctctaggagaaatcccgtcactcgctagagctctagatctggaagaagctctgcctctcttctctcctccagtgcagtgtgtgtgtgtgtgtgtgtgtgtgtgtccccacatgcattacacccttctacagaggaaataattcccgtccaagtgcaaaggttgggattggagcaggcagcatgtgggctaaaggagcagagaggaggaaacgggggcgggggtgagggtgggaacaggaggtgggtagatgccacgaggcatgccttccacaactagaagggctggtggagatgaccagaatgctccagacagaccttttatcaaacttccaaaattcaatcttgtttcatgaagcctgaggaccctgcagagtgaaagacaaggaagggctttcctgcaggggggtgtgtgtgcctgtgtgtgcctgtgtgctgtgtgcccccatgtgtgtgcacgtgtggacctgtgtggtgtgtgcctgcacatgtgtgcacgtgtggacctgtgtggtgtgtgctgagtgtgtatatgtgtgtgcctgtgtgctgtgtatgcacttgcacatgtgtacacagatctcattttccttttttctggcttactaagtgccagaaagaatttccgtgagcctctccacccttcccaaggctgcacatggagggacttgcgcaggcacatgtgcgcgtgcacacaacacacacacacacacacacacacacacacacacacacacacgagtcaggggcgagcactcctgtggattgtacctaggcctggcaggaaaccgggttctgggaaactgtaggccccacctttggcagaaaaccatgtttttgttgctgctcgttgaagggaacattaagtggggctggggacagtttatgttgagaagagcaaattttgcctatggcactggggacattgagtggctcctgtcccgggctctggagggcttgggagacacgtctgcagctctgggcatctctcaaggtcacgggcggccacactcaaggttaggccctcctctgtgtgagctgcggtcagcaggaaggctgacctcagaggcggccccagggcccttggaggccctgcccctgagacatgggccaaggtcagagagccgagaaggctgctgctgaggactctggttggcgcccagcccagcggcccttcaggcgggccctgtgcaggggctgatgaagtcagctgggaaatctgtgaaataaagcacaggtcccccaggcttgcccagagccccggcatcagatgaggtgcagagaagggaactgagctgccaagtgtgaacaggagagaggagccccaggaccacacaggggccccgacatggcaggtgcttggtcagcagcggtgctgcccttactgctggacgtgggaaaatgcactgacacttgctgaccagagccggggtgagcatctgggtgaccctgcagatgagacaaaataagggctgccgtgggggaggggcccttgccgggccaccctgctgaggccctgtgttactgtcctgcggctgtcataacaaaggaccacaaatgaggtgactcaaaacatccgaaatcggccacgtgcggtggctcatgcctgtaatcccagcactttgggaggccgaggcggttggatcacgaggtcaggagatcgagaccatcctggctaacatggtgaaaccccgtctctactaaaaatacaaaaaaaaaaaaaaaattagccgggcgtggtggtgggtgcctgtagtcccagctgctcaggaggctgaggcaggagaatggcatgaaccttggaggtggaggttgcagtgagccgagatcgcgccattgcactccagcctgggtgacagagcaagactccgtctcaaaaacaaaaacaaaaacaaaaacaaaaacatccgaaatgtcttccctaaagtttctggagccagaaatcccagaccgaggtgtctgaaggttcattcctcctgggggttccgagggagactgtcccatgcctttctccgagctctgcggcggccagcaacccctggtattcctcggcttgcagctcggcctaccccccacctggccttcaccctgtgtctcttcttgtgtctctgtccaaactgccctctctgttgtctttttaatttatttttagggacaggttctcattctgtcctccaggctggagtgcagtggcgtgatcatggctcactgcagcctcagcctcccaggctcaagcaatcctcccacctcagccttccaagtagctgggacacaggcgcacgccaccatgcctggctaattttttaatttttttgtagagacgagggcccaggctggtctcaaactcctgcgctcaggcaatgagactttgcctcccaaaacactgggattagagacatgagctgctgtgcccagcctacctctgtcttataaagacacctgtcattggatttagggcccactctgattcaatatgccctcaaataacccaattacatcttcaaagaccctatgtccatataaagtcacattcataggtactggggggtcaggacttgcatatgtcttttgggggaacacaattcaacccacaatgggtctcacccacagaacgaacggcctctccagggtgtgcgcaggtgggtgaggggcccaggagagggacctgcgtggcaagagggcttgtgttcacgtcagagattccagaaggagactggatggggtggctgcatggagcaaggggctacagccactgtctccaagtagttggtgggttgtctggtagaaagggagcatttattttgagttcccccaagatatgaagctagtaccaggtacctggaaggtgctagcgagtagagcttgactctttacagaaagaggtgtttttctcacaatgttcacttgaggacggtggaacaggctatttcacaaggtagtgagttccccatgcctggaagcattcaagcaggggccatgtgggagttgttcaggagtgcatagaagggacctcagaggtccctgccaataccatctttgcttgtcttattttacgacaacttgaatttcagaatgtaatgttattggggatatgtctactagaggggcctccagcatcaggccccacacactatgcatcatttttagggcagggaatgagagcaggctccattctttttggttgtctgtgaggaccaggaggcttgctgctgaggcagcttcctgtggaaacagtgtctcagccccgcaatccattcatcggagctccaacatcttaatgaaacactgtgtcagatgggttctgggcatgtgtgtgcagattgtcacaagtccatgagaatgcacacacgcacattgcatgtgtgtgcacacatgtatgcacacatgcacaagaacacgaagacccgaggcaggtatagtccgtgagacagatccctctaggctgaaagactccccacaagggtccctagaacaaggctccagcctcggcagtccctcccacttctggtgggaggatctccacagagaagaagggtcaagaagcacagctcttgatgctcacggtgtaccaagctctgctttaagcttgtgtcttattttttacttatttagcaaatctgtcgctcttgttttgtgccagatgctgttctcagcactttacaaatattgatgcatgtttgtttcatgacaaccctgtgaagtaggtagtgttaccccgttttatagatgaggaaacaggcgtagagggataaagggacttgcccaaggtctgtctctaccttacacgcacatgaacgctcactcatgcggcaggcgctagtttccctctgatgtgagtcaggccttgagctggttggggtctgggtcccactttggttgtgttttgctgtgggcaccaaggaagcttctagcagcctcatctccctggtatgacctagctccagggactggatttccccaaatgctcctgcccagcctggagcctcctttccagctgggggagggctgaacgacccctcactcttggaggctgccggagcccctcctgcctgcatgcggccgctgccgggtggacaggcctgcttgtgggttgaggctcccagcagctggggtggatcatttctcctcccaagaagctttgggagaagcagctgagggggccagcgtcctcctgaggccaattccctgcctcccccagcgcaggcgcgaagccatctttgcttgtgtgtttgccacagacagtggagggcggtgcaatcgtgacgcctgcttgttgcactttgcgtccttgaggacgttgacccctggccggtgctgggcgcttgctcttcagtcatcttgccctgacctggcgtggcaggcccgagcactgctcttttacaaggaaacaggctcagaggccttgagtcacttgcccgggctcccccagccaataattggctgagccaggatttccatccagctctgtgactccagaagtccaagttcttcccatcacgtcagggccaggaaaggattagaatgcttttctacgtgccgattatttggatgatctgtgcagcttagctcgttgtagttgctcaataaaaatgtggaatgaatgggcctatatgtcccattgtgtgactcagagccaatgactctggctgatcctcctgttttcattccgtggcccagcatctccctttggggtgtgtgaccttggaagcagtgactctctccatcccaccttgaatggtgtctgcgccgcagcaggggagcagctggggattgccagcgcctgttgctggtgggctgtgcgccagatcccgtcttggatgtgtgggtgattgtcagccacatgtgtgtgaagggctgtgcgtgtaggatttgtgcaaatgtgcccctccctgctgccagcccatgggaggctgtcaagattctgcccctgcacattagcccacactctctttgtggcccactgctgtggctgttcccttgtgtcacgtggctgcaggcacagcccccaagtggatggggatcgtgggctgaatgtgcatcagatgctcctgcttcttggtgggtggagaccctcaacccatgcaccgtggctgccgcatctgaaaggccttccatggtgaaggacttggacctgagcaaccctccgcagaggtcttagaagtgctccctggccgggcgcggtggctcacacctgtaatcccagcactttgggaggccgaggtgggcggatcacaaggtcaggagatcgagaccatcctggctaacacggtgaaaccccgtctctactaaaaatacaaaaaattagccgggcgtggtggcgggtgcctgtagtcccagctactcgggaggctgaggcaggagaatggcgtgaacccaggaggcggagcttgcagtgagccgagatcgcgtcactgcactccagcctgggcgacagagcgagactccgtctcaaaaaaaaaaaaaaaatgaagtgctcccagctcttcctcctgtggtgaggttctgagtttccatcctcagaagaaaacctggctggggagggcatctctagacccggacataaacgccaggagaccagggctgccctctcaggtgaccaatcacagagactcagggaaagtcacgtttggaagaggcgacactgtgtctcagcctcattcatttctccatcctacagacactgcctggtgcccagcccgcaccgcgaggcttcctaagcagctctgggcaccgtgcacctggcatggcctccagccccatctccctgccttgggagacccggtggggactccgggctgagctcctgtggctgtggaaccttggtggtttattgtggtggctgagaacagggacgtggggttggacgggttgagtgtaactcccagtggctccgtgaactgcctgggagccttgggcagctctttctcactctgtgcctccgcttcctgatggaaaaatgggggccaggggggagcgaccttgaaggtattcgtgggaaccaagcgaggtgataaatgtagtgtccttggtagagaactggacacagagtccacccccatgaagggggctgctcctcctccttctatgtttcctcttgttcttatttctcctcttgtatcttctcttcctgctttccctcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcccttcccctcccctccccccccacatgcaggcacactccatttggtgccccaactgcctttctccattgtccttctgtaagtggttctctaagtgggaactcaggcctggaaagggtgggcaccctgtctggtgggctctggcaggccaggcgctgagcagcctcaggagacacaaccctaggaaaaggctcatgcaggctggctgtcatgacggactgttggtgggagaggggaaggcgccgtggtaggggaagctttggaaacatccactagtggccttatttatgactcaggacacctgccaggtcactagaacacagctgaggaagctgtcggccagacgtccagaagcatcaacctggtggctgggctgtggggggacctctctggacaggcagacaaggtgtcggaggaaggggctgacactcactcagtgtctgtcatgcactgagggcacaaagggcaggatggagagctggcccacgccacctgtggaatcttccaggtgtgggggcagatggggaagcaagggggcttgaagacacatgcgctcattaaatgtccttaaatcccaagaagaagaacaaggacacatccacaggggcagggctgaaagtctgatgcatggtgttttggggtctgctcctgctgcaacagctacagtggctccctcttacctttctcttccctccattctgttgtgaaaatgttcaaaacacatggtcaagttgaaagcattttacagggaacacattcagccatcacctagattctaccactaacaccaagctacacctgctttatcacctcaccgtccatctatccctccttcgcctggccatgaatccattttatttttattttttggtgcatttcaaagtaatttcaggtcatcctgattatctctggaatcactgtcagaaattccctcccttcccctcccctctcctttcctttccttttctgagatgggatcttgctaggtcacctaggctgaagtgcggtggtgcagtcatagcacactgcagcctccaactcccgagctcaagcaatcctcctgcctcagcctcctgagtagctgggaccgcaggcatccaccaccacacccagcttcattttcaaaatttctcaccaactcctcactccttgtattcacccaggaccacttctcacaaagccagggtgctgcaggaggggtcagaaccccaagccctaatcctggctctgtcattaacactgtgcgaccctcagcaaatcattttgcctgtctaggtcctgttttcattcctatgaaacgagggcgttaaactgtatgttataaataatgagggctaccagttaccaagctcctattttaggccaggcacttttcacatgttattatgagtcctttcaatctaggtattgttctcaatggacagcttagtcaacggaagctcagagaggtggtgtaacttgccaaaagtcccactacccagtgaatgtccccacggggtctgcacccaggagtctgacacagagcccaggcctcagcacctggcgatgttttgggggtgtgagcagcccagcctactctgggcacgtgtttacttgctgttccttctgcctcatgtttgtgtttgtcccctctgaagctcagactgttattttccagttccaaataccaaaactggctaggcacggtggctcatgcctgtaatcccagcactttgggagaccaaggcgggtggatcacttgaagtcaggagttcaagaccagcctggccaacatggtaaaaccccatctctacaaaaaatacaaaaattagccagacatggtggcgtgcacctgtagtcccagctactcaaggagaacccagctacccagctactgaggcacgagaatcacttaaacctgggaggtggaggttgcagtgagccgagatcgcaccactcctctctaggctaggcaacaagtgtgagactctgtctcaaaaataataaataaataaaataaaataaaaattaaaaccaaatgccaaaaccaacccacaaaataaaccttggttaaagtagcctgttcattttgctttaactatgtatattgcaccagattctgccaggggctcagcgtataaagatgagacccctgccctgccagacaggtgggatgatggccataccttgagttagtcaaggcaccatctggctgtgtaacaaaagctaaaacatcagaggctgagcagcactcggacccacgtcccagtccaagtgtcagtcgttatgggggcccaggacagcccggacctagttcattcctttggtgcatcctcgacacacagcttccatctcttgagctgagatggttccagctcctgccgtcatgtctgcactccagccagagggaagggaagaagggagaggggaaagggcaagtgtccctctttatttttaagggcatgacctgaaagttaaacacttcagctccttcccactggccagaacccagttgtatggccgctcctgtcatcagggaggctgagcaatgtattcttcagctgggcttccctgtgcacaaccaaaacttcagttactatagaaaaaagggagctcagatattggggaaacaactagcatctgtaccacatgcactgatagctctctttgtatgaacagagctgtggcaggccctatgccagggagaaagtaagattggaaaagagcttaccaaggaggtggcatttgcactgtgcttaaggggcaagaaaaacgtcttccaatcaggagccacaaatgcttggctgaagtgctactgctctttcatcctggagctggaacagacgtcaccagtcaatcatgatggctgctgggtgcactggctaacatctataatcccagcactttgtgaggctgagggtgggaagattgcttggggccaggagtttgagaccagtttgggcaaattgcaagaccctgtctctgcaaaaaaatataaaatgtagctgagtgtggtggcacctgtagacccagccccagctactcgagaggctgagatgggaggatcgcttgggcctaggagttcgaggctgcagtgagctatgattgcaccactgcactccagcctgggtgacagagcaggacctgtctctaaaaacaataaaataaaatcaaagttttaaaatggaaaaaaaatcatgagcacataactccagatgtatcctcaagatagcaaacccgggtgggcgcagtggctcatgcctgtaatcctggcactttgggaggccaaggtgggtggatcacctgaggtcaggagtttgagactagcctggccaacagccccatctgtactacaaatacaaaattagctgggcatggtggtgggcacctgtgatcccagctacttggaaggctgaggcaggagaattgcttgaacccaggaggcggaggttgcagtgagccaagatcacaccattgcactccagcctggagaaaaaaagcaaaactctgtctcaaaaaaaaaaaaaaaaagcaaacccagggccaggtctgtagccacatggccaccttcttccctgagcatggaggcagcctcagaaacctgccccacatcacatcagtgggcagttgattgggtcagcctgccagttgaaccctatttgccacagtcattctccatagtaaggggcattctagacataccccccttcccagggaagaataagccgtagctgcctgagcgttttatccagtggtgtgcatgtcttttcccaactctgtgtttagtgatgtcctgtttgtagcttgaaatttgccacagtgggtgtgtttacaccacaggaattggcaaacactacatatcaggccttacctcctgctccctactagggtaggttgttttttttttgttgtttttgttttttgtttctttttttttttgagacggagtctcgctctgtcgcccaggctggagtggagtgatgcgatctccgctcactgcaagctccgcctccctggttcacaccattctcctgcctgagcttccagaatagctgggactacaggcgcccgccaccacacccggctaattttttgtatttttagtagagacggggtttcaccgtgttagccaggatggtctcgatctcctgacctcgcaatctgccctcctcggcctcccaaaatgctggcattatgccactgcgcccggcctagggtaggttgttagaaatgtaccagcctgccagtttcagccttgtttgtctttcatcctttttttttttttttttttttttgagacggggtctctctctgttgccccccaggctggagtgcagtggtgtgatcctggctcactgcaacctctgcctcctgggatcaagtgattctcctgcctcagcctcccaagtagctgggattacaggtgcccaccaccacgtccagctaaattttgtatttttagtagagatggggtttcaccacattggccaggctggtatcgaactccttacctaaggtgatccacccgccttggcctcccaaagtgctgggattacaggcgtgagccaccgcactgggcctctttcgttctttcttaatgaaaatcttcctgaaagatttgcctactgatgtctgtgtcaataggtactgcctgcgggacagagcctgccctccttttgaaggtctttctctgtctgggtgaccatctgcatgtcactccctgctgctcagaactaaagatgtagctatgcctggggtaggttgggaaaacctgtgggaatcacagagcttgctgtcatgctgtgttctggatacctgaagcttggcaggcaggtgggatcgagggtgggcattaggaaagtgatgtggctctataggaaggggacataggtcctgagattttaggtccccaattggacaaagctgttttttttttctggataaatgttctagcttattcataatcgagtggtcagttttcttttcttttcttttctttttttttttgagatggagtctcgctctttcgcccaggctggagtgcagtggcgctatctcggctcactgcaagctccgcctcccaggttcacgccattctcccgcctcagcctccggagtagctgggactacaggcgcctgccaccgcgtccggctaattttttgtatttttagtagagacagggtttcaccgtgttagccaggatggtctcgatctcttgacctcgtgatccgcccgcctcggcctcccaaagtgctgggattacaggcgtgagccaccgcgcccggccaagtggtcagttttctcagctgccgggtcttgcacaccttgctggctctggagaccatatgcaccatgtagaccccatttgtttcctaccctcagtgttgggggaggggccaagggcctgtcgatgtgttgacacctggccattcactggccttgaatgtccacattcacctccttgaaatcgatgccccgtatcggaggctccatgtggatttgggggcagaggcctgtactccagatggtggggtggccttcaccaatcaggcagattccctgccctgccctgccctttgggctctgtagctccagatgtgtgctcaagatctgtggccacatggatgggacaagccacagagactcagactccgtggtccctgtgaccagagtagccgtggccctgtctgggaatgttcccaccctgttgctgaaggtgagaaatttctctgtgctggagaacagctgtgctgagaagttggcccatctggcttgcaggactgctggggcaagggaggtctgctgccggtctcttccttcctcctctgactgggtgctccttgtctaggttccttgcagcaaaagaattctctaatttattttgttcccttattgagtctctactccatgaagcccacctcctaatcccagctgactggctcccacctcctcaagaggaaggccaggggcagacgaggctgaaggaggctgactcccctgtgccttcgcagtctgagctgatgctgctgtatgttcacagggctccttcagcttttaaaaaggcttcaacacgttcgtcacacgcttgtggctctcctggatgccacactaactcagtaaggcctgagttagaggctgttcctgaggctgtgaaaatagaagaagggtccagaggagaatcccttcatctgacgatcccaggaaggcttcctagaagaagcagcctctgagctgagacctgaagacagatcaggcctgagtcaggccagggagggtgtgaggggcccaccaggcagagggaacaggatagggcaggcacagaggtctggcacctggcttgtggggaagtgtgagcccctgggcatgaccaaggcggggagaagtggcgtgagaggaggcagatgtggctggcaggagatcggcggccccggccttgctgagctccactctgtatgcaccaggtgacggaggctgcccaggacggtgggcagggaagtgacaggtcacatggtcatcccaccaacagccgggagtccagcttggggggacccaagaccctggggaaggcacgagtcaggggcctgctagagccaggagctagtgggagaaggaaacagtgttgcttatgaattataaacagacactcccgcaactttctctgacgtgatacaatctcaaagtgggccacccagaggtgggaaggtgacttctggctctccaggccttgggcctgtcttttttttttttttttttttttttttgagatggagtctcactctgttgcccaggctggagtgcagtggtgtaatcttggctcactaccacctctgcctcctgcgttcaagcaatcctcctgcctcagcctcctgagtagctgggattacaggcacctgccaccacacccggctaatttttgtatttttagtagagatggtgtttcaccatgttggccaggctggtctcgaattcctgacctcaggtgatccgcccaccttggcctcccaaagtgctgggattacaggcatgagccactgtgcccagccgagcccatcttcaagttctccctggccctcagtgtttctgtattagttcacccttttggctccctgcttttaagagtctcccttaagactgtccccaagtggacaggtccccagaaccaaggagcagccttaggagtccccagttacagacactccagggggtccgtgtggccctcagcctctggcctggttccggcagccttggtcctttgtgctgtctctcacatagcctggccagagctggccaggtcccttggctgggccgagtcatcgtggccagtgactcatgcagggggagaaaagtgaggagggggaacagagtgcgagggggactgtgttaataacaaacccattaggtccctgaggtcacttcacaggagggacaaatggttcatttaggttgatctggctgccggctggcttccagagacactcagggtggggaagatttcattatctggggaaagcaataccagattgtctggaggggcccagccagcgcaccccgcgcttcctgtctgcctcccacgcagagcgttctgttcccaaggcggcaggccaagagcgcgagccgaggctcaggtgcaaagaggggtgcggcatgggggcactgcagggcacggggtgcatgcatttttatttatttttttactgagtgttagggtaatttgttaatggggtatatttggtgacataaaaccttctgtcgattcatggcagtctggaacggagtggaagcgtcccactcctggggaacccccacacacatttggctgtgaacgtcggtgcctttgcactggagcctctttggagtgtgctgggcagagcggagaggttcctcttctctcttctccatcatcctgtggaggtgtcaacatgtagccagagatggtcagtggcagtgaggagaggggggcaggaagagaccagggctgggggcttgccagcccacagttctacccctgaacacccatggcctccctgttcaggtcagcgaggctgggggcagagacgggcaggggtcccccaatgttgggcatctccccgctccctcatactctggatttgccctctggagaaagctctggagcacccagaagtcctggggctgctggctgaggtggggagcagagcccagctgtgcctggaggctccccacttccactcagcttccagggacagtctcagctgtgcaggcccaggccgctgaggctggctccagaaatttcttcacaaccaccactggatggaaaaccagttctctaaagggccccagagccagttttgtttcttcttccacaggttcccatagttagagcatcgggtctttgttagagatgcagaagagacgatgtccccagcccttatgtggttcggtctccactgtggatgttggtgatcttagtctccttctcaaaaccaagagggctgatgccccacattccaggcccccagaaagagccgccacccacccacaccgctacatcttctttccacttttctgttccggaaagagtagagtggatatgcgctcctgtagaaatccatctacagcctgactgcagatgtattttgctcccttattgagtctctgctccatgaagcctgccttgtttgtacctctttctctctctttctctctttcttccctctcttccttcccttccgttcccttcctttttctttccttcctgtcttattctttcctctttctttctttcctctctctctctttccccctttctctgtctttcctatcttttctttctctctctttcctcttttttgaacagccaaagatagaatgaatggcataggtaggtactgagctccctgtaactggaggtgttcaagtgtagggtggatgggcatttatagggcaggcattgaggaaggatctccctgggattgtggatggcaggacaggccctgtggagccttctgagcgggtgcagaagagggagggcatgttcctgctccctgcccttcccgggttgccaggccgccactcccaacctccaccctctttccttccacctgctgggccttacgggatgggcagaggcattgttagaacatggagccgcggtccacagagggccagcagggaggagagctccctggggaccacgtcgcctcagtcactgtggtgactttgaaaataaatgctttcttctctgcttgagtccctgttgttcctgctgacgtggaactagggcaggctggtgactcagccctcatccctgcactgcatcggtggcaagttgcctccagcctcagaccccacagagcagggtgccttcttcagaaaaacagtagggaggccaggacaccaagggccccagggacagcctgtttctcctggctggcacgagttctagccaagcctcctggtaccctgggggtgaggaggtaccagctgtgtgctttagtcactggctgctttgaggctgggtcggtgccaggctggccactccttcttgtcccctagtgtgactttgcagagctcccggaagggtcagagggtttttttccatcactggtgtccatgggatactgtgtccccatctcatttttgtactccagtctcagacgggtgctaggaagttggagactttagccatttcacgactgtgtcttgcggggctggagtaggaacaggagtaggaggaacgctctggtcatgggactgtgtgaagagagaaggatcaggaagaaaacatgagctatcatgtctgggttatacctcagcagagccgctggtggcctcccaggcatctgaatttactaatcacaaagctcaccaggtgtgcaaataaacaaatgctgttcaggaggcacagccagggttctgctggagagggatcatcttggaggggtcatactttccacccagtccttcagtccttctgtcctgtgtgtgtgcagcccctgaccaccaccatccctgcccccgccacttgctcccagggttccatcaggttggatgttattgcaataaaatgtagcaacagaaggtccaggcagtgctgcagtccctggtggtatcatcagagccagcaggcagcagggctggggaactccaagctgattcagtcccaagtgccggagcggggagctcggatgaggtgggggtggggaaccggggagccatggagcagagcatttgctgtgctgaaggccaggagcctccttgggagatcatgaatttagaacactaatactttgtttaaaaagtcccctgccttggagataagagctcaggccgctgtggtcaggttttgctgtaaatgttctgcacaaagcaggctggggggatcactgggaagtctggggaacagattggtcatgtgcttctttgagtgaaaccttatggttgcattgaagcggccaggcagagggtgtgatggggtgtggtagccgcacaccggctcagtcaggctgaatggggaaatgcaaactcaggtggcctgaaagagacttagtggtccacagcctggtggctgctcccagtacaggtgatgtaaagagagaaggggttccgggggcttggcccaggtggaaaccatgcactgtctgtgatcctgggcatgtcgaggctggagcaggtctgcttggtggctggcagaacgcacatgaagaatccatgtgtgttctgaacgtcccctctgcccctttgggctcatgccccatcaggagtctcccgactctgccattctgcaaaggaaactgcgctttgtcattgcacaggatcgaacaggtgtgtgtggagtccctaaagccactgtctcaaggggtctcatgggacaatgggagagttgctgtgatgtttaagactaaagtgatggctgggcgcagtggctcacgtctgtaatcccagcactttgggaggctgaggaggatggatcacttgaggccaggagttcgagactaccctggccaacacggtgaaaccccatctctactaaaaaaacaaaaattagccgggcatggtagcgggtgcctgtaatcccagctactcgggaggctgaggcaggagaattgctccgatctgggaggcggaggttgcagtgagccgagatcacgccactacactacagcccgggcgacagagtgagactgtctaaaataataataatgctaataataaataaaataataataataaaataataaaagcaaggacttgaacaaatatttgcacacccatgtttgtagcagctttactctcaattgctcaaatgtggaaggaatggatatacaaagtgtgtgtacacacagtggaatatcattcagccttcaaaaggaacggaattctgtcactacatgtgaaccttgaataatgaaccttgaagacctcatgctacgtaagcctgtctcacaaggacaaatattgtatgatttcacttatgtgaagtcaaattcatagagaaattggaatgacggttgccagcagctaggggaaggaaggatggggagttattgtttaatgaggacagagtttcagtttgggaagttggaagaagtttcggaggtggatggtgttgatgggtgtacaatgtgaatgtacttaatgtcactaacatggaaacttggttaaaatggtaaatttgtcttttttgtttttgttttttttttttttgagacggagtctcgctctgtcgcccaggctggagtgcactggcgtgatcttggctcactgtaacctccgcctcccaggttcaggcgattctcgtgcctcagcctcccagagagctgggattataggcgtttgccaccacgcccggctgatttttgtatttttagtagagacagggtttcaccatgttggccaggctggtcttgaactcctgacctcaggtgatccacccaccttggccttccaaagtgctgggattacaggcgtgagccatggtggctggccaaaaatggtaaattttatattacatatattttatcacagtaaaaatgcattgctctattagaaaaatgatagatttttacaatatgaattaaattacaagttatgaaggaaaaattaagcaaaacattaaaaaattacttataagtaattatatttaaaacaaaagataataaatacacaactttcatcacctcttaggttttttgcaacatttaactattgtctgtcctgttgcggttatgttcttgaggttgtatttgtatgatagaaacactatattcgtggtgactaaacatctcttctcagtctcacctccaatgatgtcatacagataacttgaaattggccggctgggcacgatggctcatgcctgtaatcccagcactttgggaggccaaggcaggcagatcatctgagttcaaaaccagcctggccagcagggtgaatcctcatctctagtaaaaatacaaaaattagccaggagtggtggcgggtgcctgtaatccgagctacttgggaggctgaggcaggagaatcacttgaacctgggaggtggagtttgcagtgagccaggattgccccactgcactccagaccgggtgacagagtgagaccctgtcaaaaaagaaaagaaaagaaagaaattggccaaggcaggaatattgacaccacaggaataggcaagcgctacaaatcgggaaactgagtgttgttgcttttgctggccccaggtggccggttgttgaccgttaactggcacactactggaggagggaggttcagactgattcgcagagagactagaggtagaaacgcaccatggtttggatgctgagggtgagggaaagagaggagtcaacagtggtgcccggagacttggcttgagcaactaggtggatggtagcaccgtttcctaagatgaggggctgtgggaacttgaggggctgtggaaggctctgccactgacggacccagggctcggcagctctgggaggcctactttgtgtcaggccacgcagagataagaccatctgggccctgcccttgggaagtctctgtctatgaggacacagcctgccacctaatggggtgtcccgtctggagcctcagtgttgctgggagaaagcccctcaccttccttcgctctccgagcctcttttgcttccctgccagctgagcctctccatggaggctgtgcctggaggggggtcatggatatggatgtgtgcgccaaacgctgcttcctcgtggatttcctccccactccgttcccacgctttgtaagcttcatttccccggggcctgacctgtggggtttctctccagacctgctccttcccatttccagaaaggcgtgcaggggtttcctatggctctcttccctgtccccatcccccttcccttgggacagtgatctgctggacgggtgggctacccacagggtttgtgattgcttagacatctttgctgtatgaagctttgacctcaaggcatgatgcagatgggaataaggcacgagtttctcctggctgctgtaacaactgtcgaaactgggtggcttatagcaaggggaatgtgtcctctcacagttctggaggccagaagtctgaaatcaaggtgccagcagggccagcttcctctgaagactccaggggaaaacctttctttgcctcttccagcttctggtggccccaggtgttccttggcctgtggctgcatcactccggtctctgcctctgtcttcacaaggcctttttctgtgtctctgtactttcttttctgtctcttagaaggacacagcattgaatttagggcccaccttatcttgagatccttgcctaaattctttctgcagagacccttaaacagaatcaggtcacatttgaggttccaagtgggcatatctttgttttgggggggatcaccagcccactgtaggtctcgttgtgcactgaagacgcaggcggtccctttggccaggcctgcagtcggtcttgccttcttttgtgaccgtggaagaatgcaccttgctggatgcacaggcctttatagttcttttgttcttgccaaatttcagctcagtttcctctctgctgccggcgtgcatcttctctgcccagtgccccttctgggactgtgtgtccaggccctgaggccctagaaaaggggggtggagggcctcctcactatcctgtagcaatgaggcctcattaaaatcctggagccccagactggacccagcccttagctatgatcaaaggacagctcgggatatgattaaagggctagagaaagatgatttaggctgagaaagaggaggccaaggagcaactggattgtccttgaatgtggaaaaggtaattatgacttgaagggtggtgcccagctgtttcccatctcctctgaggacaggaaaaaaaaggaaataaatgatgtacaattagagcagttggttagatacgagggtgaacttcctggctgggagtatggccaagccctgatttgggtttcctgaaagagctcggggaacctccttacctggaggtttctaggcctggtcatgtggctctgagtgattacattgaaggggcagtggctggggctggagccggtgggctctgagcacagtcacgcaggcatgcgcactttctggctgctctcctgccattgtcccttgggttcccattttggtgaggcgtgcaccctggcggcgctccccagggaactaaatatgtttgctgcactgtgcgtggagatggagaatgtacaattggctgaccctgtgctaatctggtggaactccatgccagccctgggaaagaacaattgcatgggtgtgtccacactcaccaggtgctttttagaaaaacactcgagaataatgctgtggcttaggatggctgttgtgccggacccggcatcttcccaggggggctgtgttgttgggctgagtttcttaggtactggacccccaaatccccaaatacggcgtggacaggtggcccagtaggggctggactatccgataggcccaggtgctggagttcagacaagacataccctggcctggcgtggaagatacggggtgctattaatggcagcaatggctgcatttctgaaacccgggctcccaggccgacgagggtgtgcacgcatctgaaatgtctgtggttttgcagttcccatgtccacaaactcacttggttgaaaatagttcaaaatatccaaagcatgagggagggagtgcctgcttttcttaaaaaggaaggacttgatttcatctacttaaaaagccacccaaacctagaacattttccgcaagagaccccctgccccccgcctctccagaatggctggagagtctcagcactcctgcacatttgggatatttcagagggggtggggaggggcaagtgggcagcgagcgacctcagacccaggatgagctgtcaggcgctccccggccacacattcaagggaccggagtgcagttgtagcgttgcggcctgctgcttcgggggtgggggtgttgttccatgctgtgaattctcacatggcccctgactctgggcagaggccgagggtctaagggacggggtgacagggagagcatgcaggagtgggtttctggctttccagggcgagtggaagaagcgcctctctctcttgtaggtgacagacctggggggcccttcttgaggatgagagcctgttgcttctcaagttctgtgtctaacccaggtccccaggtctaccccagcccctcggccctgcctgccttgtggatgatatagtttaagggtagagaccgctggcctggagggaaggctaggcctcaggttagggcccagaagggagggagaagcccttggggcagctccctttctgctcactcactgcctagctccttccttcacaccttccttcggaaacgtctgctcctgacaaggtctacttcctgctctcaggaggcccttattgtggaggaagggaggcgtcgcccgtccctggcttctctgacagccgtgttccatccccgccctgtgccccttctcccggacagtgccttctccagggctcacccaggagggtgcagcggtggcccccggggcggtggtcgtggtgggggtgttagctgcaggggtgccctcggtgggtgggagttggtggcctctcgctggtgccatgggactcgcatgttcgccctgcgcccctcggctcttgagcccacaggccgggatcctgcctgccagccgcgtgcgctgccgtttaacccttgcaggcgcagagcgcgcggcggcggtgacagagaactttgtttggctgcccaaatacagcctcctgcagaaggaccctgcgcccggggaaggggaggaatctcttcccctctgggcgcccgccctcctcgccatggcccggcctccacatccgcccacatctggccgcagcggggcgcccggggggaggggctgaggccgcgtctctcgccgtcccctgggcgcgggccaggcggggaggaggggggcgctccggtcgtgtgcccaggactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcgaggaggggccgtcgcccgccttcctcccccattcattcagctgagccagggggcctaggggctcctccggcggctagctctgcactgcaggagcgcgggcgcggcgccccagccagcgcgcagggcccgggccccgccgggggcgcttcctcgccgctgccctccgcgcgacccgctgcccaccagccaccatgtcggaccccgcggtcaacgcgcagctggatgggatcatttcggacttcgaaggtgggtgctgggctggctgctgcggccgcggacgtgctggagaggaccctgcgggtgggcctggcgcgggacgggggtgcgctgaggggagacgggagtgcgctgaggggagacgggacccctaatccaggcgccctcccgctgagagcgccgcgcgcccccggccccgtgcccgcgccgcctacgtgggggaccctgttaggggcacccgcgtagaccctgcgcgccctcacaggaccctgtgctcgttctgcgcactgccgcctgggtttccttccttttattgttgtttgtgtttgccaagcgacagcgacctcctcgagggctcgcgaggctgcctcggaactctccaggacgcacagtttcactctgggaaatccatcggtcccctccctttggctctccccggcggctctcgggccccgcttggacccggcaacgggatagggaggtcgttcctcacctccgactgagtggacagccgcgtcctgctcgggtggacagccctcccctcccccacgccagtttcggggccgccaagttgtgcagcccgtgggccgggagcaccgaacggacacagcccaggtcgtggcagggtctagagtgggatgtcccatggcccccatccaggcctggggatatcctcatccgcctcccagaatcgggccgtgggggacagaaggggcctgcgtgcgggcagggagagtattttggctctctcctgtcttcggggtttacaaagtgtgttgggacttgcggggctgctctgtccaagcctgggtctggcgtccgcgtctctgagcctgtgagtgcgtgcgctttcctgcgtcctcgtgactgccggtgctggggctctgcgtcctgcgtccgcgggagtaaatacagcaggcgaaggggaagctcacacaatggtctccagcgctctggggcagggcttctgaggggcgggcctgcctctgccgggacctggagcccccgcccctcggagaggctcctaggctgacttgggcagagccctctggtgggccgggagggggaaaggctgtgttgaaatgagcaaactgtccaggtgtcaggccaagctgggaggtgaccagcctgaggtcctccccgctccatggccagaaccagggctgacatctgggtgtcctgagcccagctgcccacacggcccacctggggtcagccctatctgagtgggggaggcggggcctcctgggggaccagaactttggctggacgccaagcagagtgccagtggctgttcttcagggctgggcctgaggagggtgtggggcggcgaagggacgggagggggttgtgatccagtggccactggcgctgtgcagagtgtgagctggaaacatcgtagttactttgtcagcttagtggtgaaagccctttttcaggctctatccctttgcatccctgcttcccagagggaggggaggtctgggtctgcagagctgggagggcttgctgttcccgcccccctcccccacaacacctcctcatctggacatctttgggcacatgctcatactggggtctccctaggtccactgtgttccgttgagcctcctgcagtccccgagtgaatgtgacctccctgcccctgcctctttgcaactcttccctgcgaccgctcctccaggggccttccttgtcccaaatgtccaagtggcacgacttagccggtctgaccactttccagtaagcccttatggagagaggccctgtgttgtgcagagctctcctcctgcctgcgggatcgaggtctctgctctcagttcctaacagaaagtgtcgggcccccagtgggatttctggggaagaactctcgtgtctcaacgggagccctgtggcgggaggggaggccagggtttggggttgtgttcgttgtacagctgtcaccatttgcactatgaaagttgttagtgccccttccttgggtctctgggtgtaactccacccttgcccccatgtgcctccatctggagctgcttctgcggctgtctcccaagccagttttgtgaccctgtaatttagtccaagacaatgggctcattgagaccatcctggtgcagcagttggcaatcctttggctctgggggaaggtttctcagtctcggggagtggggcctcaatctgctggttccctgtgtttatcagtctcccccttgtgtgccctgaatggttttgctgggaattctggtcttagagccatcaggtggcccgagtcgataggcgtgagagagtgtgtgtgtgcatgagtgcgcatgtgcatgggggctgacctggggtatggaaaggtggccctccctggtgcccaaggagcctggagtatagttggagggtgtgggggtgtgtatatgggagttggacaaccttgggtggacagacagacgtggggaagggatgattgaaggaggtggaggagagagtgtgattcagcccagccaggggtgatgtggacaggcagcttccgaatcagggtagagaaaagtcaccactagctagcaggggagaagtcagtatggaggaggcggaccttgagggagagtaggaattggattgcaagaggaaggagagccttctggccagcagcagccagcagcagtgggggaggctggaatgagctggctggagagggggctggggcataaggaggggcctgcctgtgaagatcatatgggccaggctgtggagggccaggcatgcccgccgggagtgcagctggtccacgggaagcatctggagtggctgggaatgggcgcaggagcagcgccgtgggagcacaggtctctttcccggggcggctcacctggtgtcttggttcctgcaaggtaggccgaaagggtggggaggaaactgccagctccttacagcgctgggatggtggccccagggttcctgaggccagcggatgtgggtgcctgtcaccatgtgggttgctgaggggcggagactccaggggccaccccaaagcaggacgagctctgagccacggcatctctgggggcagttttccaatcgagcagacgtctaggcctggaatcctgtaacagaggccacagggccctgatcagggtgttctgggaggcttagaactagtggcagtatacagggtagacggcaagtgacctggcatggggaaagaggcaggtgcccaggccggcacagcacacccgtaaggaacaggtagacgggaagccgtccgtgggcctgtgtgtgtgctcggagttaaaattctgccaatgtcccatgtcctgggcacatctaccccctccctggggagcacctttctcttcaccttttccttccccgcctgtccccttcacccagggccttccccatccctcccgtcttggggaccgagggcaccatggctttatgttccatcaccgatgagttgcacagggattcagtccttccgctgttcaggccgggtccttcaggctcagggttcccaggaatggagagggtatcagtgtcttccatggactcaaacttcccgcatcccgcctttgctcccccttcaagataggtctccgagcttcaaggtcttagggctctgtggaggccgccacgtagcagcaaggagaatgttttgtatttggctgatgagatttttagagtctcattttctacttttccactgtacaaacgggcctccaggcgactgcagcacccgccactgcccgtaatagggtgacaagagggatgaccctttcctctttctcccttctggttggtggaggcacggggctggcggacggcatgtgctttcgtgaattcaggccaaatctgttatcgcaaacacgattacaactcgggtctttgtgtaacaaaagcctttccaagtaccagctgttggcctgctttgctcagcggtgtttgctgtaaccagatttgcacaccgagaaagaatccaaaagtccttgatgtttgttgaaacaatctggcccaggacccacgtgctcagatcccagagctgtgtggcatctgagcttctcccgagcccccactgtcgcccgaggaggacccccagatctgtgttctggaggcagagcaggctgtgggacgggcttctgggtgggaaggaccatgtggatatgccttcttgtctgagagtcccaacacctccgggacgtgggagctggcgcgctggcaggattcaggtgcctctttcctctctagagaaaaaggccccgttgcttggtaataggtgcagacctgtccctaattaatgccagtaggcctcttgcgtgatgaaccctgcctttcagccaagactcaaggcatcctgtgaatactgcctctctgcagtttgagcttttgtggtgggaggcaggagccatggggagtgggggcaggcctcttacacgggtcccacagccactggcagcactgacttgatgctctttgagttcagagcccagggccagacagacccactgtcccgactacgagttggttcatttagaggggggcggacacagcacccaggcagcagatgcactgtgatcagccttgcagcggggctgtgggttctctgggctggatgtccgggaagaggcaggtggaggtaaacgccaggacacccctgcagtgactgggtgactgcaggctggaaatgctttctgtgggctgtggctgtccaggaaggttttgaatggggctagtggacagagtttgcatccagaggggcagtgctttggaggagtgaggggtatggcagtgtagggatgcccaggccgccctcactctgccattggaaagctgggcggcttcggtttcttcagtttcttcgcctgtttccctgcctgcaaagtggggttagaaacagctctctttgagggttgctgggggactctgagatgcagcccatggcgctgagcacgggtcctgcctcctacgggtgtggtgggtgtcgcggctggtgtggcatctgggcgggaaaagggggcatttgcaaaggacaggtaggtttggatgcttaaatatgcagatctggggatgggaggtctcaggcaagggcctgtgtgatgccactgtatgaatgaggccggacagcatggtcaccactaattatggaaagcacggcagacactagtgccagtagcgcccgcctgggggtccctctgagcccgacaggtactcaggctcccagtgcagccatgggaccccccttttcctgcctggctgacattctggaggctggcgtcatgttggctgcaggttcctcttactgggaggttgtcctggtcttccctgccaccatctacccccacccccaccctggagtgtcacagatgggtggaccatatgcccatctgcagggccaagcgctgacaatgaggtgagcacttgctggatgaccggaccatgaggacagcgggggcgctggcagcctgcgttcggctctgcaggctggcctttccctgaaaagcggttgtggcagagtgtgcatcccagggagtggtgcctgctgccctgaacattctcatccagcaggcctctgcaagggcccagtcaagtgtggtgcagagctgggctggcagctggaacagtctcatcttgtctagtggtgagaccaagggctgatgggccaaggctgcgtgctgcttgcccagcccgtggacccatccactgagcacccccatacccctacactgggcccggggtgtcaggaggtggaggggggactgggtgcctggaaaaacaagcccaccgagagcctgagcccccaggggtcagtatcaggcagtcaccacggtgcccggtacacagtggccacctggtctcgtcggctgtcttggtggtggagagcgtgcatggtggccgtacgtgatgggcatcacccagggtaatacagatatgcagactgtgcatttgtctgtaggagccagggacttctcagcctggcaacctgtgacctctgcctacccgttgggagagaggtgctgttccctgatagcctggtgccgggagagcagaactagggtctcctcctcctttctccacctcccatttcttacatgcccaggcatcaggggaggtcacactcagggatgagtcttggccactgggttcagggcctcactgttgccatctcttccctttgccagccagccaaatgcccgtccatcatcgtgccggggatggggctggcctgctcctctgaagtctccttggtgtatagcctaggctggagccccggacgattccgccaccccctcccccgactttttctttttattttgattcatcccagaaacccagccaaaaaccaagttcctgtgctctcccttgacaaagccactgaggaaaaatggtcaaacactgcctttctttccaaagccctcttggtttttcccaaatttggaggctctgagttgcttatgagaccaaagggtccggaactctctggaacacagtcccagaagtgggaggatttgtcatctctccagccaaacagacccaccagttggcccctagacacccccaggcgcctggggcatttctgggctcaggctgtttaatttggtctgcagagccccgaggctccgtttagactgggccagcagacagttctagagacttcaagtttgttgtcgtttttaaaagtcctgccaatgcccagaaacttagagggacaagaagatgacctcgatgtcagccgggaccataaacagtgaggcccgccccccccccccgcatgcccgcctccccctccatgcccgcctccccctccatgcccgctcccccccatgcccgcccccccccaccccatgcctgcctccactgctcccgtagctgggtctccaggggattgcccgtggccatgggggaggccgggaatgcggggctcagactctactgggcttcttgtatttttttgtttttccttgtccatcttctttctcggaaatttctgaatatccccctacagcctttggcattctgtcactcctggcatctctgggccaactgggaaagccatcatttgtccaatatccagaaaatcaaggggcctggccttaaatacattgcagtgccctcctccccacatggcatcgaatttcctgtgtcctcaaagccaggagcctgtgccttggatgtgggcgatggagccttgcagacacctggagcggctttcctgggagagtctccctcgccttcccatccacccgcttcccctcccctgccccaagctctggtcacagcctcggaggggtcatctgagtgtaggttgcctccaggtgtacagttggaggggggcagttaccccacatccccctgtctgctaggggcacccccagggactcaggtcttgagggacagcggaagggtggggtggggagtaggccgttgtctcgtgccacctgggtgttatgtagactctgaatgggcagttcctgggagctggtttttccttctcaccccttctacagtgctgcccctctgaggggctggagctctctggagccctttgcagcctgtggcaggtctttctgattctgtgcctggtttcgcagcctccaacccatagccagtggcatgaagaacattcctggctgtctctacctgtggcctttgcaggcagcagttccctggggcagggcctgggggtcctggcacctccttgtgggaccccttgggtatgagggagggagccacctgggccacagatagacccccttcctgtatccaggaggttcaggatggacctgtctcatctttctttttggtgggaagagagcattcctggccatggggaatgtggcctggacagagccacctagcctctcccctcccccaggcagggccctgaaagatggagatggctctgctcctgccaggtcaacagccagcagtctggtggatttccatgcagtccaggcaggatctccttctgtccccaccccccaccccatgtgcaggaagctggttccaagcagggacccttggccccgctttccacgtgggtgggcagtttccctgcgaggggcaggccaggcccctgccctatgtcccccagagaccgatgttatctacagtaagagcatacaagtctttttggctccaaaccaggcctggaggggtggtcttctcctctgtcctctgcctcttgccccccattaaaggtcagggaatggagtgctctgtatgtttgctggggttgggttttttcctttggtttaaaatgaagggctggaatccctggtgcagactgcacggtgagaggtgctccttgggatccactcgaggagcattactgctgaatgccctgccaggccaggagcatcgctgggggtgggagaggcagttggcttatttgtttatccaacagccatccatgggtaccccaagggccagctctgttctaggcactgggggtctaggcatgggctcaggagaaggggtagaacgggagggcttcctggaggaaggcttcctaaccagagaccggggtaggagtttgccaggcaggtgatgctggccagcttctcttgccattttccttttctttttttctttttctttctttctttttttttgagacagagtttcgctcttgttgcccaggctgcagtgcagtggcgtgatctcggctcactgcatcctccgcctcctgggttcaagcgattctcctgcctcagcctcctgagtagctgagactccaggcacgcaccaccacgcccagctaattttttgtatttttagtagagacaaggtttcatcctgttggccaggctggtctcaaactccttacctcaggtgatccgcccaccttggcttcccaaagtgctgggattacaggtgtgagccactgcgctcggccttctcttgccatttctgcagactcatagtgtgtgtggaagactgtatgtctgtgcctggcacagctgccctcggcactcaggtgggaggtgggggagagggctgttggtgccagcacaggtcatggcatgagacaggctcccgcagccaagcggggtgcaccgcagcattggaggggccctgctgcgcacgagatccaggctctgcatctgtcctcctccccaggaggcctggagggctgggagggaccagggtggtgaaataacccaggtgggagagaggcactgttggagaggcagagggagctgcaggtttgtagcagcgagctttaaaccctgggcctccaccagaaaacctcagaaagggctgctttgcttttttttctaaactacaaaagaaacccttggccgcctgggccccttggggtcgggtgggggaggagatccttcattcgcacctttgcaggcccagtactgtgcagagggaggagggtggaggcaaaggcgagggaggagggtggaagcaaaggcggggtccctccctagcccccctgccctgcctggttgctgctctcagacccctactcctggcccggaaacatggaatcttgggacagctggggtagggggcacagaacggagaccctggtgagggaggaactctttctccagccctggctgtggccacagcaaggccaggctgggaggacctcactcaaatatttacatctctcctaatatttaaatgatgaagcaggctcctgcacacagctgccctggagccagctgttgcctgccctaccctccctctctccctccctctttctttccctccctctttctctccctccctccttctctccctccctccttccctgcattctttgtctctgacccaagtccaggcccttccagctgttctctccttacccacaggcacctcctgtgactgagcttctccttgttatttttcataaccatttcctttaattgagcacctcctaggtgccaggccctgggctggtactttgtatacaaggtgtcttttaatccccacgagagcccaacaaggtagattgggctgctgaggctccagcgctggaaggccggcccgggtcctcccagtccgcacctgcatccatccatcactcccccactgtggagacctgttccctggcccctggctgagcacgatggaaatctctgtctactagtccttggagagtggggatggctgagggtcccgaccctggggtctgacgggggctgcctctgccccacttcagcctggctgctcttccactcaatgactgagtttgcaaaaccagaataacagtgctacctggctggtactttgggtggctgggaggcgtgggagagggtgcacggaggggctgagcgaggtgtcagcatcgtggggatctccgagggtagccttcccaggcccagggcggagtgtaggcagagggcgcgatggcccagcgtgccggctcacatctggccttgcccttgcccacacggcaatgtgggggagtcatcagcctctcagtgcctcagtttcccatctgtgcaatggggacaagagtaaatcactgtcttcaggtatggtaagcactcatacacattgactattgcagaatgaacacagtgagcccttcttaggcttctactacatgccaggcagggtgccaggccctagtggagaggggacaatgatgggcaagctggctcctgccctcaagggctgtcgagcagggaggaaggcgccggctgccctgactgtgacccggagtggggtgattcgcaaagaggctggcgggaggctggctgggggctggctgggggctgctccctctcctgcctgtgttccgtggcagggtattaaactggcttttttcatggatttccgaggccctgactgtgggacctcgggcaggttttgggaccttgtgactttgttcccgcttgtcattcaggcctttgtcctcagcagtgcccagcacacggcgacttctgcatgtccttcagtgtgtgactgaccctggagctgagacttggcagctgaggctggacattgtccttggataactcccggggaggtgggggcagggtggggctgtgagctggcaactccgagtccctagcagcctccgaatggaggctttcctcttgtaggattctcggggaggaaggaggggatgggggagatgaggcttgtgagtcttcaggagggcagaggttcacacctgcagcgccccagaaacactccggggtgcccaggcttacccagccctcctgagccagaaccaccaagagttggggaccagcagtccattttttagcaagatccagaaatgattctcctgaacagtccgagccaagaatgacatatctggaatcagaacatcagaactacagaggaatcgagagaacgggcccaaaatgtgtagggacctcagccacatggcgccacatggaggaaagcacccaacatcatcactgtatgaacctgtttaaacacacacacacacacacacacacacacacacacacacacacacactccccagtaaagagtggaaagacatttgtcagaatattgatggaagttacctgggttgtgggtttatagattttttccctttgtttttgtgcattttgcaaattttcggctttgtgcctaaattccttttacagtcaggaacaaagcaatagatgttattttttaaagttcatgggctcgtgcccgtaatcccaacactctgggaggctgaggcaggaggattccttaagcccaggagtttgagaccagcctgggcaacatagggagacccccacctttttttttttttttttttgacagagtttcactgtgtcccaggctgaagtggcggtggcacgttcttggttcactgcaacctctgcctcccaggttcaggtgattctcatgcctcagcctcctgagtagctggattacagacactcatatttgtaggatttgagaatcctacaagaggaaagcctccattcggaggctgctggggacttggagttgccagctcacatattttttagtagagacagggtttcaccatgttgaccaggctggtctcaaactcctgtcctcaagtgatccatccatctcggcctcccaaggttccaggattacaggcgtgagccactgcgcccggccatgggagaccccctcttaaaacaagaataaaaataaaaataaataaaagtttactgtcaaaaagaaaaacacatcacccaacctaatctccccctaggattgagagatgaggaagcagaggccggaaagtgtcacattccctggtcgctggcagtcaggggacctgaggcctgggctggttttctcgtgctccaggcctggggtgtcaggtggagcccctgctttgcccaaaggtctaggtgcctctgccagcactgcttgcttctgcatttttggccacaaggaatgtgggccaaaggcagggtccttgacctctgcccaggagggtgaagtgggctggtcctccttgtccctgctccaaggcccctgcggctgtgcctttggaaattgctggcccgagctagtgtgcggagctgggacagacctcaccgtggccctcgtggggtcattccatgtccgggctggaagggatctttcggtccagcccttcctgttcctcatcaggaaactgagaccagagaggtcatctgcctggcccggggtggggtgtagatggcgcttgtgactcctgcatgccacgtgcagacagtccctcagctgtgggcttcccacgcaagcagccatgctggggataacttggctgaaacctgcgatttaatgaagagaagaatgactcctcctgcagccctgtgccccacaggctccctcctgcccccacccctcctgcagaggggcctcatgctggtgggtgggtccctgttgctgcaatgggcccaggcagtttctgggcagtggaggcttggctgtcttcctgcccaatgtcccctgtagcccacgctgtccgggaagggcggggaagcactcagccactggggacttcacaagatgggtatctgggagatgctgattggcaggccaggctcccgtggcccacaggcaggtcagaggtcacagtgctgagctgggctgagttggcagctcagggcagtgggggtgggggtaccttgctcagccatgggcctctctggcacaagggtttggagtttactgtaaacaactccttcagtttttccttctctcataggccaccagcagaattgaggggccctctgttgatgaggtgtggcctgggaggggctagttgtctgtccacctgatccttgcggacaggtgaccacaggcttcctgccccagggggctgggggaaagatcggggaggcctctctggcttccccacttggaaggaaaatacgggcataggggagacactttacagggacacatttcagccagtaccctctggctgtgctgggggcacagtgcctgccctgcccacaagaggggtcagttctctccaggatttaacttcagccttcagtgcagggcagatgagcactcagaggcccagaggactcatatcacgagagagaagctgtgaccgcacaggcactgaaggttaaacagaagagtgggacacacgggtgacctgaaagtcccagggtcagtgtggttagccccagatagctggggagctttgggtaccaggcttagcaggggaggagggcccccgtgacagtttgctggggctgctgcaacaaagccccacgaactttgggggctgaagatggttctagaggccagaagtccaaaatcaaggtgtcgaccaggctgatcctttggggcctctgcgggaggctccggcccaggcctctctcccagcttctggtggctcccgggtgctcctgggcatgtagatgcgtcacgccactccctgctccgtcttcacatggccttttctctgtgtctctgtgtctcgtaaggatgcttgtcattgcatttagagcccaccctaaatccaggatactctcctcttgagatcctttattgcatctgcaaagaccctattccaactcctgtcacattcacaggtccgagggctagggctctggcatgtcttttgggggtcactattcagtccactgcggcagctgatcttaggggaagcagaatgttctaagcttggggtgagcggagggaacgctgctgggtggggagtgggagaccaggctcggagacaccgcggatctcctctgtctgatgagggcgtgatgaggttctcatctcaggtcctctgaatggcggctgcttctgaggagaccctttcccctggatctgcccctccagaaacctccacttaggtccaggtcccaaggtggatggtaagaggcggctgtccctgccacacttgatgggtgagtgtgtgaacggggctgggagcaggacacttgtcacttctgtggacagattccagaggctcatgaatctgctgctggggaaggtgcctgatctagcctgaccctccacccccacctcccccttcccgccccccttcaccagccctgttcccagagcttcacttccccaaaggcaggcgccgtttcctggacttctcagcagctaccccctaccccagacccctctcttgtaggcccctctggtctcagcgcctactcctccctgggcttctgcccctctaccgtgaggcttctgggcagaagtgtggggccccctcgctgtgtctggctctcgcggtataccaggggtcctcccaggggcccgccctgcccgctaggtttccagggagcttttcaagttcttagatgggcttgatggagtttcccaatgcgttgtctcagagcaggaggggccccggctgagtccgagagtcccctcagtcacaccctgggctgtttggggcagccaggcagcccgtcttctggaggtgctgcctctctctggttaccccttctggaatcttctgcgtccagttgcggcccctcctacacagcacacccaccacccccttttacctgtgactcttctttgtcaacctcttcatgtctttgagaatggagaccaggtcctcctcaccctggagttcagcagaacctaaaccaggcagatccgtgtaggttcacgtgggggctctgtggccactgtggctctgccgtcacctccagcccagcttggcgcgctttggatcatgtcattcagtgccggtcctccaaacctctcccctggctctgcaggcctgggaagcagctggctcctgggtgcagctgtgaccggagcctgaactctgctccctggggtcaccgtcccctgtaattaggctgcagctcatattggctcgggcagaggccatcggctgcccgccttggggccacaacacagagagccccgtgattaatggaggctccacctgggccaagtggcccctggtgttaggcgcttttttttttttttttttttttttgcattttttaagtgcttgtaacatttcccctaatggacaatgagacgaggagggagggaggggtggcttctctgcccaggcagatcaggaatggtcaccgcctgtgtgtgcagtgacaggtctgggaacagacaagggagagcttgtccgggaggctggaccctcacaccgatgctgcctgtgcctggcagctctgtcccgggcctcagaacagacactgaccaacacgctcctcagggtctccaggtccgggtcctggtccccggcagagcttcccatccatgggaagaagcaccgagcagccttgctggctcctcgcagggagctgggatgcatttctaagagcagcatgcgtgaagcccggggtctgggcaaaggagtgtttggggaagagtctgctgttgttggagggtcggaagtagaggggaaggaggggcacgcggtaggctgaggaggtggctggcgaccctgtggtggggacgagggggctatgagcagaccaggagccagcatcacgtttctctgtctccagaatcgaggacggagagctgccagagaggccctggcggggtgtctggggccacctaaagggcgtgggtggattaaagctgaggaaagcctcattttgggggactccgtacttaacctttgaggccctcagagctgcagcctgtggtttttcgaagtcaatcacctcccagggcctcgctcctgccttcagcgacagccatttatcagggagtctttgacccaaggagacctgaaaggtcatctggtccctctcctacccccaggcaggccacacctagaccctcccacacagatccgtcccacccttctgctgccttccaccagggacggagggtgggcggccctcccacccaggccctggcggccccaccccagccaggaaattcttcctctttatctgcctcacatctcttcccctgcggcttccgcccatttcccctcaatctgctcctagtggagcagccagcagctggtttagaacccgggggtggggggagcgctagaccagtgcagcacatctgagagtgtgccagaggtgctcccattcccatagctgatttagtaaagaaaagaggaagtccagcaacttagcgccactttaaagtccgcctggaatgaccctgtggctgccggaaccaggggcacgcggtagatgacgggagcaggcacagagaggccttcgtcccggatcagtcgctgttgccctcttggaggctgggctgcctttcaagaagaggacccaaggccctgtgagcggtggcctcctctggagcctttactgtggtcctggttctgctctgcgtaaagagagatggcttgaagcagaagctgctacgtggctgtcccaggcaggcgcccgtagtcccagctactcgggaggcggaggcaggagaatggcatgaacccgggaggcggagcttgcagtgagcagagatggcaccactgcaccgcagcctgggcgacagagcaagactccgtcttaaaaaaaaaaaaaaaaaaaaggagtagagaaatctttcccagaaggcctgcagtcacctccccttcatgtttcagaggtaaaaaaaaaaaaaactgcacatttcgctttttttttttttttttgagacggagtctcgctctgtcgcccaggctggagtgcaggggcgcgatctcggctcgctgcaagctccgcctcccgggttcacgccattctcctgcctcagcctcccgagtagctgggactacaggcgcccgccaccacgcccggctaattttttgtgtttttagtagagacggggtttcactgtgttagccaggatggtctcgatctcctgacctcgtgatctgcccgcctctgcctcccaaagtgctgggattacaggcgtgagccgccgcgcccggccacacgtttctgttcttgaacaggtggctccctgaccctgggtgtggttactccaagaccttgctctggtggggcacgattctggccccaggtagggcgaccgtataacttactgtcccttgggggacacgttagtgaaagggacccttgaatgactacggtgggacaacagatgtgagctgggtttgtcccaggaaggctggatgtatgggcctcttgagccagaggagacaacagcagaaagctctgcggctgatgggaccgagcaggagaagggccggcggaggctggggcaacaacgcacttgcccactgtgaagggcctgtgtgagctgatggctgatgagagggcagtggggcgaggctgcctcctgccaggctagaccagctccaggacacccatatctccttttcagaaccggtgactcagtggctagaaggggcttcagaattgacgggacactgagggagtcgaatggaatggctggagtggccacagcaggctctaggcctcctcccgtttcttttctgtgttctgttcctggggtctatatcctggggttgctgtaacagagtgccacaacctgggggcttacaaacatagcttccggcggctcctggagattcctggcgttccttggcctgcagacgcatcaccatcatctctgatctctggcccctgtctccacgtggctttctccccctgtctgtgtgtctttctccttttctgtcttttataaagatgctcaccattggatttagggcccactaaattcagaatgatctcaccttgagacccttaccttaattacatctgcaaagatccgttttccaaatgtgatcatgttcgcaggttccaggagttaggacttaagacatatcgttttgggggacactgttgaacccactacatttaataaacccagagttggtgccaatgtcccctgcggacaccatagcagattctggaggttccttgtaaaggaatccgtaggacttcttttcccttctggagggatgagactgtagctgggctggggaaagctgctggttcaagctggggctggttcagctggtgctggcttgccaggttgttagagagctttatccagggagaaattaacatcacaaagttgggggataagagaaggtttggaatcccaagggctggctgttgaggtcagctgcccacccctttgtgttccatcttacagggacccaggcctgccagtgctccgtttctggaaggaatgctgtgggctgctgtgccccataggcagggtggagggtccccttgcagccagcgagctgctcttcctgtagcgtgcagagggaaggaggaggcttgtttatttctcttggcctcagccgaaaatccaaccacaggctctggcactaggcagacctgctcattctcacatcatcattgcagagtgagccaggcctcttgggtggggctgtgatgagcaggaaggacctccggagtgcctgggacttcttgggcccagggttgccagaggcagagagaaagaagcctcctcctaacacttgagcaaagatagtcatcagaatccatcagagtggcctcctgtggctcttccctgggtgctgacccccctggtgcatttgaagttttcagggatactattgacgctccctgcacctccatccaggggttagtggaaatggttcttttcctccttgtccagaggtactgtggatgatgaccccaggtcccagacctcagtcattgggccacgtgtgcagataagcctgggcagtcagtaacctttggccaccaagctggcctcctgcggactgggccggcactggaggcgggtcttagctgctagcactgtggcccagccaggcctggccttgggaaggcagagggggaggggactgggaaagggattgagctgggggtggggtggtaccctggttcttccctcccagacctttggcaggtttgaactatctggctgcggctctctaaggagggagcgcctcctccgccttgatgtggactttgccttctgttcacgttgtccctgtccctaaacaaatgtggctctctgtggggagcctgggggccgccctccactgacactgctgtttcctggcttccctttgcaggctccgctcagcttcactgcgcctatttttaagcctttccttttggacggttttgcttcctgagaacacacccctccccatcaccccaactgtgtcctcctccctatccggagcctgctccacctgccccaggagccacctccctcctccaccaagcagcccaggccaattctggagggctaatttgtgtccctccagaagcaggtcctgagacagggatttcagtgggaggggacaccaggggatgcctgagtgtgggaatgggccaggcagggaatccagccaataaagggtgcctcaccagctcattgtgaccacaggtggctgcccagcccccataccgggcagcatggggagactgcagaccgtgcccccagccttgtcccacctggggttgggtaagggagctggggtttttatacttcagttcttggccaaggactgcactgctcactccttccagccttccgagggcttgggcactaggaaaggctctgggtggagacacggaaataggccatgtgaagtcagtgggcgtgattggtagcagtaaggccaggacagccttggtcaccagcaaggtgaccacacatttcagcatgcacagcccccacagacacacacccaggagatggtaattacaccagcaacagtcacccctgccgcgtgccatgcctgcacccagggaatcttattttttatttatttatttatttttatttgagatggagttgcgctcttgttgcccaggatagagtgcaatggcacaatctcggctcaccacaacctccgcctcctgggttcaagctattctgcctcagcctcccgagtagctgggattacaggcatgcaccaccacgcctgactatttttgtatttttagtagagatggggtttctccattttggtcaggctggtctcgaactcctgacctcaggtgatccacccacctcagcctcccaaagtgttaggattacaggcatgagccaccgcgcctggcctcaggggcaccttattaccccatcacctcctacagcaggtgacactgaggacactgaggctcagagtagactgtggttatgtcactctcctgtttggttctcctgctctcagccctgaaataaagagcacggtccctgtgcaggcccatacgtcctgtctccagccctggagcagtccttaagctccttgaaggcacaccaggcctttgggcctcgtcccccaagtcctggataaataggaggtgaaggagcctttgcaactggaccccactctgccagcgccaaggccctgcctgactacccaccccaccctacacagatcagggacctgtgccaaggtccagtgtcacaggagagtgaagacaaggaggtgcccatggcgtacatgctgctggactcactctgtagatcctaagggttatggggagttatctgccaggtgaggttttcccgtggctttttcctgcaggctcagggtagcatacagggaggtgcttccctactccttggcaccatctgtccggcttccctgagccctgaccctggctcctagatagccagtgtttcttcagggacagaacctgctttgctgctgctcagaggagacccagtttgaccagggctagcgttcctggaacctgagcctggaattccaccctgccctgggcagaggccacgttgctccctcctacgagagctgagctgcgcatgagattattctgaccttgggctctaccatttctttgcatgacatttgtcccaggctggagcagggctctgtggctcgcttggtgttccctccccagactgaggcctgatatgtacaccaggaagtgcttgatctggtttcaggagctgggagcggtttgccaggcagcctgtggtcagagcaggggccttaacaatggtcccttgtgcggcacattcctctctaaacaggcccaggtccaggctgctcctgtttcgaccccgccatgggcctggaggggaaagtttgcatctggagggtggcccactgtggcctctttttgtgtagcagctgagaccgtaggtgcttgagaataggagaagccctgtgcccatcctgggctgtgagatgtttttccagaggtggggatggggatgggccagcatgcagttacccacaccctccagcttgttggcatcaaggtctgtgtatgtgtgtgtttttttttttttaattttgtttttccaacatggagtcttgccatttgcccaggctggtctcggactcctggctcaagcgatcctctagcctcaggttcccaaagtgctgggattataggtgtgagccaccatgcccagccagtaccaaggtgtgttttttaagagcaatattggccgggtgcagtggctcacgcctgtaatcgcagcactttgggaggccgaggcaggcggatcatgaggtcagcagattgagaccatcctggctaacacggtgaaatcgtgtctctactaaaaatacaaaaaaattagccagacgtggtggccgggcacctgtagtcccagctactcgggaggctgaggcaggagaatggcgtgaacctgggaggtggagcttgcggtgagccgagattgcgccactgcactccagtctgggcgacagagcgagactgtctcaaaaaaaaaaaaaaaaaagaacaatatcgatggttttattccctgaacatgctaagtgatccccatgtagtataagcatctcagaaggcaggaaaatgtaatgaacaacacccaccgccattcattccatccagagatcgttattttctgcccgggtgtgagtgtgtgtgtgcgtgcaaactgcacatgtgtgtatgaaatggaattaggatctttgtatacatcttgtgtcctgctatttttacttaatattctcggcatttctcatcttcaaaaatgtgattttaatgatggtgcaggcctttgacatatgggtttagaaaatctgcggaaacccggactgtttccaggttttgtcagtttaatgctgatgcaaatgtcctcgtacgtaaatctttctgtacttctgattatttccttgggataaattcccagaagtgggccaaagcacatgaacggtcttcaggcttttggagcaagttgagatcggtggggattggagaagggacccagggaggcttttgggagcttgcgagattggagtctggctttaggggacttgaattcacagatgaaggagatggctggcaaaggtgggaacctcctgctctatgggtgggggggtgacactgctttaccttccagtgacagcatggggatcctcccaacatgacctggctccgcatctttctgacactgtgcacggtccacagttgtgatgctcagctgggagcctcttctgtgtccttcagttgcattaactccttgcagacagaggaggaagctgtccggtgctcctccctgctgcgtgggtcctttgaatctgcccagttgggcctgtggatctgtgcagtcacgtacggggttctaaaatctgcaaaatgacaagctcacgaacactctcgcttctgtgggtgaatgtggataccccttggctgcgtctccctccacagggaagatggagacgtgtaaagtgacaaggacctgctacccctgggcaggttatgccggttccactgtgaggatggtggcagggggcttcccaggaggcctgcacattgggaagagaggggcgaccgtgtgtgactgcaggacccagggcgcagtcttaggactctgatgggggaggagatgctggggagccctgttctgccagcctggtgacagacatctcctaatgtttcccggctgggtacaactcacaatgtcctccgtggggaggcaattgcccatgaggcatccctggcagggatgatcttgtttcattgccacatatcccagcaatgaaacaagaatctagagtgatgtgattcctccgatgacttctccaaccatctggggtttttgtgcgactccaagaagggggaaggaggcagctctcgctcctctgggctcctgatgtggcagctctggaatggccacgtgtccgttggcccacagtgggccatttgtcgaatgtggttgtggtgggattggggctgggctggagagtgggtgaccacaccagctagcctcaccctgggccactgtgcagccaggggtttcatcttcccaggggtctcgttgtgagtgtcctggggctgctggaacaaattactggaaaccaagtggcccaacaaagattgattcgctcatggttctggaggccacaagtttgacatcaaggtattggcaggaccacactccctccgacagctcgaggggaggacccttccttgcctcctccagcttgcgttggcccaggcgctccttggctctggcagcatctgcagtctctgctctcatcacgtagccctccccaccgtgtctctttgtgtcccaagtccccttctgcctttctcctataaggacaccgagcactggatttagagcccatcccaaatccaggatagtctcatcccgggatccctaatcacatctgcaaagaccctttttccaaataaggtcacattcgtgggttcttggggttaggtattagacatgtctttttgggggtcactagtcaaccctctacagaacctcagacgaaagtgaatcttcacaggctgaaatgggggtgaaggtctagtgcgtccctcctccttgggagctccctcagggcttgtgcctatcctgtgatcctgtgatccagccttttttttgagatgaagtcttgctttgtcgcccaggctggagtactgtggcacgatctgggctcactgcaacctctgcctcccgaatttaagtgattcttctgcctcagccttccaagtagctgggattacaggcgcccacccccatgcctagctaattttttgtgtttttagtagagacagggttttaccatgttggccaggctggtttcgaactcctgacctcaggtgatccgcctgccttgggcctgccttggcctcccaaagtgctgggattacaggcatgagccaccacgcctggcatttagtaggttttggttgttttttttttttgagacagagtctcactctgtcatccaggctggagtgtagtggtgtgatcatggctcactgcagccttgatctcctggcctcaagtgatcctctcacctcagcctctcgagtagctgggattacaggcatatgccaccacccctggccaatttttgtattgtttagtggagtcggggctttgccatgttgcccaggtttgtcttgaactcctgggctcaagcgatctgtccaccttggcttcccaaagtgttggggttacaggcgtgagccaccacgcctggcttagtaggttttctagaagcgcctgaggcctggtgaaggcatggtgtcatggagtagagaacattcaactctgttcccggggagccggaacacacccctcgtagccaatctcaacagtcatgacgtggccaggatgacatggggagggggtggtgtggactgtgtgggaggccagctccccgggaagggggctggagtgggcttggctttgaggaggattcccaagaggaggaggaggcggtggcatgctcgtttggggggatggcgtgagccagggtgggcacctcttcatttaggtgtcaccttcttgacattccagccgggacatggtttccttggggaagatggacacccccagagtggggcatctcctggggaagatggacacctccggaatggggcgcctcctgttctcactgttcttctagcacacagttgtattctcttgcagttctggaggctgtgagatctcctggctgttatctagaacaaactcgcctttgagcagcgccgtcctgatggtggggtggcccctgcgggtggaacagcccctgctgtctcagagcttactgagagctagtgggcatgggagtggtgctggaccgaaacacccagagggatcatagagccaggcagtaagcacagaggccagctagtggggagggagggacccatccatgaaaagacaccaagcattgaaagagaggagaggatggttggggaccggcacacatgtgcattttgcgcagatggccaaggtggtgaggcgccagccacgcagacaactggaggaaggaggagtgccctaggggaggggccagctccggttctagaatgatccgcttgtgcacgtgggcctggctggaataaatcattgcatccgcaccgtagactcaatcgtaagctcacaccagggcagcctctgctttggtgcagtgtcttcgatcatgagttggccatggtgggggtgactccaaggggactcccaaggagggggttcaccggatctcccagggaaggtcatttgttttcttgggttggacctgggacaaggccttctcctgtctagtttctgttctccaacttgaccgcacggaaggatgctgaggacacctggaagccggcccctgctctacagcacccataggacagaggcacaccatgtggggacagtttggacagtgctcaggaggcagggagcagatcagaggaccgcgggaggccctgggaaccgcacgaggacccaggcattgagctctgcactttctggcatcagcccgatgtacagtctggctctgtgtctaccccgtacttcactttccccatctgtacgggggcggtaataatattctttacagcccaggtttaagcgggtgtagatgtgatgagcttggtaagcccatctcattacattcagttctgggcattgaaccctggactttctggctggtagaagtggacattcaacctttccttggggccctggggcttctgcagaatcagaacacagccagcagtttgcatgcagggtgcagagggacagagggacaccatgtcgggagcccacacctggcacacccctgactctggggctcagtgtcctgctgccctgcggccacgtgatcagctagaggtcatggctggacccataggcgaatacagcctgtggatttgattttgtttggccctgcggtgttttattttatttttagttttagtttgtggagacagagtctcgctctgtcagtcaggctgagtgcagtgacacgatctcagctctgcaacctctgcctcccgggttcaagcgattctcctgcctcagcctcctgagtagctgggactataggcgagtgtcaccatgcccagctaattttttatttttagtaaagatggggtttcaccacatcagccaggctgctcagtgttttaaaaagggcttgttttgctttgtgccagcatttaaagatcaggagatatcatataaagatccagatttctactctcttgagaagtgaacagctctggccacgccgggcccatatcctctagggcagtgacggagctgagacagggcctgtgacaactgagagttctctggagtccacacggctccttgcccagcttctggtggaggttgagcttagtgacccaggatttcgtctgtgtccaccaagaaggagaggtgcctgtggcttagagagggcgcccacaggagtgccttgcccaggaagctggcagctgaggcggccagggttagggggttgggcttcctcttcccctccccagtgcctgagtgcatttggaggaagagagacgggtgaggggaaggcactgaaattggtcctggagcgctattattgggggctggggaccagctgtcatcccttttcctgtgggcaggggaggcagtggtgggatcccatgagacccggactctgtggcctggtgaggcagggagcggctggggagacactgtgggtctccacaggggtgcgctgtgggtctggcctggggaaggagctggtgaatgtgcctgccatgtgggtccctccctgctctggccctgataaccaggagcggctggctctcatttggagtgcggttgtggggactgtggaggtggcagcttcccaggtaccatccccactgcctccgagggagcagaccctggtggagaggcaggatggctgcagggcgggagctggtggttggcatcactgcacgggcttgtagtagtggatgggaagatgcaggagaggctgatgactgagaaagttggttcctgtggactaagctgggggagccggacaaccaagtggttagaaccttgggctctggtatcagcctgatgtacagtctggctctgtgtctaccccgtgccccactttccccatctgtactgggggtactggtattctttacatcccagggttaagcggctgcagatgtgatgagctcggtaagcccggcgcctcgccggcactgaaagctccagtgtccgcccttagtgtcattgatggggttttgttcccgctgcggttctgattggttacagttgcggtcacttattattggaggcatgtcccccgctgtggctgatggtagaggtgtgtttgctggtggtgtcccagtgtgtgccttggctggaggtgaggagggataaaaacagccgcgacaagaaggaaatcaaggccgggcacggtggcgcacgcctgtaatcccagcactttgggaggccgaggcgggtggatcgcttgaggtcaggagtccgagaccagactgaccaacatggtgaaaccccatctctactaaaaatacaaaaattagccaggcatggtggcccgtgcctataatcccagctactggggaggctgaggtaggagaatcgcttgaacccgggaggtgccgctgcactccagccagggcaacagagcaagactccatctcaaaaaaaaaaagaaggaaataaaagtcttctctggaactagaacgttcctatgtagacgtagctggagggggaggctgtgtggtttgcgccgtggccatggcaagacacgacgggcagcatcttcccactccagcctgcatctctgccccagaactcatgatggttctcctaggatggggctgtcccttccgcttgctgagacatgaaggacgggaagagacccccggccctcaccgccgcatcgcctgccttcctctgctgctccttagcaggaaacatgccggagtgttccctagccatccattcaccaattgcatcccctctctttatttttcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggagggtgagtcgcagagcgctaggtcttggatgctgtggtaatggggggcctggttgctggctttgccacagaatcttggaggaagaagctggatatggggtggagggtgctaccctggagacccagaaagaccggaatgcatgggggtgggggtctgcaagctcaggagaggtggctctctctgtctgatgggaacatgccaagatgccccaagcgggacttgaatgagagtttggaaagattttctgggtttcaaggagcctcctttatgggtcaccgtgggccttgctgggacctctgtctgctgtgtgtccctggagggcctgggaggcttagagaatgaggagccacgcaggaaccagggcaggctcatgcaggggtgtaggacagggtggagttgagacccctagaagggctgtcacattctggtggctcctgcttgaggaattgcaggctgcctggatatgcccagcagaggccgagggcttggggaagggaggagggacgtatgcctcctgaggcttgcattggagcccatggtctggtcctcctcccccaggagggatggttgtggcagagggaggggaacatgaggagcaccttagcctgcaggacaaaattctcagggcactgggaaggggtgcctggaccagggggctgtgtgatagctgcacacggttttatttgggggtgcccttctggcgagaggagagaggccatggggctccagcagcgtcctgggagggctcaagcccacagccgtgctgacatggagcttacaggcaggggattggtgccagtcctgtgggacacagggcctgtttggaaatgccaggctgtgggacatggttgggtcccttctcagaagcgtgccccctggccccagcagggatcgtggctccatggggctatagtaaggtgccagctgggttagaagcccctcaagagccaggtctgattctgggcacaggatcagaactcagtaatgctcagtaagccttctttaggttggacaaacagcacagtctgggtttttgatttagctgctgcttcttatttctaaccgtggtgaaatacacaacatacaatgtgcaattttagccactttgcagtgtacgtttcagcggcattcagtacattcacggtgttgcgcagctgccaccgctgtccatctccggtacccttttcatcctcccaaactgagctccgtccccgttagaccaagctccccatgcccctcccccagctgctggcagccaccattctattttctgtctttattatgaatttatttgaccactctaggaaccttgtgtgtgtggaaaaatacaataactgcccattttgtgtctggctcatttcactcagcatgacgtcctaaaggttcatccgtcgtgctgtagcatggggcagaatttccttcctttcagaggctgaataatattctgttgtgcgatgcacttgtgttgtgtagctgttcctccatcggtggacccttgggttgcttccacatctctctaagtcccgctttccatcttctttgacttttctttgacttttttgagacagggtcttgctctgtcctccaggctggcgtgcagtggtgtgatcactgcttactgcaacctctgccccctgggctcaagtgattccccaacctcagcctcccaagtacctaggaccacaggttgcgcgccaccatgcctggctaatttttaaattttttttgtagagacaggttctcactaggttgcccaggctggtctcaaactcctgggttcaaatgagcctcctgcctcggcctcccaaagtgttgggattataggcatgagccacccaacccctttttggtttttctttttgaatgagagttctccagtggtcagtgggcttgggggctgggaggatgtggggcctggagagggtgtgggtttggggggagaccagtgctcctcatgctttcatgggcatgtggagtgcacatttgtcttggcgggtctggggcctgggactctgcatttcctacagagggggcatcggaacacactgagtagccagaggctagtgggccttggaaggtcctttccggccctcagtgtgcgagtcccgtgttccctctcccatctctctaagcttgactctgaagagccaccctgccccagccacccagactcagtgacagtggttgctggtggcatggtgtcaggccaaaggcatgggcagtttgcagagtggcaggaggctgtttcctcccctgccttctgttggtgcaggacctttgtttgacgtgccggatacacccccatcctgggttgatgtgttcacactcagctgagtcaaacaggatgtggctggggaggcggttgtcaccgagccatctaaatctcggtgatggctggtgctggatgcacagggacgtggtcctggctctgggggacaggtagggggatgtccatggggatgtacaagaacattctcctccaggggcagacacagtttagcccctaaattgtgccagagactgtgccgggagccaggcccaggg

SEQ ID NO: 1515 - DNA, 2801 bp, Homo sapiens
tgacttctcagggttcctcctgggcaggtgctccggaaccttttctcagcacgctggcctggggcacggccgttcctcctgcccagccacgttggggtacagggtgaagaagggctggggccagcccaggacagaggaaggcgaggcaggcacgcaggaactgggctttttaaacccttaagcccaaggaaatcgtagcatcgcgggacagggaaaatgaaagactttggaagtcgtcaggaatttgactctgtgagttggtttccaagagtctaagttaagcatctccaagtggatattaaaaaggagcagcaagcctcggggcggcgggggctggaggaggtggagagaggaggctgccggaagccgcactcgggacctctgcagccaccgaccagaccgggcggccgggactctgggactctcgcaggcagacccggtggtctgccggactcctcggggcccacttcgggccctctctcctgcctcctatttttggatttctctcctttgctccctttttcctcccgttttgaagagacaatgctacttcagtttggagcacaaacatatgatcagcacatggaaatgtggtaattcggatgcattcgtgattgcaacagattgaagaaattagaccagacaaagagtgtttttagaggaggaggaggaggaggaggaggctgagagagggagggcgacgggggtgagaaaggggaggccgcctctgagcgggacgccgggactcccgccgctgctaaatatatccgtaggaatggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtagacgccgccctgcccacccccgggatcctgcccccaagtcatttccgtcccccccccaggccctcccaccaccccattttattttatatgattttctccatttgtcatcgttccccagccttgagatgcttcactttccttctctgtaaccagactttgaaaaattgttcgtttcatcaggctctgttcctcaatggccttttgctacgtgcctcccgagaaatttgtctttttgtataaatgacaaagtgttgaaaatgtatttcctgaaataaatgtttcaaatgcagaaacccaaaaaaaaaaaaaaaaaaaaaaaa

SEQ ID NO: 1516 - DNA, 1707 bp, Homo sapiens
atggagagggaccggatctcagccttgaaaagatcttttgaggtcgaggaggtcgagacacccaactccaccccaccccggagggtccagactcccctactccgagccactgtggccagctccacccagaaattccaggacctgggcgtgaagaactcagaaccctcggcccgccatgtggactccctaagccaacgctcccccaaggcgtccctgcggagggtggagctctcgggccccaaggcggccgagccggtgtcccggcgcactgagctgtccattgacatctcgtccaagcaggtggagaacgccggggccatcggcccgtcccggttcgggctcaagagggccgaggtgttgggccacaagacgccagaaccggcccctcggaggacggagatcaccatcgtcaaaccccaggagtcagcccaccggaggatggagccccctgcctccaaggtccccgaggtgcccactgcccctgccaccgacgcagcccccaagagggtggagatccagatgcccaagcctgctgaggcgcccaccgcccccagcccagcccagaccttggagaattcagagcctgcccctgtgtctcagctgcagagcaggctggagcccaagccccagccccctgtggctgaggctacaccccggagccaggaggccactgaggcggctcccagctgcgttggcgacatggccgacacccccagagatgccgggctcaagcaggcgcctgcatcacggaacgagaaggccccggtggacttcggctacgtggggattgactccatcctggagcagatgcgccggaaggccatgaagcagggcttcgagttcaacatcatggtggtcgggcagagcggcttgggtaaatccaccttaatcaacaccctcttcaaatccaaaatcagccggaagtcggtgcagcccacctcagaggagcgcatccccaagaccatcgagatcaagtccatcacgcacgatattgaggagaaaggcgtccggatgaagctgacagtgattgacacaccagggttcggggaccacatcaacaacgagaactgctggcagcccatcatgaagttcatcaatgaccagtacgagaaatacctgcaggaggaggtcaacatcaaccgcaagaagcgcatcccggacacccgcgtccactgctgcctctacttcatccccgccaccggccactccctcaggcccctggacatcgagtttatgaaacgcctgagcaaggtggtcaacatcgtccctgtcatcgccaaggcggacacactcaccctggaggagagggtccacttcaaacagcggatcaccgcagacctgctgtccaacggcatcgacgtgtacccccagaaggaatttgatgaggactcggaggaccggctggtgaacgagaagttccgggagatgatcccatttgctgtggtgggcagtgaccacgagtaccaggtcaacggcaagaggatccttgggaggaagaccaagtggggtaccatcgaagttgaaaacaccacacactgtgagtttgcctacctgcgggaccttctcatcaggacgcacatgcagaacatcaaggacatcaccagcagcatccacttcgaggcgtaccgtgtgaagcgcctcaacgagggcagcagcgccatggccaacggcgtggaggagaaggagccagaagccccggagatgtag

SEQ ID NO: 1517 - DNA, 21749 bp, Mus musculus
  misc_feature (1)..(10): "n" at positions 1 thru 10  can be any base
  misc_feature (9223)..(9475): "n" at positions 9223 thru 9475  can be any base
nnnnnnnnnnccatgtatcccttaaggccatgcccatgagactcagttcctctaatgacgtttcacctcctgaagactctataccctctcagaacagtgtccccaggaggaggttgggggacaccagctggatcagcacccatccctctctgtctcctgtctgagtaccctgtgagcaacagcctcaacttccagacgctgtgcctttccctccacagtggacggtgtccccgagctgtgaggcagaacaaaccctttctccttgagtcgggtgttctgtcccagcatcaggaagagcaagtggtacaactagaacatcagcatgaccacggtcctgtttccagcaccaaaaatacaaatatggctgccatgctccccgtgggtgggtgggtggggcgagaagccatatctcaggtctctgggtccttgggtgaggttgaacccccccataggaggataaagtccccgagtaacttccctctttcgccatgaaacccagatccactcatggggccttcttagtacttattgcttgaggccccatgcctatgacagtggcctctacctaaggttgatgagcaggccggtgcccattagcctagccccaggtgcttacttgactggctgactggggatgacagctagccaactgatacctagtgctgctggctgtcacacctgaggttcttctccccggacaagtaggcatcttggcccccatctccagtgttaggtgacagctgactgcccagacttgctaggcaagtcctggctcacttgtctcagtcccagcaaactcagctgcctctctgggctggagaggaatctggcatgactccctcactctgaagacagcagctgcagacttcacagagcttcccttccccatcctctgccctttggctctggtgcccattgggcttctgtgctgggccctgaacaactacaatggagaggcagcttcaaaggtctgcccaatgtgttggccatctgtatggcagggctacctttaactccagaatttcagctttccgatctgatctgggggacagggtaacaaaagcattgggggcagagaggtagaggcatctgggagatgggtccatgggtaaaacagcttgctatgcaagcacgaggacctgggtttaaatccccaggacttaagctgagcatggtagagtatctaccatccagctgtcccacagtgagataggaggcagaagtagaattcccagaagctcgaggggcagtgagcttagcattcacagaggcaaaacaagagaccaccccattctaccccaagccgtctcatattaagtggaagacaaagacctctgatctccatatacgcaaggctgacttcctggctatctgaatagcccaacctacaacagttgatgttttgacctcaggtccagagctcacccagccttattctcagctgagctcttcctctgtcacccctactccgacccaggcatgatttagcagccatagatttggaaagactggagccagatagaagtatacatcactccagagcctggagagctctgcctttcactcagaaagtcatcacaggcccaccaaacctgccaatgaggcctaagagtctctctcctgtgctgtttggatttttgtcaattagatacaagctagggtcatctaggaagagtgacacttccttgaaaagatgcccccatcacattggaccatcgtctagggagcgttttcttcatgattgatgtgggagggcccagccctttgtaggcagtgctatccctagccagatctgggcgaggtggcacatacctttggtctcagcactcggggaggtagaggcaggcagatctccatgagttcgaggccagcctgatctgcaaaggcttcctggacagccagggctacatagagaaaccctgtctgggtgggagatgcagggagcaaattgagcagggcgtggggttcaagctagcaagcattatttcttcacggtctctgtttcaatccctgccttcaggttcctgccttcccttcatgacaggctgtaagatgaaagaaacctgttttcttccccaggttgcttttgatcgccgtgtttatcccagccacggatgacaaagtaagccagaatccccaaacggcctctgctctgcggcctgttgggattcactctttccttgattcgtttccagtctgatttctttgaccacccagacactgctgggctctagaccagcccttctcaacctgtgggtcgtgacacctccagggggtcctgtatcagctatcctgcccatcagatgtttccattatcattcaaaacagtagccaagtcacaactgttttaaagggccacagcattcggaaggtcgagaaccgctgctctagacggagccctgaccagcaggctgactttttttcccaagtccgtgtggttctctctcacatgatgctctctttggctctgatgctgttcctaactgtcctgcctaggatgcagctacctccatccatctcctttagccccttggatctttccactttccccactctcccagcatggaagatccactcggctgttctccatgctgacatgcctaggcccaccctctacctccttctggaggccgtagtgtaagactacagagctttctttcctcaagcatcttcccgggatccttcctgcccgcctgcacccccccccccaatccctgagaagaacagagaatgacccatcagcaagccaatgggttaccccgagaatgtgacaaagggtgaggctgtgggtcccaagggtctgcagatagagggacgagccagcagccttgggtgcaagaccaggccttggagggtatctctaccttaccttataccacagagagaagtctggctcccatgttgccctgtggatgaaggtgggcaggctgagcacaagctttcaggaaccattgaattcattgtgaggctgagatggatctgcgtccataaggccaggaggggtaacagtgtcagaccccagccccagagggcgctctgcggttgattcagtagccaggagcatccagagagctcttctggggcccttgctttgtctcccactctgcaatccaggggagatctgcagccccttttccttggcaacactcaagacagaaagaggaagctacatgcccagccacccacggggaaggagattggttccactcctgcatgaggttgtcgacgaagtcattctgccttctagcaggacaatggagaattgaagaaagagggccgaagaaatggctcagccgttaagaacacttgctgctcttgcagaggacacaggttcagtatcccaggacccagatggtggcccacaaccgcctataactccagttccaggagatctgaccaccttcttctggcctcctcggccaccaagtaggcatgtgtacaggtacagttacaggcaaacactcacacactcaactagccagggagtctgctggctagtaaatcccaagtggccaagtggcctgcttctaaatccttccttgtagctgtctgatattcactccatcccaagtcttaaaaaataaataaataaaattgacgttattaccttcattttaatgcaaagggaacagaaatcagatcagagaggttaagtaaccagcctgagatgccacagctgaggtcataaataaacatctctccccttcaatctctgactttgaacagcccttttaagagactgtagaacacagatgcttctccgttcaggaggaacgatgacagctccacagggtctgttcctggaaaccccagctggctgctgacatttcctgggtgcatgctgttccgaggcagatgtcacccaggacccctgaaccagatggggcttctcagatcacagctataacgtgactctcgggactcagtttcccatctgtgaaatgaagaggctccttcctcatcttgcttcagcagttcctgtacaatcaagtatcttagtttgtcccagaagctcagtaagtagccggatgtaccaaaggctcactgtccaagtgactcacgttggcttttaaatgatcgatttctgggattcttctgtcttactattagtttgctgtgacagactaaccaacaagaagcaactatgtaagggcttatttcggctcacggttgaagggcacagcccttcatggtggggagccacagtaaccggtttgtgaggtagctgctcacattgcatcttgcttcggggcagggagcagagagagagatggatgctggtgtttggctcactttctccttttttcttcagtcctatggatggtgctgctcacagctagggtgagtcttccaacttcaattaacctaatgtgaaaactcccgcacaacagcagcggcctgaggagcgtctcctacatggtcctggggcctagagagttaacaataaccatcagccaggatgatgcccaggttatatttactgtgcttcacaaactgtcatcttggaaacagccttgtgcctggccttactagattggatcttatttttcaggtaagaaaaccaaagcccagaatccggaatagctcagccctagtcaggtgactctagaccagcggttctcaaccttgctaatgctgcaaccctgtaaatacatgctgtggtgaccttcgccccataaaattattttgttgctacttcataactgtaattttgttactgttatgaattgtaacatcaatatcttctatgtgggatagctgatactcaacctctaggaaaggacccttgggccttaagggggggggggtctcaatccacaagttgagaaccaatgctctagaaagtggtagagggattttcagacccagtgatggtaggtagagcttaaggttgccccagctttgtgtccaagttccccccccccctcccccgtttactgtgtcagggaggatgacggaccagtttccagactaggaaaacccaggtactgaagaaatgaataaagctgaaagaagcagcggtagctggggtggtggacaaagaaaggcactggcctagcagctgaggggcagaggcctcagtcgcatgagcccatggaataactgtagaagtggctgttaatttcagcaaactgtcttccggtgtcctctgggacactaatgcaaaacagaatcacgtttgcctgcttcattttgtgaggtaattctgtaaattttatttacttgtttgtttatttatttatttattcgtttattttatttttttaaattaaactctatatactagggtttaaatgctgctcacatggggggttcctgaaagccctggagggggcacacgtgggtctgcccgtgttttaaacagaggtatctcctgcaatccgaagtcacttagcctggtgcactttacacctttttaaagattattccccactgccctccccatccccaccccgacacatttgtgtggaggtagcagagacggaaaaagctgtgctgtgtctttaaacagggaggagcgatcagcagaagcctgggctgtaaaaaggctaatgcgctgtggaagagtaggagtttaatctaatttagttggagggtgtctgtctgcggtgttgttttttggagtgtgggaacagaggaggggagctgcccccttgaatggtcccttctgcgccagaagcagtggggagccgcgcgacgccagcgatccaaggcccggccttgaaagaggattaaagcgatgcttgatttgcaattcacacgaaagcgccccgcgaacctctggtaatatttcaatccacatttcaagggaagtggccttaaaatagcggcctaaattgttctgccgcggcccggacactccttcatgcattttataacgcagagggccaagggccttttctctctgcgcctcaccacccccaaccaccccgtatcttacatgtgctgaagtgtaattaaaacttgttcttaagtttggggcaacctacactgctttgtggtatgaggtgtgtgtgttttatgcttggagcatatgtttgtgtgtgttaactaaacatcactttggatgactttaatatatctcctccgaaaggggggggggggattgtgaggcagtcgtggaaccaagcctagtgggttggaaaactgaattctcaatgtgtgccttttaaagagaccattaccagtaagcagaccactttccttactgtaaggaacagtttggaaaatgcaaacagagatcttaagagctttccaactggatccgcaaataggaaagttctagaaatggccttgaagctaccaagacaaacgttaaggagccagctccctggttcatcttcaggctgggagacaggatgttcatgtctttctataatctctgcccataccccacatgtttactcttgcaattagcttgtaacaggctaagcttctggcttaatttttctttattgtaggagacgaagtactttttttttttaatcttaaagagattatttgggttctctctaatcctatttcagaaacccctctcaagactttatggttccttcacccatactgaggaaggctgcagctttgattaccactgagacccatggcagagaatcttttcttttttttttttaacttctgactttaccaattaaacagggccttcctttcaactccccaccacctccaaaattatttaactcaagacaccatctgactcttaaagagtattccttccagaataccttgcactctccttggtagacatttgcaagaactctacgctaatatctacagacagtattttgaaatctcacgtagatagatatattaggagatttggggtccaaagtaccctttgctctaggatgctatttaaaatcatgtttaattatcaagtttcattaaaaacccttgctcaaattttgagaaacctaataagatttccattaatttaaacatagctctattcccaggccagtcccccccaccccaccccaaagctttctcttccctcttttatccctggttaaatatgtaaataaaatgtctaaagtcgttcttcaaagaagacaaaagaaaaaaaagagccgaggggagagagacagccataaaattcctcccagctctccataacgcttgccagaggggggccggtttccgagccagggctgagcagcaggggacccggctgctctggagtcactcgtctcaaatcccacacacaggagagagaaaaataaaatatcttttcagctggagccatcaaaggggtcctttcatttattagcgttgccttccactctcgctatctcggggcccttatttttagatactaatgtctatttgttgctttcctttctttttctatactaggttgggcagatggaagaaattctgttagctttttcttctcttaatgtattttaagggagtcccggggggttgggggagagaagaaaggaacgtgaagtgatcatagctaaaataaaaggtcggaacactgtagaagtaaccagagcataaaagaccaattacgtggggcagtctcaaatagctcacaccctgctccggagctgagctcacccaggctacttccacgccccccacgccccaaggggcggggggggggagtgtggaattaggagagagagagagagagagaaaacagaaggcaaaagtgtcaggaaggaccccttgcaaactagtctgtcttaaagctaagcgatagcccaagaatcttacctgacttaaaaggttttggaaacagcgtactagactataaatatctaagtaaaccatccttatccaagccgcaagcgttcaccacaccgcaggtttttcttgggtcactaacacggtggtgggtggtgattctgactgtgttaacctcagtcttccggaccgctgtttccacggatccaacttcctcccgtgaaaggcagaggggaccaggggatctaaaggtgaggcatgagcctgtgcacacccctccgccccccacccccaggactcagcaggtcctgggagtgtcccagcctcaggtctgtccgctatgtctgacaaacgaaaggggggtaaagaggaagaactccctgcagatgggacgctgaagccttgttttaattagaagtcgatcctctgcaggaagcgcaaggcagggcggggaggaggggtcctgggtagcctcgttcctggcttggctggagccactgaaggcttccaggcatctgtgcacccaactcggccctggggtgcgcaagactgactggccgaaagatgagcaggggacttagctgcacctatgcagttgggggagtccgcactggaggtcctggtagtttcccagacacttaaaacgcaaacctgaatgggggtggggtggggtctaaggagagagtgggccaccgccctgagggctgtttatccaaagccaagagtccgcgacaggtgccgcaccccagatctgtcggacatctaaggactgcggtgggctcccatggtgcactcactccctgtgcgggggaaggaggttgaagctctgtgtccttatcacagattagcccaaaaccaaccaaggggcaggagccagcatagcaaggcacggagaggccccaccactctgcgtgggaaccagccgtgcgcgtgtaggccggggctcagcctccgcctcccaggaggacgcaggccgagcacatctttcgccaaataatataaatacacaacttcctataataaataaactcagccgcttggagaaaccaccagccggcttggcgcgatggtccccaacacggtggccttggcggggcaagggtcaccacgatccaagccaagcccctcttctcggggtgcggggtgtcagcggcccggaaagtctcctccccgccccctcccttctttctttgagtagaccttgcagaagaggccctaaactccggcttcccaagtcccctccccctcccctgcactcggcccttttgaaatttcaaaggcagcccctccccggagtccgagctccgcgccccgggcagcaaacccccggcttcgggaagatgcgggcagctttacaagccgaggggccacttttttatgagcacggtcataaaacgcaaatcccgtgtctctttgaaagtgccctccgccagggcccggtcgtaaaagtagaagatgcgtccccagcccccaaccccgggtgaggaccacccttacccgagtccccaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcggaggctgcccggggcgcaaggctttctgatgcaaagcagcagcggggcggggcggcgggcggaggcggggcctgtcaccaatcggctttgctttttttttttttttttccctctttgctaccctttgcctctttgcaagtcttctcatcccgggacgccgtgctggaagcagctgcgggcgccgggagggaggagctccagggcctagggccacggtgtgcccgcgctgccccaccgcggtccgcgatcgcccgcgcccggaagaagaggccaaagtttgcgcgctgagcggcgctcgctccgccgtattgtttgcaaacttcgctcccctcccccgccgccccccgactccgctgaggccgcgcgcccaccgcggtggccccgggcgccgcgagcgctccggccagactggatgggcatgcgcgggggcccgagccggggcgcggagccgcgggcagcagcaacagcccgtgcccgggagcggcggccctgagcggcgctgggacattgagggcgccaccatgcaacacccgggcccgcgcctgtggctggtgctgcaggtgatgataggctcgtgcacggccatcagctccatggacttagagcgccctggagacggcaagtgccagccggtggagattcccatgtgcaaggacatcggctacaacaccacccgcatgcccaacctgatgggtcacgagaaccagcgcgaggcggccatccaactgcacgagttcgcgccgctcgtggagtacggctgccacagccaccttcgcttcttcctgtgttcgctgtacgcgcccatgtgcaccgagcaggtctccacacccatccctgcttgccgggtcatgtgcgagcaggcccggctcaagtgctcgccgatcatggagcagttcaaattcaggtggccggactccctggattgcagcaagctccccaacaagaacgaccccaactacctgtgcatggaggcacccaacaacggctcggatgagcccagccggggctctggcatgtttcctccgctcttcaggccccagaggccccacagcgcgcaggagcacccactaaaggacgggggtccggggcgcgcaggttgtgacaacccaggcaagttccaccatgtggagaagagcgaatcttgcgcaccgctttgcactccgggggtggatgtgtattggagccgcgacgacaagcgcttcgctgtggtctggctggccatctggtccgtgctgtgcttcttctccagcgccttcaccgtgctcaccttcctcatcgacccatcgcgcttcaggtaccccgaacgtcctatcatcttcctctccatgtgctactgcgtttattcggtgggctatatcatccgcctcttcgcgggcgcggagagcatcgcttgtgaccgggacagtgggcagctgtatgttatccaggaaggactggagagcacgggctgtaccttagtcttcttggtactttactacttcggcatggccagctctttatggtgggtggtcctcaccctcacttggttcctggctgctggaaagaagtggggccatgaggccattgaagccaacagcagctactttcacctggcagcttgggccatcccggctgtgaagactatcttgatcttggtgatgcgcagggtggcaggggatgagctcactggtgtgtgttatgtgggcagcatggatgtcaatgctctgaccggcttcgtgctggtcccgctggcttgctacctagtcatcggcacttccttcatcctgtccggctttgtggctttattccacatccggagggtgatgaaaacgggtggggagaacacggacaagctggagaagctcatggtacgcataggggtcttctccctcctctacactgtgccggccacctgtgtgattgcctgctatttttatgaacgcctcaacatggactactggaagatgctggccacccagcacaagtgtaagatgaacaatcagaccaagacacctgactgcctgatgaccacctccatccctgccgtggaggtcttcatggtcaaagtgtccatgctgctggtggtgggcatcaccagtggggtgtgggtctggacttccaagaccctgcagtcctggcaacacgtatgcagccgggggctaaagagaaaaagccggaggaaaccagccagtgtggtcaccagtgcagggatctacaaaaaagcccagcacccccaaaaacctcaccttgggaagtatgaactgcccgcccagccttcagcctgcgtgtgaaggcagagctggctgcaagaacaggacattcggagcccaaatgggcagcttttcttggttggctggttgttggtaaatcaaagtaaaaagaatatgtatatatatatacatgtatgtgtatgcatgtgcatatatatgcatatatttacacatacatgaagtctaccttgaggttcagaacagctgaatgtaaagggttctgttcagtttgttgcctccctgaagggtcgctcattaaggagggagcctcttgtgtaactaatttgtggtaaagtagttgattcaaccgccctccagaaaacttttgtttaggcctcaagcacacagctgtgtattcagaaggctttgctgcctgtgcataaacttgaggctggagagctcctttgtaagctaaagagctttcctggggggggggggcagccagtgagccacccaagggcctgctctccctccctcactcccccagctaggctgctgtatgggtgggagggaaggtgaggaggagaggggataaaagaggtgacaccccccccagcccaaggtctgcctgcagatcccttaaaagagagtcacttccccagccttcatagccatgtttctcccaacacagagcccacgctaccctctcaccccactgcagatctaacactggagaattcaaatggtgtgcaatacttttttttttttttttttacattttccccctctccctagcaaaacaaatgagagagagaaaaagtattttgttgtaaataaaaggcaagaaaagaaatcatctaacaaaagaatttagaggctcaagcctcagggttgggggttgggggggcgccttcagcctgatacattttgtggctttttaatggaaaccaagccagtgtgttctacacactgggactgatttgtggagaggaagggggagggggggaagccagtggagagcaccagagggcttattgactctctgaattgttaaacaaatgatttccatgagtggtcttgaagcacttgggaagacaaactttgtctccagccagggagggccatgcctgcctctgtatatctgtaatataggatatttttcatgctccactattttattaaaaataaaagacattctttagtttgctgctagtcactgtgcattggtgaggggagcgttctccatttcttagcagattcttgggtgtgcgaggctggctagacatggaccatgaacctggatacaagctggcaaaataaaacatcctggggctcagaggcctgtgtgctggctgtgggaaaaggtggcggtgactctgcccccaaggctccatggatacacagaatgccgagaccacactcacccaggatgcagcagtctttacctgacctactgtgtgcaccagtctgagtggaccactctactgcagctctggggccatgggatacatttcagagctggataggtgaaagtgggactaagtgtgtggtggggggagggtcatcagcaacaaattcagaagcttggccaccttgaagtttctggtaccctttcttctcatcactaagacaagctataggccctggagcagacccaggatccactaggcttgactaagctaaagttctagctagaaggacccaaggacacagttcagctctgagaaattgggggggaggggtcagtgtagacctacccaactctgaccttcatagctcagaagcactttaaactatttgagcccttctgaagcagagataccagcttgatcgtggctttctgaagcaagtattggggaagtttcacagggccatgggtccttgagcaggaaggacaggtgaattgggtagtctggggaacaagttctagaaatcaatgctgggcagccgggccatcggtgagcataaaacccagaacccagaatcatggaaataaacctctatattgactattgttgtccttaccaccagaagagacactaagagtgagtgtgtgtgtgtgtgtgtgtgagagagagagagagagagagagagagagagagagagagagagagagagaggatcactggagtggcaactggccagacctaggctcatctgcccccctgagctgtagtggttagttgtataggttttgaaagttcatacagagcaatgcctcagccaagaacatgataaggccttgttcagctgtgagcctgcttgacggtggccccatccccaacagtgacagggatcctgtttacaaatatcaagagactaacaagtggccagaagtgtgcttttaacatgtgctccttgggccatagtgagaacagcctgagcttctaaggtatttgtttcctgcaccttctcttgtttcatccgtctctctacctgcatcagtctgtctcttgcagttgaactctagttctaaaccagatggtagatttaaagaaaaacatcaaagcttaaaagttagaaagcttacacccagacacacagacacacaaacacaccacttatctttggacacccccccacccccccacccaatcccctccccctcagctctgtccagacctcgaaagggaactgctgtttccttaatttggagactgtaggcttcactccaggaccacagccatgctgatggagagacaggaggatttctgagttcgaggccagcctggtctacaaagtgacttccaggacagccagggctatacagagaaaccctgtctcaaaaaacaaaacaaaacgaaacaaaacaaacaaacaaaaaaccccaagaaaatcaaaacaaaacaaaaaaaaaaaaaccccaaccaaccaaacaaacaaaaaaaggcccggaaaaggtgaatgtcaaggtctcaaagcactcagttcttgatctcctaccaccagctgttgctcacatgttaagagagcccgacttagggaaaccatagcctcatagaggagacagcggctcacgtctcctgagttccaaatattggggagatatcctgagccaggggtcccccctgtggttgggagacccagcacaagtgcctgcaagaaaagtgaagctgctggggtcatgcgaagggcaaaggtaggaaagagaacacccctttgagaaagtgataggcagggtctagctggtgccccttatataccccacaccaagcacagtgtcttgtccagtcagtacacaacacagggaaagaatggggagaacagctgtggccacagcccaggcagatatgagagcctctctggaccagtggttcaggaagtgatcttttcagtagatggcgtcgggggtggggagatccaagaagcaccaggtgtctgtatgtccagccctctgacgaggaaattcaaggttcaaagggctccggagtccagcctaaggtctcagcttattttttgaactcagggtctctcactaaactagtcaccctggctagactggccagtaaactctggcaatcctgtttctgcctcctctctagcactgggatcatgaatacactgttacactccagtgttgacagggaactaggggttcaaattcaaggttcctttgataattcctagactaagccaggatatgagatgagcactaagcccagaacagtccagtgccacaatggagaaaccaggcctacttatacatccattgcccctcccctcggagagtcaaacatgcctcgctaatggtctccaaagagaatgagcttttgagctttccttacgggaacactttccgacgccaggcacaggattccagagaataccctctgatcttgcaagtgtaaaaggcggcgcagtggcttcgccccggtgagggagaccctagctctgtgtctttgaacaccctcacatcacagtcacctcccagggacaagggctctgtgctgactcctcccccaagcaaacggatggcccagcagcaacagctggaagatgagaaacgcagacaggctgcaggggagccccgggatgacacggggctgggggttttcatgttttattaagagtgcggaaggccaagctggggggaggagggactgaggcgtttgaaatccaaaaagaatgagttgctatcaggtaggtgagctgttgtaattggggacacccctaggaaaatgacacggttggagcgctggcaggtcctcggcagcctgtgggaaccttcggaaggcatcgtatcttgccttttattagaagacatttttaattaaaaaatggggattcccagcctctcctccaggggctttagtgtcaatgaaaggattcaaagccattctttgcctggcacctgcctccgtctagaaggtcgtggcttctgggggccttggagggagagttctcaacctgagcactagactatatcttaaaggctattcttacctgttttaaggacctgtaaaagcagggtgatgcatgccggaaattctagcgtttgtgaagttgaggtaggtcagttgccagctcaaagtcagcctgggctacatagggagagccttactcaaaacaaggaaaacaccctctcatggtatcccgagaacctctgcatttgccccatccctaccctcagagtcccaaacacacacactgttagctatgtgcaccatcctccactggcaacctgcctgcccagccacccttagatccccatactccacaccccccactgcccccgctatgattcttctgaggctattatcaatctgccaaggtcccgtctgtcaccagggtcccatgaagtctggcctggactaaactcagaggcaaaatttcggttacttgcttttctttgtttggcctggagcaatgagtctatcattagatttttctctcttggagaaatatgtctacatggataaaacggtttgttgaaagggtggagaagggtggactgtaaaacttgccgttctcccacagtggctgaaagctgagtgttttccatcagtgaagtccagagctcttccatgtttagccttagcccatctcccagctaagcagaggacactaaagaaggcattccccacagggaccaaggagatgtgttgtttattctgacttacccttcagagggctttttttccccccagtggaaaaaatgtcccaggagctggggaaatggctcggtggatgaagtgtttgctcagtaggtatgaggagaggacttgagttcagatcccaggtacagccccaagtgtggctgtgcctgtctgtaatcctggttctgggaggtggagacaggaagatcctggggttcgctgagcagccagtctagccaaaatggagatctctgggttcaatgagagactctatctcaaaaagaaagccagatgaagatggaattgaggaatatgctctgtcaacctctggcttccatgtgcactcataccagcatgagcatcacatacatacacaagtgtacacacacacacacacacacacacacacacacacacactaagaaatgaaaagatactgcctatatcttaggtgctaagccaacgcccaagtaagatacccatatagcttaatgaaatcacatctttccatctggggtatgaagtgtgtccttttggaacacaagagagaggctgtgcacctgggagaaaacaggagaaatcttagttttgtttcctgttgctgtgttaaaatgtcctgacataagcaatataaaagagatggctttatttggctcacaatgccaggttactgtccatcattgcagagaagtcaaggcaggcacaaaaagcagctagtcatgtgacacccagagtcaagagcagagagacatgaatacacgaatgcttggagacagaaggcattctcaagggagtagggacaatagacatttgggcaactttgggtaactttagaacctgctgggatccgatctatctatctatctatcgatcacttccatttgatggtagattgctggtgtgcatatgctactttatggcttgatggctcagatgacacagatgacacaagctcaggatagggagttcaggttgcatggtaaccctggtggcctattgtcaagtgttcagttcccaccacagcccagtagcaggtcgagagctgtctctcaaagggagaatagttgtctgcagatgatggcaaattcttcctcgagggattctctcgtggttcacctatagaggcttgccacaggctccaagcagcacctctgactgccactgccacctcaagaaccattgagtttgctggatcgtgtgaccaagtggcaaagcagcctagacctgttgaagagcctttgcctgtcccaggtcccactcgaagctagcagcttgccaagtcacttcgtagatatcggcccaagcgacacacccaggtgaggaatgtgctgtctccagaatccaaatagacccactaggcattgtgcttctttcttgatggtgggagggaccaggtacaacaacttatccctcactttagaaggaatatctctgcacgcctcatgtcactgaactcctatacatttccctgaggtagaaggcccttgcattttggttggacttaattcccatcctttgatgcacatacgtgttaccaagttcagagtggttgcaacctccagcttacttggtccaatcagcataatgctatccaatatagtggatcagtgtgatattggtagaagaggcaggtggtcagacctcttcaaactaagttatgacacagggcgggagtgttaccatacttttaaggcaaaactacgaacacatatagctggtctggccagctgaaagcaaactgcttttggtggtccttgggctgagggaaaaaaaaaggcatttgctagatcaatagctacataccatgtgccaggagttgtgttaatctgctcaactaaggacaccacatctggtacagcagctgcaatcagagtcactatttgattagttctgtgatagccaactgtcattctccacgagccatctgtcttcttcacaggccatacaggagagttcaagggagatgcggtagaaaggaccacctctgtatctttcaagtccttgatggtgacattgatttctgtgatccctataggagagagctgagacctgctgaggtgcttgcagtgggtggagcaagtatggaatgggtggtagagaaaagtagtcatagctaccagccaaggtcacggtgatctgctacagaagtgagggctgtaattggcctaagcgcttctgtcttattttgttacaaacatgtttagacatagatccattttgttaagaacacgcttacacatatattaagccaaactccatgttttctttgcgtttacttatttattgtgtgatggaatattgatagagacggtatccacggttaaagtggtgtaaatctacattatcatatttaagtgataagacactaaaagatgaagcattcaagacactttgcctcctatgctgaggggtacacctgcagttagaggtggagcagctatatcatgctatacagaattgtgatcctgttatcactttcatttggaaagttagcaaggtcaaaggagatgcgattggatggcaagaggggtcaacttatcttagttgtcaactttactagatcttggatcaggccaataggcaagccattggacattcctgggaggaattttcttgattagttgaaatgagaagactcacttggaatacgggtggcactttctgaaaacttcactgagtgcggacaacacggttggcatttcgatgttgtggacagactgtgctgacatctggcctcttgggctttcttaacacagactggtgagccagtggctctccaggaattctacatgccttcagtgcctgattgacagctcgcccctccggtgtgaaggtagccatcattgcatggcccagatgatatcgtgtaagttaacctaataaactcctctttaacacacacacacacacacacacacacacacacacacacactcattctattagtttcattcctctaggaaaagacagatgagaggaagcctgtctttcctgcacagaacgtgaaagtcatctgcgtggctgctgcaatcattttgtggccatgaggcaataggcccaatattaaagccaaaaactctgacaggtactaatcaagaagcagccagccttgttatgacttcattaaacgtttgtacctccaggcttcttgttaggcaaggtaattaagtgcctggttttttttttttttttttgaatgtcagcacgttgggtgtcctgctcttagaaaagtagatctggtagagtcaaccagtttagggctcctcgaagtttatcctggatacaaatcaaccagaccagaactcttgctggagttcaggtgctgattcttagtggacctgaggcatagttgcaatgaggtttagaattcttgaagcctgcaggtgcttcattccctgtacagcgaatggtcactgatcatccaagcaggagcctgatgagtgtaaagaaaatataagaacaaacttctttttaaaaattaattgattcattaattaggttactcaagacagggtttctccctgtagtgttagctgtcctggaactctatctgtaaaccaggctggctttgaactcacagcgctccacctgcctctgcctctccagggctgagagccacccagttcaagatcaaatttcttttttagatttatttatttattttatgtatgggagtaccctgaagctgtcttcagacacaccagaagaaggcatcagatcccattacagatggttgtgagccaccatgtggttgctgggaattgaactcaggtcctctggaagagcagtcagtgctcttaaccgccgagccatctctccagccacagcagcaaagaatcctggaagatgtgacttagttgctggagtgctagcaggcacgacgctctgggttccatccccaggaccacacagtggtgtggtgatgcacacctgtaatcccagatagtaaacggaggcaggaggatcacaggttctgtgtcaatcacaggtacatagagagtacaaggccagcctagacgaaataagaccctgtctcaaaaaagagggggaggaagaaagatagggatgctgagttacagctagtctggcccctctggagcaaagagaatatagttcaaattcttcctgaaattccaaccctctgtgttgttctgttactggacagtttcttaattgttactggctgtcaactcgaacccaaaccctgtatcactttctttcttttttttttttttttaagcaacctcgagtgccatttaatatcactgctgcattgttaccacagaaagctgggtagatcacgttaggggtgaaaacttcccagagagtgtcaacttgttgactctattgctccctaatgagggagcagagatgtccattcaaggatgagcagatggggaaagaaggatgagaagctggaggtggggaagggctgattagaaggagctgaggtgtgaacgcaagccttctttcttcatgggagtcatgtgggcgtggatctgccttgtgggtgctttggcatatgaaggacacagccaccacagttagaagccagtcggacagagtgggggagggtttcatacagtggtcgctgcccagatgctcccgagaatctgatcttggttgctcccataattcagcctcttctgacctctgacctctgcctcctgccgcttcctgaattctaaagtcatcaggactggggtcctacgctttgcctgcttcttcatcttcaacgagaagtgtctagtaggacctttgcctgatgcatgaaagtattatcagtcacacaaaatccagaactcaagaaagacttccttgatatttaatagatttaatattctcttcttcgtcccagttttagactgtcttgagctatgcaaggttctctgggagttctccctgtatcactttcaacctgcgtcctcatggctatttcctgtgagttctgagtctatgactcctccttggtctgattggctttc

SEQ ID NO: 1518 - DNA, 2871 bp, Mus musculus
atgcaacacccgggcccgcgcctgtggctggtgctgcaggtgatgataggctcgtgcacggccatcagctccatggacttagagcgccctggagacggcaagtgccagccggtggagattcccatgtgcaaggacatcggctacaacaccacccgcatgcccaacctgatgggtcacgagaaccagcgcgaggcggccatccaactgcacgagttcgcgccgctcgtggagtacggctgccacagccaccttcgcttcttcctgtgttcgctgtacgcgcccatgtgcaccgagcaggtctccacacccatccctgcttgccgggtcatgtgcgagcaggcccggctcaagtgctcgccgatcatggagcagttcaaattcaggtggccggactccctggattgcagcaagctccccaacaagaacgaccccaactacctgtgcatggaggcacccaacaacggctcggatgagcccagccggggctctggcatgtttcctccgctcttcaggccccagaggccccacagcgcgcaggagcacccactaaaggacgggggtccggggcgcgcaggttgtgacaacccaggcaagttccaccatgtggagaagagcgaatcttgcgcaccgctttgcactccgggggtggatgtgtattggagccgcgacgacaagcgcttcgctgtggtctggctggccatctggtccgtgctgtgcttcttctccagcgccttcaccgtgctcaccttcctcatcgacccatcgcgcttcaggtaccccgaacgtcctatcatcttcctctccatgtgctactgcgtttattcggtgggctatatcatccgcctcttcgcgggcgcggagagcatcgcttgtgaccgggacagtgggcagctgtatgttatccaggaaggactggagagcacgggctgtaccttagtcttcttggtactttactacttcggcatggccagctctttatggtgggtggtcctcaccctcacttggttcctggctgctggaaagaagtggggccatgaggccattgaagccaacagcagctactttcacctggcagcttgggccatcccggctgtgaagactatcttgatcttggtgatgcgcagggtggcaggggatgagctcactggtgtgtgttatgtgggcagcatggatgtcaatgctctgaccggcttcgtgctggtcccgctggcttgctacctagtcatcggcacttccttcatcctgtccggctttgtggctttattccacatccggagggtgatgaaaacgggtggggagaacacggacaagctggagaagctcatggtacgcataggggtcttctccctcctctacactgtgccggccacctgtgtgattgcctgctatttttatgaacgcctcaacatggactactggaagatgctggccacccagcacaagtgtaagatgaacaatcagaccaagacacctgactgcctgatgaccacctccatccctgccgtggaggtcttcatggtcaaagtgtccatgctgctggtggtgggcatcaccagtggggtgtgggtctggacttccaagaccctgcagtcctggcaacacgtatgcagccgggggctaaagagaaaaagccggaggaaaccagccagtgtggtcaccagtgcagggatctacaaaaaagcccagcacccccaaaaacctcaccttgggaagtatgaactgcccgcccagccttcagcctgcgtgtgaaggcagagctggctgcaagaacaggacattcggagcccaaatgggcagcttttcttggttggctggttgttggtaaatcaaagtaaaaagaatatgtatatatatatacatgtatgtgtatgcatgtgcatatatatgcatatatttacacatacatgaagtctaccttgaggttcagaacagctgaatgtaaagggttctgttcagtttgttgcctccctgaagggtcgctcattaaggagggagcctcttgtgtaactaatttgtggtaaagtagttgattcaaccgccctccagaaaacttttgtttaggcctcaagcacacagctgtgtattcagaaggctttgctgcctgtgcataaacttgaggctggagagctcctttgtaagctaaagagctttcctggggggggggggcagccagtgagccacccaagggcctgctctccctccctcactcccccagctaggctgctgtatgggtgggagggaaggtgaggaggagaggggataaaagaggtgacaccccccccagcccaaggtctgcctgcagatcccttaaaagagagtcacttccccagccttcatagccatgtttctcccaacacagagcccacgctaccctctcaccccactgcagatctaacactggagaattcaaatggtgtgcaatacttttttttttttttttttacattttccccctctccctagcaaaacaaatgagagagagaaaaagtattttgttgtaaataaaaggcaagaaaagaaatcatctaacaaaagaatttagaggctcaagcctcagggttgggggttgggggggcgccttcagcctgatacattttgtggctttttaatggaaaccaagccagtgtgttctacacactgggactgatttgtggagaggaagggggagggggggaagccagtggagagcaccagagggcttattgactctctgaattgttaaacaaatgatttccatgagtggtcttgaagcacttgggaagacaaactttgtctccagccagggagggccatgcctgcctctgtatatctgtaatataggatatttttcatgctccactattttattaaaaataaaagacattctttagt

SEQ ID NO: 1519 - DNA, 1749 bp, Mus musculus
atgcaacacccgggcccgcgcctgtggctggtgctgcaggtgatgataggctcgtgcacggccatcagctccatggacttagagcgccctggagacggcaagtgccagccggtggagattcccatgtgcaaggacatcggctacaacaccacccgcatgcccaacctgatgggtcacgagaaccagcgcgaggcggccatccaactgcacgagttcgcgccgctcgtggagtacggctgccacagccaccttcgcttcttcctgtgttcgctgtacgcgcccatgtgcaccgagcaggtctccacacccatccctgcttgccgggtcatgtgcgagcaggcccggctcaagtgctcgccgatcatggagcagttcaaattcaggtggccggactccctggattgcagcaagctccccaacaagaacgaccccaactacctgtgcatggaggcacccaacaacggctcggatgagcccagccggggctctggcatgtttcctccgctcttcaggccccagaggccccacagcgcgcaggagcacccactaaaggacgggggtccggggcgcgcaggttgtgacaacccaggcaagttccaccatgtggagaagagcgaatcttgcgcaccgctttgcactccgggggtggatgtgtattggagccgcgacgacaagcgcttcgctgtggtctggctggccatctggtccgtgctgtgcttcttctccagcgccttcaccgtgctcaccttcctcatcgacccatcgcgcttcaggtaccccgaacgtcctatcatcttcctctccatgtgctactgcgtttattcggtgggctatatcatccgcctcttcgcgggcgcggagagcatcgcttgtgaccgggacagtgggcagctgtatgttatccaggaaggactggagagcacgggctgtaccttagtcttcttggtactttactacttcggcatggccagctctttatggtgggtggtcctcaccctcacttggttcctggctgctggaaagaagtggggccatgaggccattgaagccaacagcagctactttcacctggcagcttgggccatcccggctgtgaagactatcttgatcttggtgatgcgcagggtggcaggggatgagctcactggtgtgtgttatgtgggcagcatggatgtcaatgctctgaccggcttcgtgctggtcccgctggcttgctacctagtcatcggcacttccttcatcctgtccggctttgtggctttattccacatccggagggtgatgaaaacgggtggggagaacacggacaagctggagaagctcatggtacgcataggggtcttctccctcctctacactgtgccggccacctgtgtgattgcctgctatttttatgaacgcctcaacatggactactggaagatgctggccacccagcacaagtgtaagatgaacaatcagaccaagacacctgactgcctgatgaccacctccatccctgccgtggaggtcttcatggtcaaagtgtccatgctgctggtggtgggcatcaccagtggggtgtgggtctggacttccaagaccctgcagtcctggcaacacgtatgcagccgggggctaaagagaaaaagccggaggaaaccagccagtgtggtcaccagtgcagggatctacaaaaaagcccagcacccccaaaaacctcaccttgggaagtatgaactgcccgcccagccttcagcctgcgtgtga

SEQ ID NO: 1520 - DNA, 22804 bp, Homo sapiens
agtctcggcgtggccttctctcatatcttacatctccctccgtctttctcttacaacatcaccagtcattggatgtcaagcacagccggataattcagggtcacgtcctctcaagatccttaacatgattacttctgcagagacgtaatgtagagctttttccaaataagatcacagccacaggttcccaggatcaggacgtgaacaggtcttttgggcgaacaccatttaactcgctagaagcactcagcgagcagctctcagaaacagtggctctgaggacagcagctgttaggattgtcagttctctgcctgtctctaccctccctaattctagggagaaacttcatttactccacaaaccctaggactccctaaacctagctggggtctctcctgcatagaatttcagaatgcttaaaaataaagctgtacaaacgtgtagatatgaaaagtcgtggagtgggtgccagctttttgccattggtcgtggtggcgttttattgtttctctcttagggaaaactgtaggatggagtagaagaatgagttttctggcagggtgcagtggctcacgcctgtaatcccagcactttgggaggctgagggaggggcggatcacaaggtcaggagatcgagaccatcctagccaacatggtgaaatcctgtctctactgaaatacaaaaaaaaaaaaaaaaaaattagctgggcttgatggcacacatctgtagtccaggctactcgggaggcagggaaatcacttgaacctgggaggcagaggttgcagtgagctgagaccgcaccactgcactccagcctggtgacagggcaagactctgtctcaaaaaaaaaaaaaaaaaaaaaaaaaaagaagaagaagaagaatgagttttccatcaaaatggacagccttggtccatggtcaaaatggacagccggcccaggcttgcctggtggccctctaagcagaatccaatccctgctgaccgtggcctcttctgcctccggggtccaagccaccagcctatctcctctgaaccactgtggctgtctcctaactgtttctctgcttcactctttccctgccactatgtgtccttgatgcactagccagaagggtcctgggaagactgaagtcagagcatggctctcgtctctccagaaccctccgtggctccccatttcactcagagtcaaaatcaaaaggcccatagacgccatcatggcccgatttctttccctcccacttcctctccacacacctcttctgtcacctaccttctgacgctggcccctatgtcctgacttccagccattggccccattgttcttcctcaaaaaccccaggtatagtggcacttcagggccgtggcactggcagacaccccattatcccagcaggcacttctagaagtgccctcagctctctgcacccactcctggtgtctttgctcagtggtctccttctcatccaggccttccctgcccatcttgctaaaactgcagcccccctttcctagctctctggatggcatgagccgctcacctgccccgcacgccacgcaccgtggaacaggctgtagcacgcacatgtgcagaccccggcctatcgcctcctcctactggaaggtgaactccatgagggtgaagacatctgtccttctatcccctgctctgttttaaccatctggcaaagcaagcacactcagcgcagcacttattagaagggagggagcagaacaactattctgggactgacttcctgctggaggaggaacagaaaataaatacataagcagatgagtaagatcatcgacgggcagaaaaagtaccacaaacaaaataagagtaagactgctccgagacaaggggctggggagggggaacctgagtaggaggcagcctagtggacgcgtcacccaggagcagacatcgttcagccatgaggaggcgggggatgcagcctcctgatgtgtcagctctgaaagctaatgactgtgcctgcgtgtgtgcgcatgacatgcgtgagctgtaagggcagctccataattagattatatatgtgtgtgcgtgtatatatatgtctgtgtgtatatatatgtgtgtatgtatatgtctgtataataatatgcatacacacgtgtacatatatataacctatatatctctctatatagattatatatgtgtatagtatatacacacatatatattatatatgtgaatgtgtgtgtatatatgtatatatgtgtattatatatacacacacacatatatatgtatacatatataatctatatctcagagagagagactgacctgccagcagatgggcagacatttgtcagacatggagagagtgtctttattcctaaagttggtttctcagctgcaagggcaatggccaagcccttcccaatcttaccttacgaaacaagggtgacaggcattcagggatagcaaaacgatctttcctatcctattttgggccttagagaaaagcgtaattgtgcatttaaactgttgtttgggatgagggcagcagagcacacagctgttggaaccagtttctcttcatgctatcacatgaggctggagcctgaactatctctgggaggctgcagaaagtgggaagggagtttcagatccatgctggaagaacagggaaaggctcccgcagggctccgggtggtgtctgccgctgattcagcaaaggacttgtcctggacacggggcatgtgggagctgagcacgggatttcaggtcctgcttcacctccttctcatagggaagaagctgtccactgctcactcctggttaaattcaaggaagaagggatacacaagtgtggcagccctatagaaaagagaaagactcgtaagtgatgctattagtaagccatcttggcttccggccagtgaagacaaatgaatttaacaaagaaaagtcaactaaccagaaagtttacagaccagtgaatcccacagggctagcattatgtgccaactcggttctcagagcttactgagttatctcacttcattcctaccccgaacctgatcaagtaagtgtcattgttcccattttacagcagaggaaacagaaagaatctcagagaggttaagtaacttgcctggggtcacacagctgaggacatgggtaaaccaacacacattaatacctcccacattgcttcttccgccatttcctccctgtttgtggctccaaagaatcccttcagacaccatcacggggaatatcaacatgacaggaaagtggcagcctcgccccaggccaggagcccctgaacaaagccataaaccaagacttgatctttgcctggctccagacaggacagcagaacggggtcccattctgaaagtcaggctccatcacaagtacccactgtgcttgcatctccgtggagaggcaggaggccaggcgtaggcagctgagcccctgggggagtggaatggtgtcggctctacccccagtagccccgtggcctgggtctagtgactcggactccccagccccagttgctcctctctgaaatggaaatcttctctggaccagcttcctggggtacctatgaggaggcagtgagctgcttcctatcaaggcttaaggcagcacctgtcaaatgcttagtcagcctcggctcttgttagccttttgattatttgcttgccttgattatcagcttgtattactgtgtgcctgacactgacatgtccccaaactcctccccacaaatgtcacattccagtgcctctccttattgtgctctctccctccatttatattgcatttcaacaataataaccgctactcatcactgagcacttatttggtgcttggtattgccatcaacgcttccaagtgtgttatgacatcatcctcatcgtgccttgggaagcgggaactctgctggtcccattttgcagatgagaaaaccgaggcagagcaattagaagtggcatatctgaggtcatggggctagaaagtggaagagggggattcagacccaggcatccgggtcgtttcctccccagatcatcactgtggtgcggggctgctcaggcgtttggtgagtggctgcagattcagagctcacctaaggtgaaaagcaggaacggggttccttctcatttctttgtaaggcagagccaagctcgtgggtgtccccactctgtccctgaagggatagtttctctgtgtcatctttgcctcctctgtcacccatgcaggggccgcaggcctgtgatgagctgacccactcagctcccagaacaggcaaaagggtcccagggtgcaggagggaagccgaaagaaaacagatgggaaggggagtaattaaatcagcacatcccaaacagctaagggaggggacaaggagcaaagcaatgaagaccaggtatgaagtctgaactcacagaatgggcacgcgcttccgataagctgtccgctcaagctgtttggaatacaaacaccaaccaaaacaacacacgcacacactcttttgtgtcgtgtttctggaattctgtgatgtttcttttctcatatattcctccaaaaacagtccagtacagaattgcaggttgaagcactgtgaataggctctaggtttgccccaggttaagggttaatttgttgagtttcagaacaggtaggcgacgccctcctggattttaaacagataacgtccttgccatgtaagagcacttagaaggctggctttatctctttaaaaaaaaaatatatatatatatatacacacacacacacacacatatatacacacacacatatatatacacacacatatatacacacacacatacacacacacatatatacacacacatatacacacacatatatacacacacatatatacacacatatatacacacatatatacacacacatatatatacacacacatatacacacacatacacacacatatatacacacacatatatacacacacatatatacacacacatatatatacacacacacacacatatatacacacactatatatatatatatgattgtgtttgttgttgttgcagttgcagagatgaaaaagaaatctgtgtctttaaatgaggaggggctgcgtaaggaggcttgggcagcaaaaaggctaatacgctgtggaagagaaggagtttaatctaatttagttggagggtgtctgtctgcggtgttgttttttggagtgtgggaatagaggcgggaagctgcccccttgaatggtccctcctgagccaggagcagtggggagccagtcgacgccagcgatccaaagcccggccttgaaagaggattaaatcaatgctctgatttgcaattcacactagtgcaccccgtggaacctttggtaatatttcaaaccacatttcaagggaagtggccttaaaatagctgcctaaattgtgctggagccacactggacaccccactcatccactttaggatgggggtgcttcggggttcatttctcaccttcccccaaacctccacatctcacagccagtgtttttaggcagaattaaaacttttgcgcctgttgaattcgctgcgacttgcatggcctttctggtggtacaaactgtgttttctttgctaagtatcacttcagatcactaaaggtattttccctggagaaaaagatgggggcacgccacggggagcatgcctacttgatcagaaaacataattttttgtgcatgttttatatctgataagtttctgcagaaacttgatactagatgaggtcagagaaaacaaggtctattcacatcagacttccctgcatgtgaagcaattattggtaaatagatcagttttcattctcatacttgaaggtagaattggaaatgtcccggactaaatacaaacattgacgacacgagaagacaagagaagaaacacaagaatcacttacgtggatcctcacacttgaatgtaccaagagaggtgattcaagcagcagctaccgaaaggcgttgcgacagcctgaaccactttttatctcaacattcaccagcacgattttacttctgtttatgagctttcttcctatgccaccagtttactcttgcaattagcttgtaacatgctaagcttatggtttaatttctttctgttgctgaaagactcagtacttttttatcttaaagagattatttgggttttctctaatcccatttcagaaaacctcgcacagtgcttataatttccattgactattacataataagaaaagatacaactttgatttttagcaatatccgtgtcaaagtacttttatacttttgactttgtgagtttaaatggaatgaaactgggcctctctttcaattcccctccacctccaaaaaatatttagttcttgttcaaaacactgcctgactcctgaaatattctctctcaaaaacctcatactttccctggtgaacgtttgcaagaacctgaaggcggataatgtttactgatagctttccgatagacagacatttttaggtggttgggggtaaaaacatattccttgtctctgcacgttatgtgaaatcatgtttaattataaagtttcattaaaaatctttgctcaaaattttagaagcctaataagatttccattaatttaaacatatcactattcccacgacggctccaaagctttcttttccgtctttcatccatggttaaatatgtaaataaaatgtctaaagtcattcttcaaagaagacaaaagaaaaaagagctgagggaaagacagccataaaattcctcccaattctccataacatttgccagaggggggtcggttgccagccagggctgagcagcgggggaccccggctgctccttagactcacacatctcaaatcccacacacaggaaaaaaaataaaataaaatatcttttcagctggggccatcaaaagagccttttcatttattagttacagacttatcttccagttgctgatttctcagaaccctcatttctctataataaagtctatttgttggtttccatctcagctggacagggcgaagcacttctgcagacatttttataaaaaacgagagaaaaaggcaatctgaagtggttatagctaaaataatgggcctgaacgtggctgaattaaaacagcacagaaaagatcaattaggaggcactttctcaaatagctcacacccagctcccggcgtttggctctcactcttgcactaaatatttctaatagttgctgagggagagacacaaaaaggaaaagaaggaaaatagggcccaggaaggacctttgccaggaaaattctagaaaagccaagtgatttccgctgaattaattttaatttaaaggtcctgaaaaattactcactagacaaaaaacaacaacaacaaaaaaaaaaacactataataaaaatggcagtctttcaaaaataaaatcatgcaacttttcacttgggaaataacacagttgaaggtggtgttctaactgcccggagtttctaccttctttttcactttctccctcaccccgacttcctccagcacctcctagtgagacccaggacacccagggacagcgacccaggggtgggtgcctgaacctgcctattaattctgggattctgggcgctcaaatgtctgttgaacggatgaatgaatgagtggaaaggtgagatttccccaagtttcttaccgatgtaaaaattgtagggcttgttttaattaaaagccaatactctccgaggaagtggccccctcctgcacggcgtgcagaaagctggtcagtgaggggggttcctggcgggccccatctccttcccgggcgcttcctagggagaccttgccccgtgcgcagcgtccccaccgcgggggcccgtgcagccgccccccacgccgggtggagcgccgccaacgcgggaagccccagcactgcctccaaagatgtccgcacactccaccctgctccctggaactatcctcaaacgggcagggggcaagcgaggccggtggacgcgggactcgctcctctgacctctccccggccccccgggaggtagcgggagattgcacacgcgatcctgcgagtttccgaactttggaagatcgtgacccggagagaccctgggaggagagggccggccacctcctaggggtgctgtttttttaagggtcaacccaggacgctacgggaagcacctggcgcatccttgggaacagtggggcttggcggtgggcgcccaccgcgaacgccctgggcgggggaagggaatggcggggggacgtcgtgtcctaagtgaccccgtcacagacccgccccaatccgaggggggatgagctcagaggacctgcccaggacgctccttctccactttccaggaaaaccgagcggcgtgcgcgcctccgtgtcctcgcgggagctgggggtccccgggcaggcgctgacgcgctcctcccacgacccactccatcccaccctactccgggtcctcctgcggggctgcagccaaggagggcgctggccgggcacatcactcgccaaatcacataaataccccacgagcgaatgacttcctataataaataaactcagccgccaagaaggcatctccagccctgctggcgcgaggccccggctctgcggcttcggagggggcgggggtcaccgcggtacaaaccaagcccgcacttcccgcggggtgggaggcggtgttcaaagtcccgggacgcttcccgcccctcccccttcccgccttcttagaggagacctcggatgagcggccctaaaatccggattctcgagcccctccccctccccttagctcgtctctttgaaatttcaaagaaaatccctcctcggagcccggagcccggggctggtagcacctccccagcctcaggaagatgcgggcaggtttacaagcaagggcctactttatggcccaggctataaaacgcaaatcccacctccctttgaaagcgccctccgcccgggactcaccataaaaggaagagaagatgcaccccgcgcccctcgccgcggaccacccccaaaccccttctcccgccagtccccgaacttcccgtaacctcggcgtcctcggggtgccggggaccatcccggggaccgccgggaaagggggcgccggcggagaggatagcgagaggcaaagttggaggccaggcagagagagggcgaggagaggcgggcgggactgccggggagggtcgcagcgcgcagagccccgcgcgccaggcgggctgtcccggggctggcgggcagacgcgggcgggactaggcgctgcgccccccgcaggctgggctgcaggccgggggggatcggcccccgcggggcccgggagcccgcggcggggcggcggggaggaggctgccccgggccgctgcgctttctcatgcaaagcagcggcggtgcggggcgcgcggcccgggggcggggcctgtcagcgctcggcttttctgcccccctttgcctttttgcgagtcttctcatcccgggacgcaaacctcgaaacagctgccggctggtcccggccgaggccggcgcagggagggaggagccgcccgggctgtgggggcgccgcgagctgggccggcctcggtgtgcccgcgccgccagcccgctccagacgcgccacctgggcgctccaagaagaggccgaagtttgccgcggccgtgagttggagctcgcgccgggccgctgcgccgggagctccgggggcttccctcgcttcccggtattgtttgcaaactttgctgctctccgccgcggcccccaactcggcggacgccgggcgcggagagccgagccgggggcgctgtgcgcagcgctcgggccaggccgggcgggcatgggcgggggcccgagcaggggtggagagccggggccagcagcagcccgtgcccgggagcggcggcgctgaggggcgcggagctccccgcgaggacacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttctttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccgtaaatatacatctgtgtatttgagttggctttgctacccatttacaaataagaggacagataactgctttgcaaattcaagagcctcccctgggttaacaaatgagccatccccagggcccacccccaggaaggccacagtgctgggcggcatccctgcagaggaaagacaggacccggggcccgcctcacaccccagtggatttggagttgcttaaaatagactccggccttcaccaatagtctctctgcaagacagaaacctccatcaaacctcacatttgtgaactcaaacgatgtgcaatacatttttttctctttccttgaaaataaaaagagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttccacaaacagatcaggaagcactaggttggcagagacactttgtctagtgtattctcttcacagtgccaggaaagagtggtttctgcgtgtgtatatttgtaatatatgatatttttcatgctccactattttattaaaaataaaatatgttctttagtttgctgctagtccctggttcatggtgaggtttcccttctctgtgtgtggagagactacaggacactttctccctttgctttttaagcaaattctggggttgtgcttctagccagagagtactggttatctgtataaaattgcagatcagaggattccaagattggaagaatcattcacttgtgagtttctgaggaactgcagtcaggcaatgtgtgaagttggaagtcgtttctgtgactgttggtagctggacatgagggcttagttgtagacacacatcaccaaggagagcctcaccactaagcgtggacccactcatgagcctggattagccagttttaatatattcagagagtagagccaaccgattaggagaattaaatcatctgtattcaattgacctgctaggctcaaatggtacctagacagagctgtatacatcagcccaaagtgtgctggctttgcagtgactctgaactatgaagacatttacaaaacagattatagacctggacgggataaaatacctgctaagggtggcgaatccttaagaggaagttaagcagctttggaacttcatggtacttggttcttctccagggtttcctgttagaactgggtagctgtaaagaactgccccaggtctgctggtcaaaggcacagctacactcaagttccagccagaaggaagcaagggcacagtgcagtcctactgtggtgaggactctattaatataaagcaagccaagctgcccctggggccatgcttttgtccagctccaagttaaacaaggagctctggaaaacttggagcatggatgacacgcttaccaacgaggaggagagcctggagctagtgcagtctgttttctgaagagggtgttcagaacttcagcctggtaaacataagatcacccatcaacactagggctggaaacaggcttacattggctttgaggggctactgcacttggccgtgaatatttgcagggcacaggagcaggcagatcggtggtttgggatcaagtttgacaaacggaggaaacaccagctaggtaggcaaagtaaaagaatgcaagatcccaaagagctttcagtgcattaaaaaagaaggcagaaaagcttcagaaatgcccccaaataaaatttctttgttgattgttttcgcctagtcccccaaaagactacatagaaatattgatgtctctgtgcatgtatgggtatagcgtttcctttttgtcactcttagggaaaatgaaaataacatatttggaatagaactttcaaaaagtccagaagggtaacattgtccggatgctgctgtgagccacaaggctagatataacacaaagacatttggttctaaaattcctggactacagcagcttcagacctgcccatgctcaggtgtgtaggctcgaaaatgtggtcccaaggaaagtcatattcaacaacatacctaagagcctttgttgttagttatccctgaatgtgtctcactgtggatccatcccagaaatgactgatcttgtttacgaatgtgaagggattgtgacatgtggctgggttgggcgcagctgggtgagtttaacagtgagcagtgcaaggagcagctgtagagcttccaagcaaaatgctccaaggtcttcctctccctctctctctctcttcctctctctctctctctctctctctctactaagctgaaatctgaccctccctcacatacagacagtgagttttaggagaagcatcaaggccttaagtcagaaagctggggaaaaaaagaaaggaaagaagggagggagagagggagggagggaggaaagaagcaaggagaaagaaagacaggcaaacatcactagtgaaggaaggaaggaaagaaggaaagaaagaaagacaggcaaacacatcactagtgaaggaaggaaagaaggaaggaagggaggaaagaaagaaggaaggaaggaaggaaagaaagaaggagaaagaaagaaagacagccaaacacatcactagtgaaggaaggaaggaaggagaaaggcaaacacatcactagtgaaggaaggaacgaaggaaggaaggaaagaaagaaaaagaaagaaaaaaagaaagaaagaaaggcaaacacatatcactagtccttagattctctttagctcagtacagggtttccaaaggaattgttgacagcattaatttggagatttctcagcatctgtaccccacggccttagttttagaaaaatggcaacctgttttgcatggcagtggtggagtcatagaagaagcccaaagaagtagattgtccaagatctacatccattcatccctcccttccttcctccagcctccagccaatcaccacccaccacatgctaaggccgagaaacagaactggtacctggtctgtgtgtggttttgcagtggacaggagagacctgcatggcacatcttatatgcgcctctgtgaggcatcagggcaggaggcccaaaagtagatgtatttccacagggcccctaaatgcatacaaggcagaagattcagcctatgtgaggtcatagcaaggggaagctgcagggtcatatagaaggcaagagaagttatcaacagagcatcaaaacattccatcgggacccagactgggtctggctcatgatcccctatgtaagcccacaccttgcagagggctttggacgtagtaagaataactacaataatagcaatggctgtgataatagtaatcgtagcagcacagccttgagaccacttgctgtgtgctgaacaggctgctgggactatctcagtgaatcctcaacgcattcagggaggtactgtcatcagccccactttacatgtgaagaccctgacacagagaggttaagtaaattcccagggtcacatgacaactaaaagacccagaacaggaactgggtggtctgataacagatctggaacccccaattcagtaagcaattgttgaataaatgaatgaatgaacaatagctgaccactttacatgcattaattcaatcctctgacaaactttggtggtactgctctcatgctcataatattacagacgaggaatttggagcacagagaagttgtgtcacttacccaaggtcacacaggcagcaagcagagagtctggcatgcaaacctgggctgtgggactccagacctgcacctctgaccacgaggctttcccacgtctctggtttctcaggacttgactaaatcatttcatcttcacagcagcactgctgcacctttattccaagcaaaaggggaacaaggttgcatggcaaagagcaaaagccacttggccagtgtgggggagcccaagggaggaggccgtggcaacctgcatttttgcagcagtcgcgagggtgctagcagtggggctagggggaagcaggtggatggagaggtccttagaaggtagaaccaggattaggttttatgtagagagggagcaagaaggaatggtcagggaggaccacaccatttctgactttggtggcaaagtgacattcatcaagacaggagaaaaccaacagaggacaggcagtgtgatgggaagcaaagatgagtgcagtgtggattatttgccatcgaggtgtctgtagagaatttgggatgaggtcatggtcacaggcgggtgtttgaaatggtgagagttggagctgtggttaacctcaggaagcaagtgggtctctccagggacagaggagggaggagggcagacctcagggccaggtgaacaaagaggaggttgcaaggggagctgtgactgggagcagccccttaaccacttgggcgctgggtgcccatttttactataagaggattggcagaggagattatgcaaatggccttatccaacgtcaaaatacgtgatccggatagcgctaagggggaatgcagcaagggtcttacaggagtgacttaggaggatccactcctgcccgtgataactcagcctctgtatctttaacttaacccttgggctacccgagcaaaattaaaatcagctccaagagctcatagttttaaattctccactagcatctttggggatgctgtttcaagacagagaaacagaagagaaaaatcaagaagtattcctgaggccatagatattatcctacattctagattattttctcagaaggaggagaaagaaatacagaaaacgataacagattggagtgcaaactggcatcttacacttaaaggatgtgcagatataaacatcgtttaggactgaactatatcttgccttctctatgagctggtttttagtttgactcaaccacttacacattgcttcaccttgagcaagataccagaactttcctgcctctgtttcttcatctgtaaaatgggcatgataatggtacctatctcactggactgtcactcacaaatagctcatgcttattgaacaagtattacatgctcgattgctttaagttctctgtgtttattaattcatctactcctcacaacagccctaggagagatggtacgagattaaataaaaccatttgtgtgaagtacttggaaggctgcttggcgcagagcaaatgctcaataaagtgatctatttttatgttttttgtccctccccccaaagaaagttaaatcctgtaagctaatgagtagggctctttaaagaaaatgagtttttttcttacagaaacactttttccaatactgtgttcaggttccacagaaaacccactgatctttcaagtttaaaaggcaggcacagagcctctacagcagtgaaaaatattctctgtctttccctttgaacacaataacatcacagctgacttcccaggaaatcagacctcatgcacggacacctctatacgcaaatggataaagatggctgtaatatggaaatgcagagaaacggtcagacttcagggaagctcgcgaaacacgtgcaggcagcatagtgtggggtgttttttaatgttttattaagagtgtgaaggccaagctggagggaggagggaaggagacgtttgaaatctgaaagaataagtttcagctgccgaggtgagctgtcgtaattggggacactcctaggaaaatgacactgttggatcccacacaatgtccgcagcccatccggacttccccaaagtcagtgcctgtcgctttgttattctaagactttctgaatgtttctgtttttatatacattgtttggtaccaggctgccctccaggggcctttggtttataggaagggattcataacagcaacccttgccacacgcccatctccttcccagatgctgggggcttcaggggttctgtagatgggatgggatgttcccaggtggtctcttgcaacagatgtcctcaaaggatgcaatttgtggcattttagggaatacttgcacttaaaaaaacatctaaaacctatcctaacaatgttttaagtattttaggcagaactacaaagtgatcgaccttgacatgatgaatcaacacccattttccaagggggcgatggtgatcgggagctgcaggtgctgactttgatcagaactgacaagctcatggggtggtgcagctctctccccaccccagccctccccattccacccctgcccccagggcagcagcacctgtttacctcccatgctctccctgcactattttcgcctctcataaaacacttggatgttgttggctctgaataagatcattcatctgcgaactgcctctcttcctgcagctcatctgaaacagtcttattgaacttgggtcaatatcacctcggtttctttggattccaggatcacagcagaaggctcaaatttgaactaaactcagaagcattttaggtcagcaaaactttttttttccccaagagactttaagtattaggaatctaagtgccaccttacttttccacacatggcacagggtaaagagaacatgagatagccatgaagaagttgtgattctgatttgctatcatgatgacccaggtctaagaagacagaacaaaagcaatgagaacaagagaacacggccaattataacatttgacattcttccatggcagtcatgattgtaaccattttcaattaaaagaaaaaacacaatactacagcaatgttctgagctgaatcttatctcttgagtaaacagagggcctctgagcaaaaaaccatgcaatagaaaggaggcatcaaaagaagttggaaatgtagtatttttatttttaactcacctctaccttctaaaagctttattctttccaagacaaaaagcttcacgcatgtcccaggggatgagccaagaaaaaaaaaaatcaggtaaaataatccctctgggtcaggggcgtgcatgtcactcggtctggtcagtgagatgtgaggggagctttcctagtgagacaaaaaaaaaatgagggtgtgcgtgtgggagtgaaggaaggttctaataaaagattttgcttcatgataaaaaaaaaaaatgatgaggaaacctgtccttttcttctgcacacaatgtggtgtgtgagaatcacatatggagctattgcaaccattttgtgaccacgaggcaataagcccaacaccaaagccaaaattctgagatggcaggtaagcaagacagagccagcctcgtgagcactcattaagcgactgcacccccaggattcttgttatgccaagtagccaacactgcctggatcccctgagagttgcaggttgggtgttctgtgcctcttaggaaaatacacctgatgtggcaaatgagtcccaggtgtctcaaaccctactgtgcacacaaatcactggggctcttgctaaaaggcagctcctgattccttaggtctgggtgggaccccaaattctgcatttgtaataagttcccagttgatgtcgatgcttctggtgctcctgacccctttgagtgaagaatctatttggccacccaccagaagttcagaacgaccccacttactcctggctgtaattatatgaacacatcttgggcatcacttcctgggtgtcctgtagtggactagctgtcaattaaaacaatttcttatgttgagttaaaatttgcttccttgtaactattttctattattatctctacttttgccacatagagcttcacagagcaagtctacttgtttttccatgggaaagccacttatatatgggagcttatcacaaatgcagaatttggggtaccacccaaacctactgactcaggagctgccttttagcaagagccccagtgatttgtgtgcagagtagggttcaagatgcccaggactaatttgctatatcaggtatattttcctaagaggcacagaacacccaacctgccaactctcaggggatccagagagtaatatgtgctccctggatctttctttttattcttaaaactgttgcccagataacttggtttcatcttgctggctgtcccctgaatgtgtttaccatggtctcaattcttgtcaaggaagaatgtgcccaagtaaagacaaatctccaggaagcatctaacaaggagtgggatcattagacacccagcaaatgttatacaagataatgggacactaaaagcatttttactaaaaccagagacaaaacaaggctatctatgattactggtcactacccggaacatgattaaccctgaagtcagagaagaggaaagaaaaaggaaggtaaaaccattggaaactgtcattatttgcagctgttgtcattgaaaagtgacttagctggaaatagaattgatgagattttcataaggagaccaggacaaaacatagctacaaaaatcaatagcatcctcatgcaccagcaggaaccagttgaaaatatgaagaaaatttaagatcacttatgcaatgcctacaacaagcacaaactatctagaaattaacatagggggtgtgcaagccttttggaagacaatgtgaagatgttactgaagagcataaataattggctcaaataattggaagctcatgtcatgtgcctgtaaatatgtcaattatccccaagttaattcctaaacataatgcaattgcaactttaaaatatgtatttctgtggaactccacaagatgatattaaatccataaaatttgagcagtagtcaaggaaaaaaccctggaacagggataagaaaggacataatctatcagtgaagtacactgtgagtctgcagaaacagacagcatgggccaagtgttaaaacagacaaaataatggaacaaaataggaaatccagaaagagtctcaagtgcatttcaaataaataagaaagaatggattacgcagtcaatactgttgaggcttagtttagatgtggggaaagtaatattccatccccacctcatgcctttcaccaaaatacatgttggattgataaaacatttaaacataaaaataatacagtaattaggggaaaatgttatctaaagttttcattcaatagaaagaaattacaggtaaacattttttataaacttatcaggaaaatgtcttcttagcatgacatcaaagctaaagccattttttaaaaatcataatttcactacataaaaatgtaaaattctgtaatgtaagaaatcagttaatttaaaaaaaattgcaaaatctccataaacaaaattaaaagacaaaaacttaagtttcttgtctgggtctatgagtaggcaattcaaattagaagaaatgctagtgacccataaacctgtggaaagttatttaagctcacttctaataatccaagggtgcatgcataaaaaaatgattatttgtgcctaacaggtttccccgttttttttttctttgagacagagtctctctctgttgcccaggctggagtgcagtggcatgatctcggctcactgcaacctctgcctccccagtttaagcaattcccccgcctcagcctcccaagtagctgggattacaggcgtccaccatcatgcccgtctaatttgtttgtattttcagtagagacagggtttcaccatgttggccaggctgcttttgaactcctgagctcaagtgatccgcccgcttcggcctcccaaagtgcgaggattacaggtgtgagccaccgcgcctggccagcttggtactttttttttttttttaaagcggataatacctggattttgctcaggcatggagaaatggactccctgtatcacagagtggaaccataaagtagctcaccctttctggagaacaagtgtgatgtgtacctagtgccgtttgcagtatacatgtcctttgacccagcaattccacttccaaataaatgttgtattgaaaattgggaacagtctaaatatataccggtaagctgactattcaagccaattatggaaaatccttaaaatagagtaacatgtagtcattaaagtaattacgtagaaccgtgtcattaacatgggaaaatggccacacggcactgctaagcaggctgatcttcagacaggacggaccagggcagcccttccagtttgttttgtctggtgtgtttttgaatttgtccacacccctatgccaaatcagttgttgaacatttcaaatattgccctgttgttactacacaaagcaagttatataattcctgaataagacaagcctgggcaacacagggagaccctgtctcaaaaaataaaaagaaagaaaaggaagagaggagggaaaggaaggggaggggtggggaggggagggaagggaaggggatggggaagcaaaggaaggccgggtgcagtggctttcgcctgtaatcccagcactctgggaggctgagtgggcagataacttggggtcaggagtttgagaccagcctgaccaacatggtgaaaccccgtatccactaaaaatacaaaaattagctgggcatggtggtgggcacctgtaatcccagttattcaggaggctgaggcaagagaattgcttgaacccag

SEQ ID NO: 1521 - DNA, 2811 bp, Homo sapiens
acacgtccaacgccagcatgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtgaacagggctggagggaagggcacaggggcgcccggagctaagatgtggtgcttttcttggttgtgtttttctttcttcttcttcttttttttttttttataaaagcaaaagagaaatacataaaaaagtgtttaccctgaaattcaggatgctgtgatacactgaaaggaaaaatgtacttaaagggttttgttttgttttggttttccagcgaagggaagctcctccagtgaagtagcctcttgtgtaactaatttgtggtaaagtagttgattcagccctcagaagaaaacttttgtttagagccctccgtaaatatacatctgtgtatttgagttggctttgctacccatttacaaataagaggacagataactgctttgcaaattcaagagcctcccctgggttaacaaatgagccatccccagggcccacccccaggaaggccacagtgctgggcggcatccctgcagaggaaagacaggacccggggcccgcctcacaccccagtggatttggagttgcttaaaatagactctggccttcaccaatagtctctctgcaagacagaaacctccatcaaacctcacatttgtgaactcaaacgatgtgcaatacatttttttctctttccttgaaaataaaaagagaaacaagtattttgctatatataaagacaacaaaagaaatctcctaacaaaagaactaagaggcccagccctcagaaacccttcagtgctacattttgtggctttttaatggaaaccaagccaatgttatagacgtttggactgatttgtggaaaggaggggggaagagggagaaggatcattcaaaagttacccaaagggcttattgactctttctattgttaaacaaatgatttccacaaacagatcaggaagcactaggttggcagagacactttgtctagtgtattctcttcacagtgccaggaaagagtggtttctgcgtgtgtatatttgtaatatatgatatttttcatgctccactattttattaaaaataaaatatgttctttaaaaaaa

SEQ ID NO: 1522 - DNA, 1746 bp, Homo sapiens
atgcagcgcccgggcccccgcctgtggctggtcctgcaggtgatgggctcgtgcgccgccatcagctccatggacatggagcgcccgggcgacggcaaatgccagcccatcgagatcccgatgtgcaaggacatcggctacaacatgactcgtatgcccaacctgatgggccacgagaaccagcgcgaggcagccatccagttgcacgagttcgcgccgctggtggagtacggctgccacggccacctccgcttcttcctgtgctcgctgtacgcgccgatgtgcaccgagcaggtctctacccccatccccgcctgccgggtcatgtgcgagcaggcccggctcaagtgctccccgattatggagcagttcaacttcaagtggcccgactccctggactgccggaaactccccaacaagaacgaccccaactacctgtgcatggaggcgcccaacaacggctcggacgagcccacccggggctcgggcctgttcccgccgctgttccggccgcagcggccccacagcgcgcaggagcacccgctgaaggacgggggccccgggcgcggcggctgcgacaacccgggcaagttccaccacgtggagaagagcgcgtcgtgcgcgccgctctgcacgcccggcgtggacgtgtactggagccgcgaggacaagcgcttcgcagtggtctggctggccatctgggcggtgctgtgcttcttctccagcgccttcaccgtgctcaccttcctcatcgacccggcccgcttccgctaccccgagcgccccatcatcttcctctccatgtgctactgcgtctactccgtgggctacctcatccgcctcttcgccggcgccgagagcatcgcctgcgaccgggacagcggccagctctatgtcatccaggagggactggagagcaccggctgcacgctggtcttcctggtcctctactacttcggcatggccagctcgctgtggtgggtggtcctcacgctcacctggttcctggccgccggcaagaagtggggccacgaggccatcgaagccaacagcagctacttccacctggcagcctgggccatcccggcggtgaagaccatcctgatcctggtcatgcgcagggtggcgggggacgagctcaccggggtctgctacgtgggcagcatggacgtcaacgcgctcaccggcttcgtgctcattcccctggcctgctacctggtcatcggcacgtccttcatcctctcgggcttcgtggccctgttccacatccggagggtgatgaagacgggcggcgagaacacggacaagctggagaagctcatggtgcgtatcgggctcttctctgtgctgtacaccgtgccggccacctgtgtgatcgcctgctacttttacgaacgcctcaacatggattactggaagatcctggcggcgcagcacaagtgcaaaatgaacaaccagactaaaacgctggactgcctgatggccgcctccatccccgccgtggagatcttcatggtgaagatctttatgctgctggtggtggggatcaccagcgggatgtggatttggacctccaagactctgcagtcctggcagcaggtgtgcagccgtaggttaaagaagaagagccggagaaaaccggccagcgtgatcaccagcggtgggatttacaaaaaagcccagcatccccagaaaactcaccacgggaaatatgagatccctgcccagtcgcccacctgcgtgtga

SEQ ID NO: 1523 - DNA, 20450 bp, Mus musculus
  misc_feature (11023)..(11084): "n" at positions 11023 thru 11084  can be any base
gggctctgctgtgaggatggaaggaaagatgaatatttggtgactcctttgagactctgcccccagtacgcttttctgcttctgatggtcttcatttccacacactaggacatgcacggtcactaccatagcccagttctcatactgaaagtgaggatgtgcactgtcggggcagtggcaagaagagtgccttcaaagtgagagtattctgacagtcccaggccactgagatggccacacaccatggatccttcctcacaagttcctatgtgtcctctgagctggcccaaccctaggaagaatttgcaacagcttgaacccatcacgttttgcacacaaaacctctgaccccttcatctggagttcattgattcaaatgggcgtgaattggggcgaatgggatcagcccacttcaaaggtgttgcagagtgacaggccactcccactgtgatatgcggcagttcggcagcagactccaacaccgagtctttcccttacatcacctgtgataacgatctagatccacacattttctctccttgctcactggatccttgtgataatgtgaattaggcagaacacatccatcctgtagccatggaaacctgagacatcacagtgatttagtagtaaggctaggacttgaacctaccactctcaattcataacaaggccctttaaattgtaatgtgtcatcaaaatactcctatctggggccctgggagttggaaagcagattcagggcagaaataagacaggatcccacacagcctggggcccccaattcttctgcaattgagcccctcatactcctgggtagcatgcaggcatcccccaacagcctccgtataaatcacaggaaggaggaataacgtttccccaggattgccctgagaaatgttttcttttcccaggggatgtattggacacaagataaagggctagggtagaaaacaaactttgcaaagccgtgctgggcatttgtgcttgctctccctgccctcgctctcccctccccccacccacgtgtgggaagacacaaggttcccttccatgatctcccttctccagggatgatcgtcctggcagcccaggtctcaccggcattctaaatgcacaaagccctaaatgttgctatgggtgacatcaggaaagacaagtcttgaggcaggtttcagagcccaacccagaaaccagagtgtgtgttttatcattccctatcactgtcttctgtgaccacacacctgacagaagtaaccggaggggaaaagttagtattcttactttttctgtgtatgagtgttttgtcagccgtatccatgagcatcaccggcatgcctggtgcccttggaggccagaagtagtagatgccctggaactagagttacaggtggttgtgggctgccgtgtgggtttctgggaaccaaacctggatcctctgcaagagcaacaagtgttcttagctgttggaccatctctccagtcctgggacaatttacttgatttaactcagtcttagaggttcctggatgctcagctctttgtatacgggagaaacatcatgttggtggggacatgtgacagaggaaggtcttcaccactcagtagacaaagaatagaaagagacagaaatgatcagagcaaagacacttccaagggcctgtccccttctccaggatttacttcccccaggtagtgtctcccatagtttccagaatcttccaaaatagtaccagcaggtggtgacctagacttagcacttgtgtcacagggccaaaccacataaggtagaaatctttaatcactgacccacttgccatcagggtcaaaggcagtaaacttggtcattccaagcttgttctagcctggcaagatgcaggtagtaccttgaagtctgatcaaagacaccattcattctgtccccacagcccctcaatgatgcctgcgagtgtcaagagagccacagttgggctctggaagagtccaccatttgtacctttggcagtcaacacacaaccatctcatgtcccctattgcaagaatgcccagagagtgcatctctgcttcccatgagaagccatctctgatctgcccagtacagtgaatgcccctctctcccttttgagcatactctgtcttcatcatttaatctctttgtttgtgggttcctgccctccatactaatcatttcaacccacatttgccactgccccctcaccacctccttgcaaccaatgtgaattcctcacgggtgcctagtgtgtgccttccctctgggtgtttggcacagtgaccagcacacattccatcaccctatgcttggggtatctacttgttgatccctaatgtcctaactcagtgaactgtcatacatcctcagtgcaccaagcatttggcaaatatacttttattgttagtaattgtcccaacaatacaaggaaggagtatcctttttattttatttcttatttgtttgaaacagagtcttactatgcatccccagcaagcctgggtctcactaggtagagcaggttgtcctggaacgctcagagctctacctgcctacctttgcctctcaagcaatggagttaaaagccatacacatctgtatgcatggggtatactttttaaaagacattctgctcactgtgtttgtgtgcacaggcataccacagcccatgcaaagaagtcagaggacttcttgcaggaaccagttctctcctttcactatagagtccaagagatcaaactcttagtcttgacagcaagccccttttcctgcaatgccatctttcaggtttacaagatgtaaccttatccctgctccagggcaaatgaataagttatgtgataaattaagcgtttgccagtgccacactgagcccaagtctggaagtcagtcgagtctaattattaaagtggggcacaacccagagcagtgaacctaccttctgccaacactcagtttgtagcaagaccgaaggctttcacgctcccaaccacttctcacctcacacctcctgcctagactgggccgtctttctgatgcatgcacctccatgggtcttcagactatgctgtcagaagagtactggtcactgagtatggaaagagtcatttcaggacaacaggatactgtcacctctgtcttcttgtccaccatctcttccgcctcctgggctgggaccattggtaaagagtgccatcctccagtaaatggaatgttcctgttattgcttgtagagtctcaaaatggtcatgccagagaactctccaaaccctctgagtgctgtatgcactgagcaatgcagaccagctgactgctgcttcctcccaatacccacagggctacaacaagagaagaaggcgtggcaacaatgctttgggggtagagtctactgagtgcccaggaggaactgcttgaggccccactgacctgcattttgcatccttctgtgccacaccctgtgaagcaaagtcttcccctaacccctggactgctgttttcctgaggcttgtgcaggaagcagtagaatttgattggagggaaattacggtggaaagagccaatctgagcccaaggtgagtaagtggctggtttcagatgtgtgagtacctcagtcttcagctctgtaataaaggcataaaggctcagcctttctatgctcacagttcatctggaacacgaatggcaggttagcactaatttccatgaacatcagtgtggagatctttccagaagtattcacagcacttctggtgacttctcccctgtttgtgttggcttgcccatcacggtgacaaaacaagggaggctaacaacttaaaagaagaaacactaacaacctggatgtggtggtacccacttgcaatcccagcttagggagcccaggcctgggccaagagcattgtgagtgtgaggacctgggctacaatatggagatcctgtctcagcatgaaacatgaaaagtgaggagatgcaggatatgtattttggctcttgcatttataaattctgtccatggatgatggctagttggttctgttgcttctgtgggaggttggaacatcttggtagggaccaagtagcagaccaccctcatggagagtgggggccgggcaccctttaagggttatacccccaaagagccaacttttcacccattggcctctccctgtaaagattccattactacctatcagtaacacagactagggactaaaccttcaacacagggacctctgggaacacccaagatccaaactacaataccatcttatagtaggatatgctcaggaaatgaattataaagtcactctccataaaacaggattctgaggaatctgtgaagacaacacacggttggatttccaccctgaaggaaatctaaaggtttgtttaccataaagatatgaaaatgaaataggtggtcagggagatgactcaggtaaaaagtgcttgcatggcctgagttcaaatccctacatacacacatacaaaacctgggtggtgtgggacacatctgtaatgaaatgctggggaagcagaggcaagaggatccctgaagctcactggctggccagcctagcccacttggttcactgagagatcctgtttgcttgcttgcttgcttgcttgcttgcttgcttgcttgcttgcttgcttgcttgcttgcttgtctgtctgtctgtctgtctgtctgtctgtttttaaggacagggagatgactcaatgattaggagaactggctgttttcccagaggacacaggttccatccccagcatccacatggcatctcaccatcatctgtaactccagtctcaaggaatccagcatcctcttctggcctctgtggacactgtgtgcatatggtgcacagacagacacacagacaaaacattggtgcacataaagtcaagacaaataagaggaaaagaggccgaggaagaacctggtgttgacctctggcctccacaggctcatgcatgcacacacgaaaaggaactgtgcttggatgaatggtcaggcataggaaataaggttcattccggagatcgtcttgcttcatctggatccccacgctcacacccatcaggatacaatacggttcccatgaggtatgaaaggctggaactgccatcctcattttggcaggcttgcaaactgagactcgagaacaataacaagctttgccaaaaccatatcccaaagtaggatggggttaagataaacactagtcagggcttcatcccggacttcaggccacatgtgtaagttactgtgagctcagaactttgacgtcccagctcctaataaaacccagaagcccctgctcacagggcataattagaacaggaagaagccactgaaaatagatcctgggagtttttagagaacagtgagcgacaagagaaactatatacaaattgtctaaatatgcactgaagaaaatatcatgtgggctatagttctttgctatgtgcaaacatcttaggataaataatcaagaattgactcatctacagatcatttttcctgctcaatcttatgactgcttatatggttaggtttcgcctttggaagcagtccaatcatcccttcatcgggtatcccaagggctctttctccatcattggctgaggtatcttctgaattctaaagccctctttcttaactcccctctgtgtgcttcctcggtactctgccagctccttcctaggggtgactatccacacgattacagcaatccccaggcaatgtaaggacccacagcttctgaaggtatctcactaagaggatgacatcatgttttacaaagataagtccattcataagtgtctggctcactgatatccttagcttgattcatccctcagggcttggggcaatgactttttacgtgacagaggactatccctcgcttgtcttttgatgcctagccagcctgagggaggctcagggtcactatcattatcgttagtagcaacatctgtattttgagacagggtctcatggggcccggactgaccttgaactcactacataatgaggatgatattgaacctgtttctctttcctcctcctccacaggctagggttacatgctctgcttattcagtgctgggggtggaaccccagggcttagtgtatgccaggtaagttctccaccaactgagctctatgcctagccagcttaaacacttttcaaaaaggcaccagcgctcctgtctacaggtctcacccacatttgatcctccttgaggcctgaacaacttcttgttgcaggggcaacctgtcctgaatccccagtattctctgaaaactctgtgctccttgatgtcatcactgtttccagtagttgccctttggggctggagagagagctccgtggatgagagagttggctacacaagtgtgaggacctgagttcaaatcccccagtgcccacatgaaaaaccatgggtggccatgtgtgctcttgtaaccccagtactgtggaaagtggagattagaggacatcaggagctcactggccactagcttcagactcagtgagagatcctgacacaagggaatcagatgctgagttgtagaacaagacacatgaactatacctctgctctccatgtgtgcacaggcacacacacatgtgcacatatactacacacacacacacacacacacacacacacacacacacacacacacacacacactgtccatttgtgcctcctgaaactagttctgcacagtagggtgagggaggacaaatcccaggccaaatgatggctcttctccttcatctctcattctttccttcttcaccccacccactcactaattcctgtagttgtccatacaggagatacttgggcagtagttagcgttggggtgggttgtgtgggcacaatgtaacagccacccctaaggaactgagagcagagtgggagaaatgatgaacacatgtgttgatggtggctgatttcgcacagttagattattctttagtccatctcctttcccctcccaagcatcctccagagggaactggaccactgatctctgacttacagagtcagaaaagctgaagcccacgttggttagctggcatttggatagtccagatcctccttacccagtgaagtattgtttctggaacatttctttactacccttcgcaaaaataccaactgtattcaggtgctagtaggaatgggtattgacacatgctatgatcggcttgggtacctggggacacgatgctgactgaaggcacacataggcccagagctgtggctgaaagtcctgtgagaagctcaaagtgaatgattccagtactggaagccatcgggatgtcccctttgtgcccgcccttcccgatgtgtcctccaaggaaaggagaagaaactagaataattggttgctgaagtcaaacatggtggtacacacctgtaatcccaacacgccagagttagagatggagggatgataactagcctggactatacagtgagtatgattctagcctgggctacatgagtcattgtctcaataccctctttctaatataggttcttgatactgtgagctatgaaagtgcttttctgtgtgtggtgtacatgtgtgcttgcatgtgtatgagcacatgcatacaaggccttaagtcgatgaccaggtgtctttcctggtcactctccactttactaactgaagaagggactctcacccaacctggagctctctctctgcacttagcacaactagcagcttgcctagggaatgccttgtctctccctcaccagtacagggcttacggggcaccacacctgcccagtttttatgtggtgactaaggatttgaactctggtcctcacacatgcctggtaaagactttacccactgagccatctctcctgcccctggaatgttttcaaggctctttaaagagctgagagtgcattgctcgcagacctcagacatctgttttggtcttgtgatgatttaagccccagcagcaagcagacccaaagcaagcctgtggtgggtgagagagccttcacactatgagccttgcccccgccgcaactgctgctgagccaggttccaagggggctctcccagaagtcctcagtgcacagggaacagtggacatctggaagcggttagtttcagtccagcctggaggccggaggatggactaaatgacccctgcaagtcaccctctgccatctgcctctccggtcaccttccctcatttccagcaggctggctttctctagggaaaaatgaatccagggctctagcttcccttgggagtcacaatgatttcattctccagcctgtggaatctaagttccatgagacaataactctgggagaaatggggaagaagccggaacgacacatactgtatatatttagactcgtctagcaacacgtgctcctcagagcaccacatgcatgggagacagggaccaggagtccttggcctgtcctccaccctgcccctgaccaccccaatgtccctacttggtgcccaagtgacctctttacctggatgctctgcaggaagctggtgacatcacaggacagagctatcctgattcttcctacgctgagatttttccttcaggctatggatgaaacccaaagtctcctacaagctaggcaagtcctttacccacaaacttcaccccccacctctgcatagacccaaccccagacatgtgggctgacaagaatgtttctgatgcctctgagtctgaggatcattatggcgatagcttctttgaacccctttttggacacctgttttactagttgcttttcatatgggatggcatgtcatcacaccaacccctaagaataggagcttcagacagatagaatccaaggttacccaggtcaggaaccaccactggagcctgtctgggatgacttcctggggtcctgttcaggacagccagtgcactaggctcatgggcttcagtctgcacccgttggaattgctgaccctaaacactgcggccatgcctcagcccttctttgaaaaagctgtttataataaaaggtttcaaacactcggaaaaagtagcaggaagcagaaatggacccatcttccaggttcaaccattgctgacatttgagatatgtgtccatccctactccccagccccttgcccaccacaggcctttaaataaattcctgacattgtgtgttattctgcccctaaatactcccatatgtagatctaaagggggccagggaggaaagaagagggaagaaaaaaataactatgaatccaaattcctaaggcaaatgacttctagttagctagttcaactctaatgtctcctggtgtcaaaaaataaaaacacgcgtctgcatttggttggtgcccataaaaagattcaaaaatccacacaccgcctttggtggtgcccctcctccataaatcttggcctctctctttcctactggtagttaacaagctgccttgagcagaagggatggctcagaggttaggagtgaacactgctggcagaggacctgggtttggttcttagccaagtggaatagctaaaaaccacctgtaattccagatctgggggctccaagtgagtgttacactcacacaacatactcttgcatgcttgtgtatacacacacacacacacacacacttaaaacctttaaaagaagttgtcccattaaacagtaatgtctcaaattctaggtctgtggaacaggctctgcaccggcagagtttacgacaatttgacacaagctaaagtcattttagaagggggaacctctactgagaaatgcccccactagttaggcctgtgatgcattttctcgactgattattgatgtgagagggcccagctcgctatgattggtgccatcctgggtagtgtaagaaagcaggctgaagtggagcgagcgagttgagcagttgtctggtcacgtctcaaaaacccgtagcccttgcagtatggctgaacaactgactgaagagcagattgcagagttcaaagtagctttctcactatttgacaaggatggggatgggacaataacaacaaaggagctggagacagtgatgaggtccctggggcagaaccccacagaagcagagctgcaggacatgatcaatgaagtagatgcggatggtaatggcacaattgatttccctgaatttctgacaatgatggcaagaaaaatgaaagacacagacagtgaagaagaaattagagaagcattccgtgtgtttgataaggatgacaatggctatattagtgcagcagagtttcgccatgtgatgacaaaccttggagagaagttaacagatgaagaggtcgatgagatgatcagggaagcagacattgacggggacggtcaggtgaactatgaagagtttgtacaaataataacagtgaagtcaagacactgtacagaatgtgttaaatttcttgtacaaaattgtttatttgccttttctttgtttgtaacttatctgtaaaaggttccctcccctactgtaaaaaaaagatgcatgtatagtaattaggacttcattcctccatgttttcttcccttatcttactgtcattgtccttaaaccttattttagaaaattgatcaagtaacatgttgcatgtggcttactctggatatatctaacttagatggagttggtccaatgagggaacatctgggttatgccttttttaaagtagcttttaggaactgtcagcatgttgttgttgaagtgtggagctgtaactcagtgtggactgtggacagtcaacaatatgtacttaaaagttgcactattgtaaaacgggtttttatccaggtacttggacactaattttttttgtactgctggtattgtaccaggaacattttcttttattgttacttgctctttaaactttgtttagccacttaaagaaaacctgcttgtggcacaacttgcctcaaatccattctaagttgtatatttgttttccannnnnnnnnnnnnnnnnnnnnnnnnnnnnnnnnnnnnnnnnnnnnnnnnnnnnnnnnnnnnnagggagggaaggaaggaaggaaggaaggaaggaaggaaggaaggaaggaaagaaagaaagaaagaaagaaagaaagaaagaaagaaagaaagaaagaaagaaagaaagaaagcaggctgagtaagccatgagagacaagtgtcactcttccatggcctctatatcagctcctgcctccaggatcctaccttgggctcctgccctgatttccattcatgaagagctgggatatataagtgcaagctgaagcaaacaaacaaccctttcctccctgaattgcttttggccattatattatcacagcaatagaaaaataactaattcaaattccttgagggtgagggtaggggagtgtgtggcttaggtggttgttgttgttgttgttgttgttgttgttgttgttttgtcatctagactcaagaagccagggcctgagaatttcaattaaaaaggcttccatcagattcatctggaagcctgtagagtgttttcataatgaatgattgatgtgaggggaccaagcccactgtgggtggagccattccctaagcaggtggtcccaggtggtataagaaagcaagccaggaagcagcattcctctgtggcctctgctttaggtcctgtctctaggttcctgtcttgagtccctgtgctggcttccccttagtgatgcactgtaagccaagtaattccctcccttctctggagttgcttttgatcatggtggtcatctcagcaaaagaaacctgatacagacaggtagttcgctcacatcctttcctcctgtgcttcctattgagatgcagtggaggcagaggaaggtggctctctgagttccaggccagcctgtgctacaatgtcaattccaggaaagttgagttcaggcaatgaagaaaccattgggaaaaaaaaaatttgaatgaggaggccattttccagccccagcaagcagaacttggcagcttctgccatgtggttctggctttagagtcaaggatacaaaaggggcggggcggcatacggaatctctcctcctgaggcaaggcccaggcatgtgtcaggggttcccctgcatggaggcctacagaggtcattgtttaaagtgaaggtgagggtgaagcctatgtcgccttgaagatcccaagatgttggagacgccagagcagtggaattcctaccaagggaagctgctaagagggagtggaactagcccaagagagggaagtgtgctgcagtcaacaaagccgaaaggagttggacatcagacatgagatgcagagttgggagtttacccagatgatttttagtcttgctttggccagcatttcctcaccatgtgcccttcctcccctttagtaaggaacggtgatgtatattctgcaacattgtatgttggaagcatgtgatctgctctttgattttgactttatagatgtttacagtaacgatatttgccatgagtctctgaacacgcttcgaggtttgcactttcaatcatgttgagattgtgaacgactacagggacttttaaatctggactgactacattgttccattgtgatatggctctaagtccatggggggccagggagtgggacgtggtggtttgaataaggatgtcccttaaaggcttatgtttaaatgtttagtcaccagggagtggcactatttggtctctaggaagcatggtcttgttatagaaagtatgtctctggaagtgggctttgaggtctcaaatgctcaaaccaggcctaatgtgtgtgtctctctcttcctggttcccactgctccaggtgtagaattctcagccacccctctgtcaccaggtctgcctgtgcattatcatgcttcccaccataactctattactgtatacaactagttatatactataaagcattgcacatcggtatgaagagttaaagtaaatatcagtgtggaccacctcctagttcataaaataaaaccttaacgactcaatttgtgagttttgtttagttttgattttgaaaaatccaagtctcacactcttgcgcaggtcggccttgaacttccattcatcctcctgcctcagcctcccaagtgctacgatttcaggcaagagatatcacaacccttctagtgatgctttaaagaaatggaataatgagatggtcttaaagtgcagtggggcagtgagcagaagagcaggggatggcacacccctgtgagccggtccatgggaagagagggcgtctcgggggaaatccaaaaatacattgagctgaaggaagatggaaataccatgcatttcaagttaagtgacagcctccaagttagaagagaaagctgagtgctacaggcttaccctggaaagaggaaaaggtgtgggtcccaagcgcacactccctgtggggaacagtggagagccagacagaatcagtagcagtggactatggaggaaaagagtctcagaagatcagtggagcactggcccgaggcatactgccctggtgggattgcccgagggaaaaggaattaaggcccaggtgaccaactcaggatacacagggatgttgctacaggactctaaggacaccagaatgacacaaaccaagaaacacaaatgaccacggtccactcagtgtgaagcagataaccagaacacactgtgatgaatagaattgaagtcagggactggggagtgggctcaacagtgaagaacacttgctgctctaatacaggacctggattcgattcccagcacccatgcagcaattcacaactgtctgtaactctagctgcaggggaacggcgccctcttctggctgccattggttcctacatgcatgtggtgtacacaaactcaggcaggcatgcacacaacacataaaaataaaatcttgctggcacacctttaattccagcattcaggcagaggcaggactttgattttgaggccagcctggtctacagagtaagctccagggctgccagggtgacacagagaaaccctgcctcaaaacaaacaaaacaaaaacaaacaaacaaacatctttttcaaaaagagaattaagtgaatatttttcattatcacatctatttatttacttaatgacttatgttctccccttccaccacgtgggcttaaaggcgaaactcagtttccaatcttggcagcgcgtgcctttaccaactgagcagaatcatggacactaaattcataattttaacaccttcaaaagacaaatctttaatcccaggaactgattttcctaaagaacaccaacaaatgtttagagaagaattaatcctagttgtactcaaatcagcaaaagataaaacacaggagcacacaaataccaatgatgttcacaaccacaaggaatctcagtaaaataccagcaagtacaactcagcaataggaagaactgcatgcactgacaactgaggaagcaaggctgttatggtgtaaaaaaaaaaaaaaaaaaaaaaaccctattcagaagggaagaagaagaaaaaaaaagaattccaagagcattttaatttgtttaaaagatttatttactttatgtgtgagtgctctgtctgcatgcatacctgtgtgccagaagtgagcttcagatcctattacagatggctgtgcgcaaacatgtggttgctgggaattgaacttaggacttttggaagagcagccactgctcttaaccactaagccatctctctaggcaccttaggtttgggttttttgttttgttttgtttgggggggttattttgggtttttgtttgttgttgggttttttttgtttgttttttgttttgttgttgttgttgttgttgttaaaacttcaacatctacctgttgctatcttaacaattcaaagtaagatttcccagtaaagaacgaatacacaatccatgcagttactgctgtctgtagaggtaaacgcagtttaactactttcccgtggagtttggaaccaggcaagaatgtctgctttctgcagcacttaattaatgaaatgccaaagaaacaaggcaggaaaatgaaataaaagagcacagaatgcacacactgacacacacacactcacactcacacacacacacacacacacacacacatgcaggcacacacatgaaataaattttttacaaagactcaatgtagaaactatgccagaacttcagagatggctcagtgggaaagatcacatgctgctcttgtcgaggaccagaattcaagtcccagtacccacattgtgtgtcacaccatccacatctccagatccaagggacccaacatcctcttctggccactgtaggtaccaagcacacatgtggagcactcatatatgaaagaaatcaatctagaaataatcttaagtaaataaataaagctaaaaagaaagtatgtcagtgttccctacattgctagacttaagcaacacagttattatcaaactcttgggaagattggtggtcgtgtacacaggctgctccaaagaggattatgttagctaaaataattttgaaaaaggaatatgtacgtggggggaaatctgcctacgtgattttaagatgtatagctgcggagtttggatgcagttcacttggtagagtacctgcttagcactcacaaaacagaggcaggaggatctccgtaagttcaaggctgcatctatgtagcaaggtctaggccagccaggtctatacatgtgagtcctgtcttaaaaaaacaaaacattttcagaaaaatgagtgcaggaaaagacatgagcagcagcattcattcggggtgtgtgaacagagccatacgctcttggtgcactgctggtgccaatgtgagattgtgctgtcactctggaagactggggacttctctggcaacttaaggatgcaatatccttatgggccagcagctcatcaaaggaatgaaaacagacattggcatatgaaccaacatatgaacatgtctaggagcattgtttaaaaaataataatgacagcttcaaacaactcagcaatcggagaacagttgtgaatgtagaaaggcagaagggacctcctggaggacacaggatgtcctatgtcttcaccatatcaatagtgaaggtcttctcagccacgcccctgcctcctgctccaagcattataagacatgagtgtctaggaatctctatagttcatctgatgtgaggcccaaggagtctgtatgataaaatcaattaagtatacacaatctctctctctcccttccccctctcacgtgggtagacatgcacacatgtgcacatgtgtatgaggagcatgtggaagccaaatgccccccttgagtgtcctcctcaccactctctgcctcactctttgagacagagagtttctggttgagacgactgtctaggaggctgaacaatgtactccagggttcctcttgtttgccagtctgctctggtctgtaacacacaacttactgagtctagctctggagtgagcactgggcatctgaattcttcctgcttgtgcagcactgagccatctgtcaagtaattattattctttagacgggtttcactgtgtaacccagactcacctcaaacttaccatcctcctgcctcaggctcctaaatattggaatcccacgcatacattacatctggcctcatcatgtcttataatgtgtgaggttctgcatttttcgcaaataatttaaccaagatttttattgaatatatctattttatttttaaattttttattatttatttttatgtgtgggtgttttgcctacatgcatgtctatgcattgtgtgcatgcagtgcctgtggaggccagaagagggcatcagattctcctgaaactggagttaccaagagttgtgagccaccatgtgggtgctgggactcaaagccaggttctcttgggagaactgatggtgctcttaactactgagccatctctccagcaccagtgtatcagttttcagtgaatatgtttgtgcatagtgctactcatattagggttagtgggggagtggcgttttgtggagactatgctgtgaaacttcgttcacataaccgggttcacccggggtttattacagaaacatgactgcgaactctctgaactctttccaacttccatgccaaaaataacatgcggccctgtcatcgggaattatttttaatagtttatcagcagacaattcctctgagtctcctcttatatagttgaaggcaaaggagtggagaacatcttatctgcaaagagctgccgcttgaccttatgctcatttcccttgtctgggaaaatctaccccaggtcctttatcaggcctcatggctatggctcctcttctcataagcacctcctacctggtggtttagagcaggtcagagacactgatctgttgttgcatttactgagccttaagtgctgactgcacatgtgttccactttgttaggagtggcaagctcggcacactcactttgcaaatacccacagcaggtgtgagccatcactgcttcatctcccagaggcagctccctgggtcccttccaaaacccttcagtctgctctatgaggtaataagtggacagacatcctgagctttaattcaaagatgatagaggatagatggatggatagactgaatgatgatagatacattgattaatagatactagatggttgattgaacaataatggataatatatggtagaacggtttattgattgttgatgtagatgacatatagagcagttggttgatgatagatcagatatacatgattcatgttagataagagatgattgatggattgttagatgatgcacagataaatgaaatatgcatgatagattgatagattataaattgattgagataggtagaatgattgatatattgatagaagatagaaaggtgataggtagatagatgattgatagatagatacgtagatagatatagatacatgcatacatagacaggtacatagatatagatagatacatagatgcataggtacatagatacatacataaatagatacatacatacatacatacatacatataaatatattcatacatacatagacagataggtacatagatatagatagatgcataagtacataaaagagatacaaacatgatagatgattgacggatgaataagtagatattgaatagatagatagatagatagatagatagatagatagacagacaggtagaaaggacaggtggtgagtagacagttgatggctggacagcagatagacagtgggcagagacagacagagaacagggtgtaaagcctgcttagtcattattttgatggaccaccctacctacagtaagacccctacatattcacagcccattttcctaggatcacagtgtattctctggcaatcactgggagaaagagagtcactaaccaagtggtatcaggttgtaaactcaaaattgctcccaaatggatcaaagtcttcttcctcgttcagccttgtggtgacagaagtcttggagtctcagcaggggaggcccgggctgcctctccttttctggcacctggaaactatgcacaccactgggtcagggaggggagggtgcatggctttgttctctggagcccaggaaagggcagcaggccctgagggcagcctgctgcttagaggcacgcatggcagtcggttagctaaggatccaggcatcagtgccagtgaagctcgtgcattgagaacctagcagccttcaagattgccctgtcccttccagattctgcgcaaccagagatggggttcctctgcccttcccaatggcttcctgccttcagatcaccaagttggtgtcacagccaatgggtctccctggcataatccattgtgtactggaggtgtcctaggagaaggctttgggggaggggaggaccccccagaaagggaaagagccacattgaagcctcagacacacacaaccatgtgaatcataggcctgtataactttttaggtctctgggaaggaaaggggcaaggcagattgaggggatgaggggaccgtggaacggcacagactgggagaacttcaacagttttgtttgtttcagagatggagagaaagatacaaccgagatttgatggaatgaggccaatgaatggatatcttctggaaaagtccacacttgtctccagatacacgagaatttcctgtatccttgcctctccacagcttagccctgaatagctaatttcagaacagagaaagaaagatctgtccttttcttggcaccttcagttcctgaaacagtggaagtcacatggattaatttatactaaagtattaatggcttaccacagttatactgaccaaaggtacattccaggtctaagggcctgtgaagtgtacacagaataatcaaaaacaaaggaatggcaaagaaagagggccaggagaaaggaatagatagggcttatcttcatctgttccctagacgtccaatcaggagcctcacacagcaacactcactcagggagtacactgataggctggaccagtctgccagtagatggcggcctacatagtaactgttctctcttttggatcacagtggtggagctggctagcatatacaaacacagaggggactacaggcactgcgtagacaagagaactcgggacgggggtcgggtggggtggggagggccctacctgctctgaaccagctcccatgtggactcatccttctgggtctaacgttcctacttagccagcccttttggggagggacagccaatggcagatgggacagaaaactgagatgagtcattatcactttagcaggaactaatctggcatattgattcaggatagaacagagcctgaaagagtagactgagatttgtgagcgctaagataaagatgagcaaagctttggcagctcttaggtatctgagggccaccgtcctctacaaagcaacgagaggcacggcggattaggatagactggttgcatccaaacactaccttgctgcctcaaaggcttattggacaccacagaaagacctctgctggaggcagaagtcacaggactcctcgtcacagacgatcacgggtcatggttgaaaaagtgaggggacagtgactaaaggactgaggaactgaggcaacttggcccgggtctagtggttgtcctatggtaacctagaggaaagtcatgttcaaaggacatcagccttaggaagggctcccagggttgctttgaggagtgcgggaccctaaggtggaaccagacatttcagagaaattgatgacgaggcagctgctctacttggcctcctgttgctgaaatatcactgactaaaaacgagttg

SEQ ID NO: 1524 - DNA, 1163 bp, Mus musculus
  misc_feature (27)..(27): "n" at position 27  can be any base
aattaatttaattacattttacctttntaccgagtccgagtggagcgagcgagtcgagcggttgtctggtcgcgtctcggaaacccgtagcccttgcagcatggctgaccaactgactgaagagcagattgcagagttcaaagaagctttctcactatttgataaggacggggatgggacaataacaacaaaggagctggggacagtgatgaggtccctggggcagaatcccacagaagcagaactgcaggacatgatacaatgaagtagatgcggatggtaatggcacaatttgattccctgaatttctgacaatgatggcaagaaaaatgaaagacacagacagtgaagaagagattagagaagcattccgtgtgtttgataaggatggcaatggctatattagtgcagcagagcttcgccatgtgatgacaaaccttggcgataagttaacagatgaagaggtcgatgagatgatcagggaagcagacattgacggggacggtcaggtaaactacgaagagtttgtacaaatgatgacagcgaagtgaagacattgtacagaatgtgttaaatttcttgtacaaaattgtttatttgccttttctttgtttgtaacttatctgtaaaagttccccccccctactgtcaaaaaatatgcatgtatagtaattaggacttcattcctccatgttttcttcccttatctaactgtcattgtccttaaaccttattttagaaaattgatgaagtaacatgttgcatgtggcttactctggctatatctaagcccgtctgcacatctaaacttagatggagttggtccaatgagggaacatctgggttatgccttttttaaagtagcttttaggaactgtcagcatgttgttgttgaagtgtggagctgtaactctgcgtggactgtggacagtcaacaatatgtacttaaaagttgcactattgcaaaacgggtgttttatccaggtactcggacactatttttttgtactgctggtattgtaccaggaacattttcttttattgttacttgctttttaaactttgtttagccacttaaagaaaacctgctcatggcacaacttgcctcaaatccattccaagttgtatatctgttttccaataaaaaaaattacaatttaccc

SEQ ID NO: 1525 - DNA, 450 bp, Mus musculus
atggctgaccaactgactgaagagcagattgcagagttcaaagaagctttctcactatttgacaaggacggggatgggacaataacaacaaaggagctggggacagtgatgaggtccctggggcagaaccccacagaagcagaactgcaggacatgatcaatgaagtagatgcggatggtaatggcacaattgatttccctgaatttctgacaatgatggcaagaaaaatgaaagacacagacagtgaagaagagattagagaagcattccgtgtgtttgataaggatggcaatggctatattagtgcagcagagcttcgccatgtgatgacaaaccttggcgagaagttaacagatgaagaggttgatgagatgatcagggaagcagacattgacggggacggtcaggtaaactacgaagagtttgtacaaatgatgacagcgaagtga

SEQ ID NO: 1526 - DNA, 30000 bp, Homo sapiens
tggctggattcctgacccagctccgttttttcccataatcttggaggaaggatagtttaactttctgaaccagggctctttatctgaaccacagaacaagaaattgatttcagtactattctctcaaggctggtacataactagtaccattctagatgcatagaagttgattcaatacataattcaatgccttaggatatttaggatttatttcttttatctgttgagaaacacataggccttaaaatcaagaatgctactgggggccagacacagtggtttatgcctctaatcccagaagtttgggaggctgaggagagaggacctcttgaagccaggagtttaagaccatcctgggaaacaaagcaagattctgtctctacaaaaaattttaaaaattagctgggcgcactttgggaggccgaggtgggcagatcacgaggtcaggagatcgagaccatcctggctaacatggtgaaaccctgtctctactaaaacatacaaaaaattagccgggtgtggtggtgggcacctgtagtcccagctactcgggaggctgaggcaggagaatagtgtgaacccaggaggcagagcttgcagtgagctaagattgtgccactgcactccagcctgggtgacagagcgagactctgtctcaaaaaaaaaaaaaaaaaaaaaaattagctgggcgcagcggtttgtgcctgcagttccagctacttaggaagctgaggcgggaggataacttgagcccaagagtgcggctatagcaagctatgattacgccactgtactccagcctgggtgacgatgagaccctgtcttaaaaaaaaaaaaagctactgtgattgtccctttgcccttcaccttggtcattagcacagatggctggaggagggaagctatgggaaggaagtgtcaaaggatagggcttgtgttatctctgacctgcaaattgaggaagaggtgtggagaggaagtacattctcactttcccaacatgggcaaaggcagagagctgtaaggttttaccagtcaggacaggaaaattcaaagacaaccaccttcttggccttggcatgttggtcatcaccaaccttctcagtggcaattgccaaagtcaggcagcactgtatgtcatgttgtggaagacaaatgctctataaataaattgacttgaaacagtctcaaatacacataaaccacaatggctttaaatgtaactcttgacttttttctcattttctttctcttctaagagaggtcagcaaggaaagttctgcaagagaggctttacggaaatccaacctaagaaacctgggaggacttttatgtatctgttttaacaaacatatttcacacctaaatatttgtttaaaagctcctggaggctttaaactccagagatggatacatacatctctgagcacgcacctgtatttcagacttaacgatgcacttgttatatgctagacatccatctttttaaaaattcattttctagaggaggtgattattcattttgtcattcaatttcccatcattaaaaatttcatgcagtaaaatcactgcatactaatggggtactgtgtaaagagagtatttttagtgactaagttgaaagaaaagatcattgatggctcttccatctgaggatttgaggagtaatcagagacaaatttctgaggaataccttggaaagacctggaagctaccagaatgcagagtaatgaaacggaggccttagggctccgttttcagctcagattctgaagcagaggtgtccgcttttaagtaacattctgtctcgatggtattccattcacaggataaagttaattaaatctcctttccccccaccatcattacgtcaccacattagcgaggacaatagaagcacagggtcctgagtttgcactgactggtcattcatctgaaaagaaggtcacagggttgccaatgctaattggaagagcatttaatgcctggtttgcatgactgaaagaaagaggacccacctctggcctggcaaagaaaagatttttgatggtgtgagaaaatgtctaacttggctaaaggaggttaaattccactgaagccttccaagtggatgcaggtagctgttagcatcagaaatggtcttgctgggcagggcaatgttctctagggagctgtcttcagtaggcaagatttcaccttggcttgcaaaaaatgctgttcactgggttttaagggtctacatgcttgtgctttttactggaaaattctcagaccttgatatggcctgtgatgatttctttttttttttttttctgagctggattctaccaacaatcttcttaaggaactgccttttgagatttaaaccttattcctctttaatttcccagcgtcctctctgcctaacgaggctggctgtctactttgggctttagtaatgcctatccccttgcaactcctccatcataccacgcaattacacacctccgggcctttgctgttacttacttcacccagaacttgctcccttctttcctccctgctttttcctagcccattttataacattagacaatttaggagttaccttctctaggaaccctttttggaacctcttatagaggactaaggtcctcacctctgcatctcgtaagcccttctatagttacaattataatcaaaccgagtttacacagtaggtgttcactatccacctgttaaatatttcaggtatgtacgcctttgtttattttggatgggaccaagcagttagtttttatgtggtttttaaaatattcatttaaatctgtggagttagaaatccaaaagggcaaatttcctatgaaggggaaggcatattatagtgaccaattgttggagtcctaccctgtgccaggtactttaacactttgttaattctaatctttgcataattctaatttcctcaatattctttcgagataggtcttattgcctgtattttacaagtgaggctaaaaattaaatgactcacccaaggtcttgcacctgagagagggacccaactaactcatgcccagctctgtccaatccagaaccctttaaccccacgataacaaggggccatttcgagatactaatcccactgaagctcggatactgtgacttttgagttacttttcttttctggtaaattacccttggcaaagaacgcgaagaggaagtataaacgaaataccctttgagattagcctgtcagctgaacagctacatttgcccgtgtccagatttacatgggttttgtgagggcgtgaaatgaagaacgtgcggcttccatgaggccaaaacactaggttaaaaagctgagttcagggtacgcgtttatcggaatctttcagcttcattctttatcggcttaaggtgttttcgtctacccctcaataaggggcgggaaagtgggtgagtgtggcagggaaggatacgtggaagaggaaggttctccagccaagcgcaaagcaggcgactctgccgcctggcgcagttgccaggacagcgcggcccgagcagcaacggcagaagccgcaccgcgtcccggcggcggctgcgagtcccagtgacgcattgcaggtacaaaccagccaatcagaggcaggctcaacgaccaacgggggacgcatcgccgccacgatgctcctccgcgccgcaaagtagcgcccctcaggggccgctccaccggccttttaacggctcgctggaaatgaaacccacttacgtcatccgttcgcccactttccttgatctcttgcctcatcgaccaaataactgtgaagaaaggggtcccgagaagagtttgaggggagggggttggccgggactcgtttgcgatgttccgttatctggatgcggcggagggatctggcggagggaggtgtttatgaggcgctgggggcggaggaggcgaattagtccgagtggagagagcgagctgagtggttgtgtggtcgcgtctcggaaaccggtagcgcttgcagcatggtgagtgcatcgctgagctgccggcgctgggcctgtggggggaagagactggagcgaactgactaaacaaaggaaactcgcctcccttacaccttcaaggagtggtttctgccagagggatggcgcgaaagaggccagggatgccggcgacggttgtgtcgcaggtgctcccccacccccattctcttcaggggggcttcctctagtgagttgagggccggacgcacagttcccgaggtggtgaagctcctcgggggcttggctggaggaggatgggtccgggatgagggacagcccagtgcacgggaaggagagaaagtgaaggaagggagagagggagcgtagagagccttctgtcgggcgtctggaaaggtcaagcagggggcgaattcaatccacccgaccgacggttagtgcgggcgccaggaagcgcctttgtccgcttgcggccgccatgcgcccagggggcgggaggagcgcgcggggccctggggcgagcgtcggcgtcgcagttagcccgcgtcctccgcgtgccgggatccagggggcgcgcgggcgggcgggcggcgcgctgtgtgggccgagcccgcgcggcgcagggagcggccggtgggggcggggcgggcgagcgcctcgcgggacccggagccgccgccccgctcggccccgctcgagctccagctgctctgctggcacctgcaggactgcggagatctccttggcgctgcggggccattggcggggatgggcgggggaggggggcctcgacggtttcccatccccctctggcaaccctaatcttccttctccatctgggccctggggcgtcttccaccacccaggccggatgctttaaaaaaaattgctttttaaagtgtctgtcgttgaaagaaattagtcttacccttgaagtcaggggcgcgtcctcgcaatacacatcttgttagggaaagtgttcggctccagctagggttctacaaggcgtttcttgttcaccgccggagggaagcaggctccggagtgactgccttctgaaagtcggtcttgtaacaattggatggatgcctttgaagagcccctgtccctattctatgcttgaaaacagcgtgcagtcctaatgttcaagaaccacgaccacataaaaacattgctccccttctgctgctttgaaaacgacccctaaattccgtgtagaagttgccaggtcgtcttgacgtacacttcgtttgtatgatgtttgtctgtcaaatactgtgatggaagagtgtatgcgggggaggagcagggaatttttaaaagcattttccggtcacctcagactgggagatcatgttctttcctgaaaaaaaaaaaaaaaaaaaaaaacacctaatgagggcggtgatctgtgatacttactttgtggttcctcctgccaagtggttacagcgatgggtgtgtccaggaggcaaggtgacatcttaaacaggagttagggatccttgccaactgaaacctccagcctgtatgggtgtggggagaggatttcaccttaaataaaactagcgttcattgacgtttgatggatttgcttcatcttgatgcttcaaatgttattctgaatttgaatgtgctggttacatttgctttcttaaagatgtagttacaggcatatgtaataaacattacaagttgtggagtaagcttttttttttaaataaacgaagggtaaagttttctttaatcagttttgataattgaatcagtaattcgaatagattttttcttggtagagttggtatctacgcatttgtggtcccttgcccagtgttaagcttttgtagttactgtttgcatcactggtgctttgggggttttctgttaaattgacagctcttactataagagacaaagtcgaaaaaaaaaatcttaataaaaattgacagatatcattatttgtgacagatacagtaaatttgaaaattgccttcacataactttataattagaggactgagattttacattaggaatccaattaaaaaaaattagccggacataatggcctgtgcgtgtagtcctggctagtcaatgggctgaggcaggaggatcatcttgggcccgggagttggagactgtagtgagctatgatcacaccactgcactccctgggcaacagagtgagaccctgtctctcaaaaaataaaaaaaattaggaccccaagttaaagtataaaaaattttatacggaagtaaagtaagattgctcatgtaactcttgagtttacatgtaatcaacatatgctcattgaaaacgggattgcttcaagaggactttgagtccagggtgattaggtaagtaaaagatgtaaaaaggtagaaaatttttgtcacttgagtctaaataattgttcttataagtgccaacgcctgtttctgttaggctcagaagatcaaaggatttggctcttttaaaatatagaaagctctagcttcagctagaatttaggcctttagtaatagccctaatttttatgaagccattttgttccagtgatcttttggtgagagatgctatgtaagtactattcttcagaattaggtgtctttttaccctaatgaaataatttagattgcttttgatacaggtaaaacaaatatcctggcttccataattgtagaaaaaacttcatataggaatccttgttgtatcaaagtagcacctgatgggaatgaacagacaggaatggatgaaggatagcagtttgcgttccatttcaagcctatgggctcacacatttattcagataagaacaccacctttcactagataaactccaacagtattcatgcatacttttgaatggcatgtaggaaatgtttgataggtacataatgtattcacttcaggtcactaatgtaatacggggtcgtgctccttagtgttgacagatcacctatggttctccaaaatgaacattctagtacaggaggtctagggaggaacctgagagtatactaatgcctaggaactttctctggagtggcaagagcagtgggaagaattatgtcaatagctacagaaataagggagtaagaacaagtcatctctctagtgaattcttcttcactttactgagataaacatacatgttaatgagcttgagttttcccaaaagtataattcttctggttcttctaagaaaatggcactccctggaaacaaggaagaaccaaatttattcgcctttgtagcagttgggaaagttagtgctaggaagtcttcttgatttatagtaggctttaatctggatattgctggtaaaagtttattctaaaacctgaactctggataagtaatacaaaaagcttctcaaccttccaagcaaaattgagagctttcaggttatgtgagtaatttggtctcttgggtgcttaattcattccttgaagctcatttttgtgatctcttccaagattgcatttgcttggaggtagggagttagacaagatggtatgaggtccctaaattttgactttccaagcaaaattggacagtggttcctaaattgctaacatcctcgtttcttcctaaggcttctcatgtttcatatatagtagccttcccaaaatcccatttcccaccccccccccccaacccatgtagagagaacgaacctgtctcccttcctgtacagagtacgggatccttcaactttcacacaggctgcagtgtctgccacacatttagctcaacttttttttagccttaaagtgatgtccgctgcatctgtcgctgggttgcaccttgtggatttagtttgcataaattttctcagcttaaacaaagttaacattgaatagagtaagcttaccataaagggcttaataaatgccatgcatgtctacattcggtgtggaaattgagctagtcaggttgatatttaacattgtaggttctttgttaatttatatgaaataatggttatcatttaactctttaggttagctttgtacatagcatctcactttgcacaacaaccctgcaaggtaagtattgttattcttgtgctacaaatgaagttgactgagaggaggagtaccacgtccaaggtcacacagctattaaatggcagggctgggatactggcctgtgactcagaacttgatgctttccccccacgccacgcatgccaggttgcccttcctttcagaaatggtggaagtcctgcaaaatgcaataaactgaagtaatgtagcttctattaatacaaagtaaataactcagatttactggattttaaaccttattccttgggtaaacaatctgactgacttcacaccaaatatttgttggcggaggatttggactttagggataaaagtggatacattttttattttacaaactctgtatttgaacttaattattggctcttcaattttacgttaccagcttttttttttttttttttaatgaatttgatttacatcatggtcaaacaaaaattgttgagcagggaaaataaactactttctggattccttcttgaattttctcatgtgccctagagaaaatgtgttccacattaaggtgttactttttccaggggtgtgttcatttaaaaagaatgaagccaggcaatgtttatttttcttttacctataaataaatgaatggattaatcattgtatacttgactcccatgttggtagggattttagataggaggctatttcttgtctgtgcttctcaataccccataagcagttgcttcatggatgtatatactaataagcagtgaaagaaagtgcatgttcaaagaatacaacaaggagtctggatattttgcaatcatctttatatattacggtgctctgaattaaaagctaaaagttactgggtatgtctgacaccttagtgctttatctttgttctactaattttctgtgccccaatcccacttaaccctagcctcattccttatctgtaagataggggataataccactgtaaggttattattaagattgaataaggataaaatttataatgggttttagcaaatggcagaaaatattttctgaagaaaaccaagtgctattaaaaaaacatcacaagccttgggcttactttgggattttaaaaaccaagagaaaatggatggctgaactttcaaacatttggtaaatattatagtattgtagttcagagctctggattctttgcattttgcctgctgggtgagaaggaataaaagtttgtgcctttttttttttttaatcactttaatttcaaaacaatgtgtttaaccatttgtgggagtaattttcattttgtgagcctgaagcattttgattcagtgggaatttctggtgatttatatctggaatagaagtgagcttaagtttagctattctaacgttgaaaaaggaagcaatgtttctattggattctaaagtatattttcaaaaatattctgaagtatttgtatatcttaaacttggagttaagacagcttagctttgaagataagagaaactagatgtgtgcattttctatccagatgtgtttgttgctggaactaaatgaaacagtacatggtaacccttgaaaggttttaaacttgtttctgtaactgctaatctacatactctcaagtcactaaccttcctctttgatctctttgtaggctgaccaactgactgaagagcagattgcaggtgagaaatactcagctagattgtacccattagattcttattataaattgaatagccaacgtcagaataagagacttgtatgaaataattgactttggtatatgtcatggatactaacatatgggtataatataatacagtaattcaacctgctttggcaagtgggattgtaaacttgccgatggaagatgtgcagggctaattgtagttaaagacatgtattttagtctgcgtggatatactttggagccttgtggtgtagtggtggtctttgttttgttttctgaagactaccttagtataaaacaggaattctgggctagctaacacgctagaaaaggaggccaagaagtaactaaggcaacttgaaatggagaatcaaaaaaggaacaattgaatttaccctagttaaaattagctaacattttaacctaagaattgcatatataatcagtcagggaataaccatttctcaagtgaaaaaatttaagaagttggcattctattctataaatgtcactgtagcaatgtggatttttctcttaaaaaacagtgacagctgttgaaatgaagccgcttaaatcttgtcccttttagtttgctatggaagtatgcaaaattattacataaaacctgatgtcatgttctctttatgccatgccatagaacattaatacttttgatttatccttgtacattgagatggctggttaatgtcaatgttggggaaacttttttttccccccttgccggagttgtttttttttttttattgtagtgttgaaatgctttgcaaactattcctttgttttcattagacacttttattagcatgagcaccaagcagtttatttgccacagttttcacagtaagcaggaagggtttgataagagctcaaaagcacttgagcactttttcttaggctggagaaaactgagaagcccagttggaactatatagcccatttaaagcaagctccccacttccataagcatatagaagtttgggggataccagaattacactagtcacctcaaatactatttgataggactgtaggtagaaagctattagtattaaagacaaatttaagcaggttttatttttatttattgtgtaatttgacttaaacttagtttttactttctgaggttggtaaattacatgtattgactgttatgaacaaaaagcaaacagttttgggaataattttttttttgttgagttacactgttttaaaggtatcacctatttgatctcatgtctcctcaaaaaaaatagactgggcctgatggctggtaatcttatcactttgggaggctgaggcagcaggatcacttgagcccaggagtttgagaccagcctgggcaacatagtgagaccccatctctacaaagtaaatgtatcgtcaaaatgtttttctgaagtagttttttttataaatatactgtctccttcccaaattgtctcaggctgtctaatactttcactcttaaactctgaccttctgtaatacatttcttaatattcccagtcaggtacaggtaccaactgtatgcagtacagcatgttcactttagggtagaaaacgttactcaatgtgccattgcatagttgatggtctgctctcttaaacaactctttgaaaagaaagtttgttggccgggcgcagtggctcacgcctgtaattccagcactttgggaggccgaggcggatcacttgaggtcaggagttcatgaccagcctggccaacgtggtgaaaccccatctctcctaaaaatacaaaaattagccaggcatggtggcgtgcacctgtaatcccagccactcaggaggctgatgcaggagaatcacttgaacctgggaggcagaggttgcagtgaggcaagatcatgccactgcactccagcctgggcaacagagcgagactttgtctcaaaaaaaaaaagtttgtgtctattgaatataagaggatccctcttcagtgattgatagcatttttattttttaatttattttgagacagtttcactcttgttgcccaggctggagtgcagtggctcaacttctgtctcccgggttcaagctgttctgcttcagtctcccgagtagctgggattagaggcatgcaccacctggctatttttgtatttttagtagagatggggtttctccatgttggtcaggctggtctcaaactcgcaacctcaggtgatccacccgcctcagcctcctaaagtgctgggattacaggtgtgaatcaccatgcctggcctggtagaattcttataaagaatacttgtagttcatcaaaactgtgacattcaggacctgttctctttattgtctttaagttaaatcctatcttttcttggctttcatcataaaattaggtttccaatgggagtagagggaaaaaaatctgttcttaggttctcttcttatcctgccttttcctagaccacagatttctttaaagccattccttggacctccaggtttcagttaagatttagggcagaggaaccaaaacttctatgctactaaaataaaaatcatgtgcggtcagggacctttttgttctactttgtaggcccggtacctgccacatagtaatcattgaatattccttgaataaattttattctcaatgagtgtgtaacacaaaaaagttctagagcactactatcctaagatttctgcctactctccaagtcccttcctcccaaatttggtatatttcagtgtttacctttgagatgaaggcaattttttaatctggtaaattgtaattgttggtggctgggcatggtggcgcatgtctaatcccaacactttgggaggctgaggcagtgggattgcttgagcccaggagttcaagaccagtctgggcaacacagcaagaccctgtctcaaagaaaagaaaaaaaaatttttttttttttttttttagttgtaagtgctggtgaccgctaacatccttgtggagaggaagtagccaaatttttttttttttttttttttttttttttttttttgagacggagcttcactctcttgcccaggctggagtgcagtagcatgatcttggctcactgcaacctttgctgtccaacttcaagcaattctcctggctcagtctcccaagtagctgggattacaggcgtgcaccaccacacccggctagtttttgtatttttaggagagatggggtttcaccatgttggccaggctggtcttgaactgctgacgtcaggtgatccgcttaccttgacctcccaaagtgttgggattacaggcatgagccactgctcccggcctaaaattttttatattacttggtcgtataaagcattccagtctagtatgacatcactaacaatttcattttgttgataactctgccatgatgtcattagttgttgctgtttgacttttggaagactgataggaaaaatgtacagtattttttccttaagaagtctgtacctaaactttcattaaattttcaaggtccaaatttgtttgagaaaaatattaatattactcaatgtatagcaacaactgcatgaagcgccaaaagagttccagtacatgatctttaagggattattaagttcagaattttgtgaagaaatagaagttaataaacagtcatttgatttgttttgtaattgtcttgtgataacctattttaataaaatttttaaaacatgttattttaataaaattatatgtttaggtaataaactaattagggaagggccttggggttgctaatgaacaaataaaacttgagtaatagatttttctgaaagtttcagtttggtcagctaaaatggattttggtaggttccttatatctatcaattatgtagaagatagctgttctgtggcattcaggacctgttctctttattgtgtgtttaggttttgactcttggatttaatttcaggtcattcctgggagttacagtttagaattatatgcttctatacataaagattacgctagttctgaagtacaggaaaactgtaaaggcaggtgaattaaaattttactttggggtttattattttgagtttttacaggtattttttactctttagtataaaaatacaagtaaaaatttggaataaaccttgacctttaaaagaaatgttatttgttcctttcttgaatgaataacaaatggtattagcatagatacggttttattttctgcattttacttattctagcaaacattttaagtgttattagatttttaaatttctcgaaagttatacatagtcttacactatgcatcttccagtatttagctttttgttaaatcatgtaatagaaaggtgattactgctaattaaacattgggaatttatgcacctaatggtggtgttaaaagatacccatagcagagaatgtaatataaacaaatacctcaaagtcctttaattttcttgtaacctaaattaggtgaaaggtgcaatgtgtctgaactccaatatatgtatttctagatatttctacattctgtttaaaaacagtaaaattgaaatgtctttatcaattgtgctatttgtaggtggagactccctgatctatttttgtcattaggttgatctaggttagcactgtatactatcttcataaaatcaattagtgtggtatgaaccttctgattggtattagatgagttcctctataaaccagtaatatttaaataagaaagaatgcagttaggaggcaattgtaatagccctggcaaaggacgatggagccttgaaccaaaatactggttgtagagatggaggaaaaatcaggcagtatttaaatgatagaattcgagacctgttgacagatttcagactgaaagagttaaaagtggctcttgggcttttgctagtacctttagggttgcctgggagtatagaattcattttcatatgttttgcttgtcatcagccaggggagctatatcctgtagacagccagaaataaagacatttattgagcgagatgggtagactaaagatatcttcgttgtaagtgggtatagatgaagtggccaaggagtggaaaaaaaggataaaattggtcacatctagacataagagacaggagtaagagcctttggcagtatatggtaggaggaaaatcaaagtactgttacgaaggccaagaaaaattttgagagtttttccatgcagttttggatgctgcaaaaaaatgagatagtctttatcttgacatttattaagtatgtatttgttggacatagttctaagtgtttgacacatactaatttttttatggggggtgaccaggtgaataccccttgtgggcatggtatactgtgtcaccccacttactgggcacatttatgtcatttcacagaaatgaggaagctgaggcagaaaaggtttagtagcttgtccatattgcattgccagaagaagaaacagagctaggaaattctaacccagtagtcaagttacaaagtctcattttagtttctatgccatatggcttcacattgaagcatgcttgatggattgggtgactgactagtagtcattggtaaactcagcattttcaggtgatgagttggagctggatgtcattttaaaatagtggattgtttggagagaggaaattggtatgagtagtagtgccttccaaaatttggggagggataagggcaagcatttaaaatataactaaggtttcaatttagttttaggctaagcgatgtgaagatatttatgtggtaatgggcaaattagtggaagaatagttgagtccagggaagaggtaatatggaatgaaactggaaggtgtacgcgaattggagttagggataagcaggcagggaataaattggccttggaccgtaaagaaggtacaccatttcttacacatgtgtcacataaattttcaaatgtatggctatgttgggaaagcttaatggcccaatgaacttggaaactttttgtattcatttgctgatagggtctaatattttctgggaaatgacttacttggaaaatactagctttattatttactgattggtataactttgcagtatcaaagttagtctgttttagtttctttctttctttttttttttttgagacaagtctcactctgttgcccaagctggagtgcagtggtgtgatctcggctcactgcaacctccgcctctcgggttcaagcagttctgctgctgcagcctccccagtagctgggactacaggcgcacgccgccacacccagcttgtgtgtgtgtttgtgttttaatagagatgggggactacaggcccacgctgccacacccagcgtgtgtgtgtgtgtgtgttttagtagagacgggggactacaggcacacgccgccacacccagcttgtgtgtgtgtgtgttttagtagagacggggtcttttctttttcttttttttttttttttttgagacggagtctcgctctgtcgcccaggctggagtgcagtggcgcaatatcagctcactgcaagctctgcctcccaggttcacgccattctcctgcctcagcctcccgagtagctgggactataggcgcccgccaccacgcccggctaatttttttgtatttttagtagagatggggtttcaccgtgttagccaggatggtctcgatctcctgacctcatgatccacccgcctcagcctcccaaagtgctgggattacaggcttgagccaccgcgcccggcctgagacggggtttcaccctgttgttcaggctggtctggaactcaccctgagctcaggcagtctgcccaccttggcctcccaaagtgctaggattacaggtgtgagccactgcacctggcttgttttagtttatctgtaaatggtgaatgaagccaggtagtctggagtgttgcaccagcaggaggtttccatgtaatctagtgatgtattagaaggaacatatagccgggcacagtggctcatgccctgtaatcccagcactttgggaggcagagacaggcggatcacctgaggttgggagttcgaggccagcctgaccaacgtggagaaaccccatctctactaaaaatagaaaattagctgggcgtggtggtgcatgcctgtaattccagctactcgggaggctgaggcaggagaattgcttgatcctgggaggaggaggttgcggtgggctgagattgcaccattgcactccagcctggacaacaagagcgaaagtccatctcaaaaaaaaaaacaacagcaggaaggaacatactatcacaacaagatgttgaggaataatcagtttcactatataaggttggggttttaatattccaaagaaagctcaaaatgatctttgttctcagtgacatgcatttagctaaaactggacatttatatcttgatcagcccattgttatagactctttatatagtcccttctcctgccttactagaaagggaaagtagcctgttttaatttagtaggtgattgatttagacatagtggctaactctaaacacagtatacagaaacagtttaattactctgtagaaatacgtatttgggtaccagtagtcttatttttgttttgtgagtgtaggttaggtctgtaattttgaattatgttccacagagcagcttcagtgacagaggagccagtcatttggggatttggttcttttcctctgtaaacctaggataattttacttaggtcagcatgaaagtacagtggtatgattggtcaaagatatatttgaaatattatcataaggtatcataaagattggttaatctttaggagtcaaagtcacatttcaattgctacctccattggtatttttccgttaaaagtttttgggtttttctgagacgtggggtcttacagtttggccaggctgaagtgcagtggctgttcactggcacgatcccaccactgagtaggctttaagagttaatacgtttcatttaggttacattttattattaatctgtgtatttggattgtggtctttctttcaaacagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaagtcttcaattttgtggggctgggaggggttgaagaagtgatacttagatgtttccactaaacctttgctgtttgcttatatgtttccactaaagctttgatgtttccactaaaccatttcaggtaatggcacaattgacttccctgaatttctgacaatgatggcaagaaaaatgaaagacacagacagtgaagaagaaattagagaagcattccgtgtgtttgataaggtacgtcaaggactggatatgttaaattttgaggatgaaatgaagataccaggactcattatgaagacttgtgtttttttggttttttttttttttttttttttttttttttttttgatgatttaccaacatattttaattaccaagcaaaagctttttaagaattcagtatagactttctaatatatgtattgcgttcatcttgtcaaaggaggtgtcacttgactttgggactaggaaataatgatttcaatgtaggacattttgcttggctcttaatgacatttgtaggtcaactgtgtagatttgtatgcatttctaaagtatgtttttcccccaatgtgaaatttagtagtaaacttaataaatttccattccaactctcaagtctgtaatttgactcagaaactatactaaattttttgctaggatggcaatggctatattagtgctgcagaacttcgccatgtgatgacaaaccttggagagaagttaacagatgaagaagttgatgaaatgatcagggaagcagatattgatggtgatggtcaagtaaactatgaaggtaaatgtttcagtctcacgcctcattcttcactttgatttttaagataagaggctctttgttagggaactgatcgaaattagtgacccttccccccaaattaggttgctaaaacagttacttacatttaaccttcttaaaattcagagtgttgtctgcagactaggtaacattgctctgacttgagaacttaatttagaaatatttactatcaggttctatccctacacctggaatcagcattttaataggattcttgggtgattcatgtataaagtttgagaagcactgttcagtgtttgtgtgattgtggaacaatgtggaaagcaaacttattccaagtttcctaaaatgaaattaatgtgactttctttccccgcactgtattgtcttttttctttaattggctttagtctgaaactgaagtttacatgtgcttcaaaagtatcgtatctactaacttttaagatggccatatcaggaagcaaggcatatgaaactgaaggattttgagtaaaactctgtatttttttcatgatgtaactacttaacttagaaaagagcataaaatgtaatgttataaaaattaaacctagcccatagcattgaatttacaatattgtcttgtaatccagcagacttaaaattcaagtctaaactaagagccaagaatgctcttttttatattggcctatctaaagcgttaatttggctcttactaataaacctgaatagttatggttaatgaagttccagcctgggcaataaactagcttccctctgtacttaatggtaattctgaggaaagagaggaatggaaagagtactcagtaattgagtaaatgtgatttttttttttttttttttttggtcttttgctattgactcattttttgtgtacttcttctttttcagagtttgtacaaatgatgacagcaaagtgaagaccttgtacagaatgtgttaaatttcttgtacaaaattgtttatttgccttttctttgtttgtaacttatctgtaaaaggtttctccctactgtcaaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttgtttagccacttaaaatctgcttatggcacaatttgcctcaaaatccattccaagttgtatatttgttttccaataaaaaaattacaatttacccaatggttgctctgcatctgagtcatttaactgttgaagtctaataattttgaaaataaaatatggcattggtttctgcttggtatagtctagataattttttctcgtgtggggaagcatatggagatgggtggcagaaatagtgaaggtgggaaaggaaggagaaaaggattggaaaagtgagaaaagagggagagaagcacagaaaataagaggaacaaaataaggggtgtaactaaggagagattgaagaggaaggccgaaaagatggggatctatgggggctggcttagtgtagtcaccttttgggggccaccatcatgcgtgcccacaacattcctccaccaccatgtgtgtcgtactgtgctactgtgttagatccaggatacctgtgagttgcctctgcccacagaacaagatggtggcagtcatgggaaaagaggggcaagttttttgttttgtttctttatccagattgtatttgacaacttcaaaaggccccaatgaaagactcaaaaacttaagtgtacctagtatgggaattggcataaagtaggtatttactgtttcctacctttatagttttcaactttggcatttgtccatgttgacttaagctgtgcagtgatgttttaaatgtttgcatgttcaaaaaaaaaccaaatctagttggggtgagcatccttatagttttacttctattaactaatattttattcattgtgctttttaattctataagatgagaattttcagcttgcccatctgcaacattttgcaaaaaaagatgtctttaggagtaaattggcaatgactacaccttgttttagtttttgctggcttctatcattgctttctctataatttgagctactccaaaggtggttatcagggtttttatttttttaaagtaccttttaaatgcttaatgaaagattccatagcaaaccagagccaagattaaaacattgagtgtaattgttacctggttattatagctacaaggtctttaatttcccaggggtaattcattatttggcaggttactgccccattgactatcttaatactactattagtatgttttagagcaagggaagttacaggcattgatagttctaatggtatcacatactcgggtaatcagttaaataggaagattttagatgtgcactctactccccttaattggatgtagtaaattttgtcgaaaggaaatccaaacaaggtttgttttttgtaaagacagggactcatgttgcccaggttggtcttgaactcctgggctcaagtgatcccctcacctcatcctcccaaagtgttgggattatgagtggggcttttttaaaagttaagtgaaataatgaaagtaaggcccttaacattgtccttggcatttgcattaagtgttccattaattgtgctattaaaccagttatgaccctgaaaaatgagggacttgggcagtcaatttgtgtttttccagcgtcaacaatgaggtttatataaattgatatcaaggtataattaacaaggacaacaaaggtaggagaaacattttttgggctcttctatgtcataattggtcatttctattgttgaaatctttacaaaagtcacgaagtcttggcattttgattttacaggaaacgagtagaatgattgtataatttaactgtggtcataatgagctgggttcaaatctgttccaatgcttcctacaacataatcctattggaacccaggactgtgatatcaccttcaagttgtgtttttgtttttgtttttgttttttttagatggactctagcactgttgtctgggctggagtgcagtggcgcaatctcggctcactgcagcttctgcctcccaggttcaagcaattctgcgtcagcctcccgagtagctgggattacaggcgcccgccaccacgcccagttaattttttgtatttttagaagagacagggttttactatgttggccaggctggtctcaaactcctgaccttgtgatccgcccacctcggcctcccaaagtactgagattacaggtgtgagccacctcgcccagccccaccttcaagtcttaaccatactattagtgttatattaataggattttggtaattgtaccaaccataatactgtctggcatgtttgctctcagatgattctcccaataaacaactattgcagttaaatatcacccttggtgtaacgtattttcctaaaatttttagaagacggcaacaattttaaagatctgatatgtaacagaggcactgttgagctcaattatagatatgtattctcaagagaaatgcctctccccctttttgaaacttacaataatctggaaataaatctcagtgatactatataagataatgttttcttaaaggaacactatgtttatcctacgtgcttaatctgctttgtggatagtccttgaaatcattgacccatgctgtttctatttttgagatacttaaactattttctcatctagatgttcccatctctaatgtcacaccttgtatgggtttctggacttctctgtacctttcatattcttttagtctcgagggtaccagtccctagtctgctgagccagttttacaggctcagccaaaataagaaaatgaaatgaggcacagggaatggacttgattaatctcttaacatttgtgagaactttggtattgcctcttcactttctaatttcagttgttcattttaaacctagtgcctgttttttttttcaaggctatgttaaatgaatttagaatcccagtattttaagaaactagatgaagtcctctagtctcttgctcctcaaaaagtcacctacagaatcacccaggagcttgttggaaatgcagaatcttaggtcctgccccagaattggaatcaatctgtttttttaacaagatcatcagatattttgtatgcatatcaatttttgaaaagcactgctgtaatctagtcttggatttacttagaggggaaaactagtcagtggtttattcaacaaatattttagtccttgtgttcaaaggggtcaattaaaaaccgtgttttgggtgtttaaaattagaggagaaacgatttgtcataaaatgaatcttccaacaatgataggcacagggtcctttgggacttagtggattaggcttagaggtctactcagaggagctgacccttgagattttccaggtggtcaaagaaaagaatagcatttcatgcagaagagctagcatatgtggagacaaatagaaatgtgaagatggcatgtttggggtttttgcaagcatgatacagcagagcatgccatcctaataagagaagtggccgggtgtggtggctcaacctgtaatcccaacactttgggggaccgaggtgggtggatcatgaggtcaggagttcgagaccagcctgacaaatatggtgaaaccccgtctctactaaaaatacaaaaattagctggcatggtggcgggcggccgaggttgtagtgagatcgcgccactgcactccagcctgggcaacagagtgagacttcgtttcaaaaaaaaagagagaagcgagagactggattgtaaatgttgcttttgtcctaaaggtaatgacagctcacatttactgactgcactgtgccagacatggttgtgaacagttcgagttaatcttttttataacctatgtggataggtaccaattttattatccccttctctatagacaaggaaataagcacagaataagtcattatatgcaaccagcgtccaagtcctggtagtcaagggaggagagtgattcaagaatgagggaataatcaatgcagcaatgaaaattgaaggccaagtttcataagagctgaaaatccccactggatttggcacttggatccctggtgagttcaggtgcaattttaattaaaagctgtgtgcaggccagattaagatgttttaaggaaagtatgggaagtgagaaaagagtccatattactcttgaaagtttgtaaagggaagcagaaacttcatggtatagggcagtggagctctagagtcaggtctggattttaattctggttctgccatttgtgtgtgatgctgagtgaactgtgctaaacgtccaaggaaacctttgtttcctcatccagaaaatgaaactaatacctactttgtagggttggtatgaagattaaatgagactaatgtgtgtgaagtccctggaatacagtaggtactgtataaaatgaaattaaggttgtggagggtttgtttttaaaggtgagaatgttcctaggttaagaagaagctacagcctagagaggctgacaataaaaagggtctatactgagaagaatggggtggtctgtggtttcacagctagtgaaaccggctgtgtctggtgctcactccactctgcaagtcagaagcaagagaagtcagccccagagtttctatttggaggagcttagaaacaatcttagaaagtgggtgctaaggcagatttctcttaagtatgcctaccaagcacactgcctccctgtctggggtgtgcgattggtggtggattggaagggaactaatggagattgtgggtacgctcaagcccttaacaagcctcccttttcgcagatccttacccgagggctctctagcaactccagagccctctagattttcttctcacaagctttcataaccgtctcttttcgagggttttcctctgcgcagttcttcgcgcgggacctcaaagtgcgtgcccgcttcccttccctgcagcactaaagacaaacctggcgggtcccccggagcggtcccaggcgcgcgcgctcgggagcccacgggccacacccgcctcctagcaaccggagctcaggttcagcctagagagagaggaggccaccatggaccagccagccgtcgccaccgcttccacctcaataagggaagacctggtgggtggagaatcattcatcacagcttcggtaagatggcctgccccttgccggcctggctcctgctcccctcaccaggcccactacccttttcccaccgctctctaatcccaggccttcgtgcccctctcgttccctcttcctacccttctctccctgccctcacgcacgtctccacctgcggaccttccttcctggtctttattggacatttcctttgttttatttcttttccccttgcttcttcccttttccttctccttcgccctttgttttctgtatttttcccttcttcccactactaattaaactggacaactgctttaatatggtgattggatttctttccctttccgctccatctgccggaagactgggtttttccttctgtagttttactagacacgttttgctccgcctcctactttaatatttataaaaatatttgaagctacttttgctacgtttttcttttagagtctcgctctgtcacccaggcaggagtgcagcggtgtgatctcggctcactgcaacctccgcctcccgggttcaagggattctcctgcctcagcctcccgcgtagctgggattacaggcatgcaccgccatggctggcctttgttacattttaaaataaatgtgggtgagggttgtttaacctaatcttttatctttccccttagagtgaatttaaagtggtagatagatggaatttagatcacctgtcttgggcaaaacaaaacagcagctgccaattgtcttccattagattgatcgcgtttacttctctctccttcccatctcattttccttattctggggtaggggtgggaggcctgtcttgacctgcctgagaaagttgtatttctgtgactataaaagtgcaacagagaagattcaacataaatctcgcgaagaagtatcaaagaagaagctcagctttagcagtgtcatgagaaaatgttttttaaagaaattaacatatttcataataaaataaagcccagtggtactcataagtacagtagatttaagttactagacaggaagaatgaattatatcagttttactgattattacttttaatgcagtcttgcttgatgacctatattttatagtaataaaggcattataaatgaaaggagaactcaacattttaatgattttatctaggacaaacagcaatatactaaacggttgtgttctgtggacaatgggctgaaataaatatgaaataataacggatgaatgggtatagagtactaaatatgaagacaaaagcttccttggaaactgaggaataccaaaataatcagcttcttaacttggcaaatgggatgttaaaaattaaagctaccatttattaagcactgattgtatatgcaagtctttataagtacaatgccttagtcttttttttccccctgaggtggcttcttgctttgtcgcccaggctggagttgcagtgatgtgatctcggcccactgcaacctctgcctacggagttcaagtgattctcgtgcctcagcctcatgagtagggattacagccttctgaggagggattacaggcatgtgccaccatgcccagctaatgtttttgtatttttagtacagatagggtttcaacatgttggccaggctggtcttaaactcctggcctcaagagatccacccaacttggcctcccaaagtgctgagattacaggcgtgagccaccacatctggcatacaatgctttattctcatgccaactctggtagtgccttatttttatactactgtgaggaagcacgagggttgggtaactcacccagtgcacctagctggtaagtggcagagctgagttccagcctaagtcggtctggcttcaagcctaactcttttcttcctaaggacaccacattttgtcacatttaagatacttacaacatctctgtgagatgggggtgtttattactctaattttatcaaagggaatttagttatttgaaaggacttaagaccataaaataacaatttaaggaaatatgggcaaatttattattatgtagcttttattttaatgaagacatatcagttgggtatgggtgtgaatttcttcaagcaaatgttttataaattatatttaatttcgagggatcacctctcaaatgaataagcatactttgtgtttgttaacagaaaccagcccaaaagacttcctcttttgaaagagaaggatggtggagaatagcattaacagtatgtacattgttcagtctttcctattcacattattcctattccattaatattttaatcaattatagcttttaagactaacactaaattgtaagaaaacagtgattgttcagatctgcatggacctcatgtcatacttaaaattttagtgtcagcatatgaataagaaactaacttttaattttgaatgcaatagaagcttgggaaagttaaacaattctagaaatctaggtgctttacagaatatctagataaggctaacctatgctcttatgatctgggtgagattgcaaaacaaaaaaagcatacattctggaaaggtgttttggtttcagtttttatcttatatggtaaagaccttctgcaaatggttcttaatatggtcaatatatgaaagcaaaatggtaatatatggaagaaaaatgaccagaagatccccctcaccagagagtttctatattacagacatattttctgtcaatgcccttcaataatagagggacttcatgggtcaaagccttcttggaattgcagtaattttaaaggcagaactgagctgagtgctcagtggaaagatggccacaaaagcagcagtgactaaacgttcaattctggccattcagccacactggttgtaatttgaaagtaccaaacctcttattggactaactaggccatatgctctgccagtttatcctggtgtcatgtcattatccttcagcttcccacttgagggctagagagaaacatagtattggctaagcagatgtaggatagcttctagttagccaagagactatcctgagtggtctcactagaggtctgaaattcatagtcaagcttgaatcccaaagttgaatcaccgaagttgccttttaaaaacttaaatttcggccgggcctggtggctcacgcctgtaatcccagcactttgggatgccaaggcgggcggatcacaaggtcaggagatctagaccatcctggctaacacagtgaaaccctgtctctactaaaaatacaaaaaaaaaaaaacaaaacaaaacaaaaaactagccgggcgtagtggctgatgcctgtagtcccagctacttgggaggctgaggcaggagaatggcatgaacctgggaggcggagcttgcagtgagcctagattgtgccactgcactccagcctgggtgacagagtgggactctgtctcaaaaaaaaaaaaaagttaaatttcaactctaacccgtttgctataattcagcaattatttcagaaaggaaataatcatgattttgaaatactcttctgtcaagagtgtttactgtatttgatataatttcattaaacttgaaaacaaagagagatgttacttgggagcttcccatccaagaatggtgttttaggagaagttacatgtttacacaatcttaaaactgatgtcaattttccacaggatactcctatacctggcacttaccacttgaaaacttttattgaagaatccctattaaatccagtgatagcaacctacaattttaaaaacgaaggaaggaaaaagccacctcttgtgcaaagaaacaatccagtcctaaatgatcttccgcagtatatgcctcctgacttcctggacctgttaaagaagcaagtggctacttactcattcaaagacaaaccacggccaagccccagcacactagttgacaaagatcaggtaaagcgctactggcagattgctttgtgtgggaaagctactaagagcccctgaggaaagtatttttatacgtagagtatatcttcccccaggagaaatggaaaacctttaagatgtcttatttcccgtagaaatcaaacaaggactgcctgatttgcaaatgtttccagtaagatttttccctataacatcttcttaacctaaggggagtacatggggagaaatgttttcctcttgggcaactcttggtgggattcccctagcctggagagcacctgggatcttatctgtcattgggctatgctcttatctcttcaagcagtatatgtggtgaaccctcttcttttaaagagaaaaccctgcctctcggggagtatccttattagagcataaatataactacataccacagggaagcttttaaaaacttttcttatagaaatgacccatctctacaaaaaataaagaaaaatagccgggtgtagtagtgcatgcctgtggtcccaactactctggaagctgaggtgggaggatcacttgaggccaggtgttgtagatcagcccgggcaatataacaagccctcaactctttaaaaaaaaaaaaaaatagctacttgggaagccagggcaggaggatcccttgagcctgggagtttgaggctgcagtgagctatgattatatgactgtaccccagcctgggtgacagagtgacatgctgtctctaaaaatattttttttaattaaaaaaaaaaagaaaagaagtgagcatgtggtcccaggagggtcagcttctactctcagctccaccagttcatttgtagcattgataata

SEQ ID NO: 1527 - DNA, 1128 bp, Homo sapiens
agtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtgaagaccttgtacagaatgtgttaaatttcttgtacaaaattgtttatttgccttttctttgtttgtaacttatctgtaaaaggtttctccctactgtcaaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttgtttagccacttaaaatctgcttatggcacaatttgcctcaaaatccattccaagttgtatatttgttttccaataaaaaaattacaatttaccc

SEQ ID NO: 1528 - DNA, 450 bp, Homo sapiens
atggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtga

SEQ ID NO: 1529 - DNA, 38643 bp, Mus musculus
  misc_feature (7298)..(7589): "n" at positions 7298 thru 7589  can be any base
  misc_feature (12267)..(12307): "n" at positions 12267 thru 12307  can be any base
  misc_feature (21481)..(23275): "n" at positions 21481 thru 23275  can be any base
  misc_feature (24717)..(25512): "n" at positions 24717 thru 15512  can be any base
  misc_feature (30600)..(30619): "n" at positions 30600 thru 30619  can be any base
  misc_feature (32433)..(36269): "n" at positions 32433 thru 36269  can be any base
tcctaatgatgggaggagcagctataggctgggaacacagctccaggaggctggagtggatgcagcaggaagaggggaggtggtccagcagtcattgccatggtgtggccctaacaagggacagcttttccctgaagacccagggtggaacccctgaagataccaaaacagcctcagtcccccagggggtgctgttggggctggaaggtcagcctcctggccctcttttgcttgccttccctttgtctccatcctctctgtctctgtctgtctgtctctctgtctctgtctctctgcctctctgtctctgtctctgtctgtctgtctctctctgtctctgtctctctctctctcccctacacacttgtggaccctgtttgaacactaacgatttctatatcagtgtgacttgtgacttgctctaaacatgctgtcttgcatctcagtccatagcaggaaagggcagctctataaacacagcaacggtggcaggaaacgtccttgatctcacagccaggcaagaggtgtcctcacggagcacaaaccttcccagtgctcctcagtgctcctcacccagaagccatggctcctctctcttgactctggagtgagtacagttaaatacagagcaaaggctgcacctgggaaactggaggactgtcggggatctactgtttacggctgttttcctgccatgacgacagaacagcagccgcaaagccccaagtgtttactatgtagccttttctgaaaatggctgccagccctatgctgtcattgggcagagagcgctgtggtgatactctgttccacactgacagtctggatggagcagggtgacaggctggagttcactgtaggtgggaggagaggagggagatgggagatggagggtgtgctatgttcccttagcaaatacgagagtagccccggcttcccttcccagggcactggtcagcatatggtactctgtcccatgcagcattgaggcaggttggtgatgtactttaagtgtggtttgtcacccaaggatccctgtgttggaacataagaggaggtggcagaacatttttgaggcgatccagtgtggggcctctgaaattagccactagcagcctctcaacatgtaatgagtttatacaggacctgggtatatagatgcataagcaggcacacaaatcaaatattttctgacaatcaaattttattttaaaacaagtctttgatatatatatatataattttaatttattaaaaactaaactattattaaatattaaattaacatatcagtgctactcaggaaattcttgttatttttaataagtaattaaatcttggttaaatagatagtcctgcaggacatcgaaagtcttcaatggtttttcgagttgatattttgaattataaccatcaacagctttttttaaaaatggggacatttttttgtatgtgatttccacagtgtgctcagaaccatttcaaaaactagttggagactctgtgctaactcctggctaaaattcatcaaatgatactttagaacaacaaaacttgaggcagcaacttttaacagtcaaacattctaacacaggacctgggtatatagatgcataaacaggtataccaatcaaatatttactgacaataaattttattttcaaacagttctttgatgtgtgtgtgtgtgtgtgtgtgtgtgtgtaattttaaattcaccaaggactaaactaatgcagagataccccagtctgatgcttatgtattgagaaatgatggaaagaaatgttacagttctgttatgtttccatgagagaagaaaaccgcttatgcatctcatagtgtatcatcgcctggagtccaagtccacgtgtttcaggcaatgctcgctcgtcagcatggtgaaatgtgatgtcacaaccttggcaaagtgcacatgcgttcagaactgctgcttcagtgatgtcacacgataaaattgccagaaacaccagggccattacgcttttgatttcgaggtaatttttggttgagtgtgggtcagaaactttttaatgaggatattgtttgtgtgtggtttccacagttatgtgaccgcatgcagagggtggggtattcacatagtgttgtggcccacagtttaagagttaggttctagccaggcggtggtggcgcacgcctttaatcccagcacttgggaggcagaggcaggcggatttctgagttcgaggccagcctagtctacacagtgagttccaggatagccagggctatacagagaaagaagaagatgctaggttctagtgggtgatccttatttctctgagggccccaccctaggaaggaattaagatggttctaatgggacccaccccaagatggctttcaggtgttcttttaagtggatcctgatccctaagtccagctcttgcttcctgtctctccgtgtgagcatcttgtcacatgtaccctgtgacatcctccgctggtgtgatgcagccagggagtgcctcaatagagccagcataatgctatttggattttcagcttcccaaaccataagttaaaaaaaagctacgtttctttaccaactcaccagtctctggtatttcattccagtagggggataacagactaactcaactgggaaatattactgttgcagaacccatataagctactcaaatcagtgcattccttgctaccctccccaatgttctgggttctcaaatgaaagacacatacacacacagggcgccttaaaatataatatgtcttaaacaatggttgggccacttttctaacctccaagtggctgatggacttttttgacaatctcaactcatcccttactaaaacctattccatcttggctgccccagaccctgacctgcagccctcctaggccacttttgcatggtggctatgctctctcttctgcactgcttaggcctagtgtctccttcttccttcccagcatggcagctatccttcctcctccctcggttccttgtccaggaattctaaaagtccccctctgtcttcctgcccagccattggctgcctgctactttagttaccaatcaaaaccaaatgggggcagggatcctcagcatcttaacgtgtggacaagtggcttctcctacaattttgaggacccaattcacataatacgagcattatatcaaaccacaacattacttttagctgagtggccatgagtcgccttgctacccccaggctttttaagtaaaggagatgagaagagtggagtataccagggcaggcagtctctgccacactagtcaagaactcaggcaaagtgtgtaacacgttcaaattgtgccgatgttagcgatatatatatatatttttttctccattctctcctcaaatatttatgaagccctcagttatatgagggtctagctaagtgccctttatagacaagaaaaccagagaacaggagccaggttttgagaggaaatagtttttaccaccaaccaaggacctttggggcaattgttcccagactctgcagggcaggagcccagtctcagagccagcgagatgtggtgcctgggagcagccatctcctgaggacaacctggagccaggcccaaatgggggtatccctggactcctgaagggtcagctcagtgccagaaggtgacagcttacagagccagagcctatctagggttttgggttttgtttttttgactccttgtcttttcctgactccctttgaaacagcaaggctgccctccacacccctgtgcatggcactgcactggaaatcagagaaactagatactaaaggtgggtttcccagtctctccttcattatagcaaagactgtgtgtggcatgtgtgtgtaagacaatagctccagtgcatgggtgtgtatggctgtatgggagggcatgtttgtatgcataactaagcatatgtgaatgtgtgcatgcatctgtccaggcgtgctgtacacagggttcattagtgtaccttaacagcgttctgagaggcttgacagcaatgtactgagtttgtcttcgtctactgttacctgcttcagagtggagcatatgaacgcttgtgtcgcggatgattgattgattgattgattgattgaatggcatatggcacagttaacaacagcatgagttctggagtcagccagagtggagctctacacctctctccgccactcactgagttattttagcctcctaacctcgtagcgcctcagtctccacatctccagagcaggcaagagaccctgatccaccctatctatgaacctcagtgtgggggtgaaggaagagtaatcaaagccgccccatttcaagctggcccagggctctctcctacgggctgccgcacagctcctcccccacagttcatgggccgtgtggtagcacaaactcttctcagtgcgcacccatgcaatttcatacttatggtccgtggacatccaagaagagctcagaccttaacttacaatccagggggctgatgcttaagtcctcctctaggtggcgccgcagaaaggaagcccgactactgagtcatagtgccccctggtgttcattgacataaaaatgcaacaaatggggagctgttctagacgagactaaatatggaggtgaggggatttcaatatgataaattgtatcatagacaggagcaaggcaaatgggaggcagatgtgctggggagagagagaaaggaggggtcaagtcatactaaggaaattatcatgaataatgttaacatctataattccctctccacctattatgtacctgatattggactaagctttcatttccttcatcaacacaagtgctacaaggtgtgtttggagccgtctgtgcagtagatgctcattaccctgttgactagatgactgctttttacatttttttattgttttgtgtgtgtgtgtgtgtgtgtgtgtgtgtgtgtgtgtgtaggtttgcacgtgccaacaggatgcacgtggcgttcagaggacaacatttaggaatcaattctctccttccatcatgtgagacctagagatcaaactcaagtgggcaggcttggctacaaacacctttagtcaccgagccatcttgagggcccaagatagctaacatacttctgagagacaaatattatctcaatttaggaaactggatgcacaaactcgtggccaagaaggcggcagtgccggggcatgtgatgcttgtgacctcacaccagctctgcctccgggagggtggggccttaccttcatgggatttgccttttcagcctccccccagcctctgggtactcggctctgcctgggatcggccagcgatggctatttatggctcagggaggcgtccagtgaaactcccctcataaattatgaagggagacacatgtgggtcaggacaggagaacttggtgcatgagggaaccccgggactcttgctctctctaatcagggattttccttctgttcccaaggaagcagctgctgcagatggcagaacagccagcgtcgcaaggggtcccagggtcctctcaggtcctgctgtttgggctcctagccctgactgctgacagctctctgcctcgtcccctaaatggggctgtctgcattttcatggttcctatgcccacacaaggagggcttgaacagtgctggatgttttgtgccctgcccattctctctctctctctctctctctctctctctctctctctctctctctctcctctcagctattttctgagcatgctcagtcttgctctgggggtacccaaaaacctggatcccctggagctatccctttccgaatggcccttgacacctggtttgagtgtgtggtgtttctttttttatgctgtagtttcttggttattgttagtcttttgtttaaatcctatctacctttaactccctctagcaattcattcctccctctgacttgctaatctcaagtctctaacctggtcactaagcggctagcattggggagatgtggaagaagcctgacagaagtcaggggttgagaactttcttctgtaaatgaaacatgccagtctccatgtggcctttgagcttcgatggctatctgtctgtttgagacagggcttgccgtgtagcccaggctggcccacgccgaaggtgaagtggggagtcagctggagtcgggaagattgcaccagcggctgcttggtatgtgtgccaagcaacggaggctttcttatttaaggggcggactgaggggcctgggtgactcctctctccctgggacaggtggctgcatgaaatgaggagccgggacgggaggagagcaggaagcatggcagctcaggacgggagcccactgctgacagggtgtctggcttccaattacactgcctcagagctccacataaaattagcagcagcgttctctgtaaaaggagccagagaaataaccacattcagcagaaccgcaagcagggacggaagacagagggagaaagggcaggcttggcccagcgtggactccaggtcccttctaggacacccttggcccctgctgcccaggtggctcccaggctgagtcaggaacacaggataatcctgcaggggtcggggggggggctgagtgtgggagtgtgggaagggggggactgaggggacctggtcaggtggcctagagggctcaacacacacacacacacacacacacacacacacacacacacaacacacacacatgggtgggggagggagagggagaggaagagagaaagccaaaaagaaaaataaaggagaaatggtttagaatatgttggcttgtgggaggacatgctgcccttgtgtgtatgtacttgagtgtgtgtctgtgtgtatgtgatgtgtttgtgtatgtgtgcatgttgtatgtgtatgtgtgtgtgtctgtgtgtgtttctgtgtgtgtgtatctttgtgtgtttctgtatctctctgtgtgcatgatgtgtgtatatatgtgtgtatgtgtgtgtttgtgtgtgtgtgcatgtgtgtgcatgtgtgtgtatgtatgcttgtgtgtacctgtgtgtgtttatgtatatgtgtctgtgagtgtatgtgtgtgtatctgtgactgtatgtgcgtgtctcctgtgtgcatgtttgtgtatgtgtgtctgtgttctgcatatgcatgtatgtgtgtgtgtatattcgtgtctgtgcctgtgtgtgtctactactgtgtatatgtgtgtgtgtgtacatgcgcccccaccaagactccatcagagaaaagtattcgctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntattcgctctgcttgtgacgtcaccactctccgagtcagaggctctttagagaccctcagaaacaggcatacctgcccacacacagttgtactcgtctctgcacaaactggccttgaactcctggtcctcctgcctccacgtcctgagagctgggattacatgtgttcttacccttgttttatttggtgctgggactgagccagggcttcactcacgctacacaagtgctctgcatcccagtcccaaaccagcacattttcaagccaggacaggcatgctgtgacacagtctctcactagtgctatgtgacattctcttgtggaagcaatgtcaccatttcctgtttcatgaccacctgttgaccaacattctcctctgcaggggccaagcttgtacctctgtgctcacagacccccctcttccactgcacccctccttgctcccctggttgtttcctccaaaagctgggacgcctgagccccgaggcccagccagagcctctgaatcatgtctagctcctcaggtgtgaattcttctgaagtccaaggcgcctggatttgcagttttgtgtagtgctgactccgaactgcttcctcagcacagttcagagccagcttttctctggatttcacaccagtgggggcttcaggctcgaggctctgaccctgtgcattagctccctctgtctacccatggctggagaacttccttcgcttcctcgggcacccaggccaatggctgagaaaccctctttggtgtttgctgtgatatccagcttcacatgagagctcaaggtggacttcctgccagcagtgggacatgtgacctgcatctggtctctggccagtcactggagcctcatctttagtaacacatgtgtttgccgttccctaggcctgggtatcagtctccatcctcagtcatgggtacaattcctgctcgtcttagacctctcagatcacctttccttgtcttgagcagggatttgtatgcttaaaagagctaactctgtgaactgcggtacttctgtgtgctgggagtaggtcagaccgtccattctacgttcctctaccaccctgatctatctgtgcagtgcaaaggccttgatgaacatgcagtcactggtggagtgtccctctcccactttcctgtcccctcctgtgactttcttcatcctcgtttctgtctccccaggagcccatgccctgcctggccacggggagggcagttctcactgggcagactctatcctgggagctctaggttcatcctctctgggctgggtcagggccagaagatcccttcagggtgacaggatggagggggggacattttaaagtaaggatcctaaaacattctatattcttggagccagatcctgaggagtctgagactgcttccaatccagccccatttaaggtgagaaacataggcggttccagattcctcagggggaaggccctgtccccacagccacgttcccaagttggggagataggagcctgattcgggcaggctgggcaggctgccatctctccttctgtcttagcataccatcaagtggagctggggggtgggggacattctctgggctgctgggcccatcctcactgtaggctttggagagctccctacagaaacaagcattagaaggagccgacgaagaacttcctccttctgctcacataatctgggtgtccgcagtgtagtgctggcctggaagaagcctaacacacaaacacacatttggaacacactggggtagggaacccctctggtgagagcttgccgcaggaaaagcccagagagtggcagggagggtctggtgaggacaggtttgtttcttagagggcagcttctgagctgagacctacaggagataggagaggagcgttgggaatgtggtggcaatgagggaagagagattgggagagcaggcagcccacggggccttggggattctgaagccagcagcgggggcttggggcttttctgagagctgagtagggaggtggaggcagattgtaaggagagagcctctgtgtggatggaagctctgggagagctgaatgtggtatctcagagcccagagccccagatggggcataaaacaatgacttcctagtataagagggagggggaccaggagagcttcctggaaaaagcactatctccaccagaccttaggaatggcaggtcttggatgcttgagaaagggattcaggaagaagcctgaggaggaagtccacaagtgtccttgatggactacccagggctaaaactgctctatggtgggtggagctcagcaccagagacaggcactgaggaaatccccaaagccagtggcctcacgcaagcccagcacccaagggtgccacttcctcaactgctgtgcagctgggaagtggctgagaagacgtgtgagggccaggcagctcaaagcctgaaggaggtacttcaaggagggtccagagaagctgggcagggcgggacctcctcaaaggctgcccccggggacaccccaagcttcaggaagctctcagatgcacataggaggaagtgagaggtgaactcggcctggatctggttgggcaaggcccccatccatctgcttttctgactacccacagccatggccctggcccagcagctgcgatcagagaggtgagagtgtgcctctattccctgccaggctttctcaatgatcccaataggcctggggggtgggtatggggaggtaagaggctgtccctcctgtcacctgatatcagtggatcagcacagagtcaaatttgaaggtcttgctgaatgatactgcaggagctgcatgctccagcagatgtttctagaaccttgacttagtaggtcggcagtgttatgcaccagtgagaagcctaaggctcagaatggggagtggcttggatgtggccaaaggccacagggtgagtgggcggcagagcctgggagcagaggtatcctgggtgctaggcttgggttctgggttcctggttccacactgcaatcaggagcggctcttccatctgcccttcagactgaaactggcctctgcgttttcctatctttaggttcagatagcccaggctctgccgtctgacccctcactccacttccttgtcctgaacaggtcttggatgcttggcacaatgttgggggccgggtctctgctctgcctgctctgagggtgttttagttttttggatcacagttgtgtctctgggaggccgaacggccctgggacacactgagagctcaatacatctgctaagagctcaaaaatgacccagatctatcttggacaatgctgacactatacaggtagggacaaggagacctgatggccccaagcccggccacctcattcagtcagcccttgctcagtgtctcttatggagacagccctgtgttcccatctgcatgtggagactcaaatgacagaaccgtcccctgaatcaagcagaaagcaacgttaggaagccaagtgtccatgtgaactgcttgagagtcaccagaacaggtctgactgacaagacccaggtgtgagcaaagcactcgtgggatctggaaaaagggatgggattcctgtaggtcaaaggtcagaggaggtttgtctgtgtggtaacaagagttagtgttgggtgggggtcagatggccttccttccatagctatagagagtgttactggggtgctaagtaaggctgcataatatgaccccagcctttctcacccccaagttctcctaggagactgacagacatgcaaacttgaatcttctagaaactgtagccacttgaagcttgggtcccttcttgtttcttggggtgcagagttcagatggtgcctgtaaggactatcagggctcagtgtttcctccgcccactctgccctttccacagctgttcccccgccctctgaggggggcggctcttctcctctgcccctgataggaccatggacccaggtcctagggccatcagacccagtatctccagcgtcctctttgagaaccagtccggcagagatacagacgaggagatatcatatatagtgtctcttcgagggcagctgcagagtttagctcccatggccacatgtcattccagctcccactgtgattgaggtaccacacacctgcagttttcaggactcccctagatcaggtccccaagcgtacctccatgtgtagctcccgtgtgcacagagcccggtggtatccacccaacaaaacccgtgtggggtccaagggggacagctatcttcccagtccccttccctctccccacaccacagcctccttggcagctcagctgcagacggctcacactgggacaagtggaagtagccgctcaggaccttctaggcgcctggcgccgctctgggtgcttaggggatgcagtgtgctcttatggggtggcagggatttgatgattgtctccattttcagagaggggtgggaggagccggaggatggggagaggccccacaaggtctcttctgacagggagctgagtgaattctggtcctagtccagggtattatctggccctgtctggcctagtatgtcttctgacactagcgctgcccagacacttctggtttctcctaccccagagaaaggttgctgttcttccacgaggcaggaaggccccttgtgtgnnnnnnnnnnnnnnnnnnnnnnnnnnnnnnnnnnnnnnnnnctccctggtgccatagccggctctctgtgctttccttacccttggctgtagggaaccccactttcccatggcaatcctaacgtccccacccccaccccaccaactgtcttctgctccactgttggtgtcttgaagaatgtgatgcgggtcacctgtggaaagtccttggcccgtgatgaaacagagggattacttcttgggtattcaatttccccactcctcagagctatggagtacaagaagcagagagcaggaccccgtgatgctaagaagtgtctgttctgtgctccaggctgcagaatgcggggaacaggcccagtgctgggcttcatccaaggtctctcagcttctttgtctcgaatcccactcacctcacctgggcaagctccataacctctcggtgcctcaccatcaccctaccccagggtggctctatctccaaggagtaggtgcccagttcctggtgtggtgtgagcactctcagccattagtgttacccaaacttccagaatggccaacggctatttttccctttccagttccctcctgccccaccccagcttctgggggaagtgggtgaggccactctttcagaggatgtcctcatgggacatgttgaaaagcgagtgggaaggccccagtgaccacagaggtgccccagcctgggggacagcccctgctggtctgctgacttccccagtcactgcctggtgacttctgaatccagatacaccatcctgggacagaccaggtcccaggggaccagagaaccagcatggactctgtgcagggtgtgtgggctcctagggatcccatactttgtgaggtgtgggacaagtcctatctgtctctcaggcactgctaggagaacccaatcacttcttcagctcctcctcctcctcaccctccttttcatcttcctccatttccatgttcccttctccttcctctatctcgccctccttcccccttccttctcctccccctcctcatccttttctcctctctcccctctgtcttccatctcatcttcattggaattctattctcctcttcctcctctcttcctcctcctccttttcctcctctttctccttctcctttttctcctcctcttcctcctcctcctcctcgacctcctcctctatctctgcctcctcttttgaaacaggttctcactttgcagcctgggctgagctagaactcctcattccatcctgactccctctcctcagcctcttcatttctgagatcacagacatgtgccacctatgcctgcctacacccacttcctgcttcctggtctgtacacaagtgacagacggttgaccttggctgtgcctggtggccggcttcctctttctctgcttgcccttctcaaccctctccagttcacttaagggtcttaagtcttagccatagccataagccacaggcaggtggctctcactttaaccacacgtcagccccactctgccatctccacacctgcacaccagcctcctgctggatgcctacctagagacatctcaccttagtgaggcctgagcagccctgcctcttcctgtgctggtcagaaacaggcatcactcttgtcgtggctctttctttcagtccaggttggctgctataccttggtcatgtatcccttggaaatgcattagactgcagggaaaggctggtctggtcttggcttaaatgatgaccagttgttctttttcacagtaaaagtccagactgcaactcgttccatagctcagggggctcaaagccagccctgcagaatttttcattctgcatcatgtttttgcctcatgggtgcaactgtggctgtggatccagatgccaccccaactccatctcattgaccagagctagtcacatggttgtgttgagcctcaagggcaggtgggaataggaataggagcaatgtttggtccaggccaatcatgcctctccaagctagacacacttaacattgagcatggctggcacttgaatggccaggaaaaaaaaaaacaacaacaacaacaaaacaccaaaacagcaggaacatatggaatgctactctagcattgtgctggggttctctatcatttgcatgtcctggccgatatcacccttcactgtcggagcttctcatagagctgtctcattaagtctctccccctccttcatggctggccacctgtggtgacctccttgaaccacctagttccttgatctcaagaccctcatatgaacgtatccaccttaagacccaccaggctctcagcaaatctaaactcttcctcagggctcagaaccttagcacgagccatttccactacccggaagaaccttcctagattccagtgaattccagttgacccaccaagagctcaaactccacctttctgaagcttttccttacttgggcatagtcaacaaaccgatctcttggctgggggatgtgggctgctctctgtctgtcagcctcatggtactatgacaaaatactggagtcaattaatatataaagtaaaaaggtttatttaggtccagggttccatggatcccgcctaaaagcatggcaacccctttgcctgagtctctagagatggcagtgaagtgaagcagaagtgcatggcagagtaaaccaggtgcaagcagaggagctggagaagaacatggtcccttagtccccttcaaggcaatccctggggacccaaggacgtcccatgaggctccctacctagaggtccacaacactccccagtggtgatgtccattaactgtgggttgtaggggacacccatacaaaccccttcaggagtcccagcacacacttcatcctgtgacacagagcctggcacaaggctggcacgaaatgggcaccaggacctggcaagttcttgggtagcttggactagaagccagctggtgacaccaattccagctccgcacccctcattctcagggcttgacctgtgtgtgccctgacatctcggggttcccagcctcagtgaggtgccaggcatggacagtgttcagaatggggtgtgcaggcctccatcagctggctgtgtccagagcaggcaaggtggtaaccgatcccctccctctggcctcctacagcgactttgagcagcttccagacgatgtggccgtctcagccaacatcgctgacatcgaggagaagagaggcttcaccagccactttgtaagagtcagcaatccctgttcccttgacctcgaacctctaatcttccaccttgacagtggtttctctggactgggtggttgctgatatttgctggatagaattcagcggtgcttctaaacacatccaaaagcatgggacaccacactgaaggcttaccccactcagtacactgcagggcttgagaaagcctgtccctctctgtgacctctgacctcatacagtgctcatctcccagtgtctctacctcccagcccctccccagccccccaaccctttccactttccagacctgtccacctctcagctctcctaccttataaagacacccagcctcccggtatatcccccccaccccgttctagctcccctcccccagtctctctcctcctcaggtttttgtcatcgaggtcaaaacaaaaggagggtccaagtatctcatctaccgccgctatcgccagttctacgccctgcagagcaagctggaggagcggtttgggccagagagcaagaacagccctttcacctgcaacctgcccacattgccaggtaggctgcactctgtccaacgcccggagctggccctgaccctggcctcaccttccagctcagcagcatgttatttcaaccctctttgcaaacgatgcatttggctggtgcccctcttgtagccataggctggcagtgcccccctagcagccctctgcctgccacccctctgtcttcagggtaccttcactgctacagtttctgcatcataacccttgacctacctctggggacacagtacagccatcttgccacagccattgctaccaagggagcctgggctgggagcactcagcacctgggttctggtctttcttgcctctctcagccacccatgagggtggctctccagccacacagcctcagcctcaacagatgactgcagctctccctctctggcccttggggaagcagggagccacacatagcttctaatcccacccctgtcccccatctccttcccatatgcccctcgtcccaaatctcccatgccacctcctcccgagcttgcccaagaaagtccttggagatgctcctgactctatcatatcacatcttccctaagcctcagaggcctgcccatcttcccttcttccagcccaccttctgtgggtgtgctgtcccccaaacacattctcttcatccatctccaaaaaggacactgagctgagaggcaaaggacctcatagctcctactccccccacttctgagtggtgaggaggagacaccactctccatctcccccccctttcctacaccctttccctgagctctagtcattttccttgacacaccgcccccctctggagcatgtgaagaggtcccccatcacaccctgtctgatgagcgttaaccaagcagtgctgtggggagcctctgttctgagcctcctatcctgagggctcccccttgtgcccagcctcttcccccattaggcctcctccaccagccttcctgagtcccgtccacctttcttgctgcaggctctgctcaccttgggatgggactctcccccatccttgcctgtctcatcttctcactctgaacaactggtgcctgtgactttgtctcgtcttggtgtgtggctcctgggtagccccaacctttatatacccccctcctggcatcacaggtgcccacctttcctgccctattgcacaggggcctctgggtggcagctcctttaagtgtctgccaaaggctcctggcggaccttcatcatttggaccttcatgcactccgctccgcgttagaggcatggctcattcatccacaaagcagattcttagttctctgaagtgtgagtggggcttggagctcatggtttctaactatggtagcctgctgaaaggaaacttacagagccctcctacctccaggatgccaatgtagtttttctggggagccctatctaatgggatgctcaaaagctcctatggtgacctgagtgttatccaagcctgaagctgggagatcactgtgatccaggcaggcaagaggtcctgagttcagagcgtgcatctgttttatgcaagtgtacgtatttttgtgtgttaaagcatgttgcatctgtgtgcatttgtgcatatacatatacatatgtgtatgtatatgtatgtatgtatatatatatgcatgagtgtgtatacatgcacacataggccttacatgtgtatttgcatatatgtgtatgtcggtatactatatgtgtgtgtggtgcatatatatacatgtcccagactgcaggtgtatctgtgcatatgtgtgtgcacatatgtgagcatgtatatataagttcttgtgtatctatttgtgtgcatttgtgtgcatgcatatgagtgtgtattcatgtgtctatgtgagtgagggtgtatgtgcataggcttatgcatgtctaagctttgcatgggtacatagagtgtgtgtgtgctgtgatgagcatgtatgtgtgttcatgcatacatatgagtatgtgtgtacctgtacacacctttgtgtgtaggagcaggcatgacattgagagctccttctgccttctcctgatggtatgatgggaagatgcggttggaaagtatctcggtgacacttggtaccatgatagaaggcaggaggaaccctgagctggggaggagcattggggaggagctctgggctggggaggagcactggggaggagctctgggctggggaggagcattggggagaagcactgattggtggggcagctgaagagtaggcaccgtatggtccaggctctgggcaacttttctcttttcagccaaagtctacatgggcgcaaaacaagagatcgctgagactcggatcccggccctcaatgcctacatgaaggtacctgctgccacatctccttggggtttgagtgggcagggtattactgtggggcatgagtttgaaaactgacattttcctgaggcctccatgatcccatcttcaatcctgaaaggcctggctggagagagaagcaaggtatgcagacgggatcaaggagctgggtcacaaaagtcacggttgacaaatccttgagtgcaccaagctcaaggaatgaatatttgtgctgagctctggaatgcagtgcctgccccagagcacctgcggcccaggggagacccttacaaggtagtgagcaccctgtcaacagtagcatccaagccatggtctgctggaaagccttcctggctgtccagaggtcctttacagctggagtgctctggctttggagacttttgtttggatgggtgctttggagcgagtaagcagtcctctctcaggaagtctcagcttccttctgttatgagacgaacagtcccaccctccccggctctcagctcccaatgagtggagctgggctctattgagaaaatgaagggaagggggttttagaactgtgaacctgcttctaggttgtaatcctgagggatttcccacagaaatctggatgcttctggaactgtagctcctgtacagtggcctcagcgctccagggtacctgagccctgtgggactgaattggtagccatgccagtccccactgctccatgtcctcacgccttagtcacactgtgtgcacatgggcagagagagaaatgtgctttgtcctgcaagccctccccctttcctcaccctgtcccaatcacttctcggacctgcccccacccccaccccatccaagcactgtctctccttatgattcattggatagagtgcttgcctagcatttgagaagtcctgggtttgttccccagtatcaaataaaatagacatggtggcccacacctataatcccaacacttaggaggtagaggcaagatgttccagtcattcttggttacatagcaagtttgagaccagtctgggctacatgagccctgatatgagcacctccggtgtctctggatgccccagttgtgttactaagctgtgtggctctgtgcagatccttttccctttctgatcctagcttacaggtttctggtgtaatcagcctccttaatcgacctctggagacctttaggtgatttcagatgacctcttaagccagcatccctcccctccccactacccgctcacgctgggccaggagcaaagcttgggaattgtctccttcaatcgctgaggactagtaacgtttttgtttttgttttttgttatcagctgagaatgcattagcagagatggtagacggggtggtgtgttgatagggctgtctagatcttttcgtcgactgcccacctgtccctcctcacacagaacctcctgagcctgccggtctgcgtgctgatggaccccgacgtcaggatcttcttctatcagtctgcatacgatgctgagcaggtgccccaggcactccgcaggctccgaccgcgcacgcgcaaaatgtaagtggccatccctgcacttctgatcccgcgacggagtccaatctctctagcctccaggagtcgctgttgcttcttgttccaaagactccagtgctcccttctcaccctgttcctcttagaaaaatgaaccaggcaggccttgaggcaccaaagtagtgaaatggtgctcgtttccgttcgagccacttctttaagaagccaaggaaaagcaggcaggaatcttgagccctgacctccgccaaagcacctaagagggcagggtctgaattccggctttgcaggagagtttggctctgagagccaggttgaggtctggtggagacttaagggcactgagccgtgatccccattccttcttcaagctctccctttgggtcttctgtgggagagcaacctcacctggggcagtggtgagaatacaagatgaagggctagcggcaagagcaaccaaccataactggtggctgcgcataatctttctctccctgcctctccagggacccacaaggctgataccccattttctttccatagcaagggtgtgtctccacaaggggccatcatggatcgcatggaagcgccaagagcagaggtacccacacacaggctagacctcatccgccgcaactgtggcgccctcctgctgtgtgccactgtgcactttggatggtgttgggtgcacagcatgaaatgccatggcaaagaacagtgggatggatgcaggagggctgtaacccatagggaggccagcgaggcgggggagcagggcaagctaggcacagagtttggattccccccttccaaatgtgaaccctacctgctctgaaaggaccacccactttgtagttgggggagagtagggttttaatcgaagtcctctgcaaacagaggggctgtatcagcacccttccaaaccctcagtttccttacctacagagagggacaccacagtggtcaagcccttcaaagactcagcgttctctctgtctcagcaatgctgtccctctcctcaggccttgtttgacttcactgggaacagcaaattggagctaagtttcaaagctggagatgtgatcttccttctcagtaagatcaacaaagactggctggaggtaagctggggagaggggttcagaatcaggaagactaactagaggcaagaaggagggtgatggcagagtacatggatgatggggtggaagtggaattggaggtgagggtggaggtcagatggagatgagattggaggaagggctgaggtggaggtggaagtggagatgaaggtggagagaggttggatgtaaagttagtgatgagaatggaggtgaaggtggcaatgaaggtggaggtgaggatggaagtaagactggagttaatgatgggaacaaggctggggttgatgatggggtaagggtgggggatggtggtaaggatgggggtgaggatggaggtgaggatggggtgaggatggaggtgaggatgggggtgaggatggaggtgaggatggaggtgaggatgggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacagtcctggaggtcctggcagggttgggtgacctgtggggtgtcctgtttttgatccagatgtgttggtgaagcagaacattcatgccacagcatatgtgagggaacagcttgcagaagttgaccctctcctgtcaggctggttgtggaagtgaaactagggttgtcagacatggtagcaccctctttatccactgagccatttcacagcctcctccccccacccctgccattctctttaatttcttgatcactaacaaggcttctaggaactgacactctttgggggtggggtggggtcgtggagacaaataattcctgggaaagggcaggctatttagggaaggaaaggcagtcagggtgtttagcagtaccctggtcttcccactaggtgtcaccagtgcacctggtcacagcaatcacataggtttctccaggtttgctttgtgggggtcagactttctccactgagagaagtgaaggctcatatgtaataatgttacttccctaatcagcagcaaggatgactgattaagagtgggtgtccgtgcctgaggcagctcggtagaggagctctcacctagtgtgcaaggccctgggtcccactcaccatactgtgagacaacagaagatctaatgcatttctagctgtccttgtgtacctcaggaggttgcttaaccccgtggtttcctttcctgtgaatgatgaaaacagtttcttcagtggttcccgtcagggacaagggagaggcggatgtcctccaggccttggccccagagagtctaggtgcctcgttcccactgcatgtgaggggactgggaagtcttgaatgtgaccctgaagctgggcccccttgggtgtttctttgctccacactgacagggaatgactgtgccaggtccctgggtctggtcatctctatcataatattgtcaccgttggacattctctggccctcactgtgtctgaaggaggcagggttcccggtatcctgaggctgggcaggagtgggagtggcaggtgtagggatataacactttgagcttctgcctccttgtgcactgggtctcagaagccatgtccacccgagcagtgactgttgtgaccaccactgtcataagaggaactgttgaccgctttactgtcttctggaaagtcttactgtctagtgtgtcgtcactggcagacctcaggctgcaggaagggcctctgtggcgtaggaagaggaaggagcctcagtctgcgaggcagcgggaagaggatgtgattcctggggctgcggagatcaatcaggcagcaaacaggacctgagctcaatcccagagcccacacactaaaaagtcagccatggtggcttgtgcttatcatctagctctgggggagacagagacagagacaagccctgggacttgctgtccagccgcaaaccagctacaaatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtttcaaataggaaaaaaatgtagataaagactggagtgacatctgaagtaatcctctagactacatatgtacacatacacagacacatgtatgtacacactcacataaatgcacacacatgctcacatgcacatctgcatatgcattcgcacacataagtgcatgtatgtacttacacacatacaaatacataagtatacacatgcccacacacatataaatatagatgccaaaaagaatgcatcttctgtctcgtggccatggaggttttaagtgaccacatgagcaacacagagacaggattgggtctccccagtcctgcacttaggtgagaggcccaagcctccgggtgacacccaaaacctgtggaggagcatgaagcactttcaggtctctctgcagtccccaatgtctgcctcttgccctgatttcccctttacacgcgtagccattgaccacagagggctgctcatgtgtccctgtcgttctgtgccatcaggagtgctgcatgagggaacagtgcttgtgtaactcccggacccatagatcgggcatagtggtgctcgagaacctctgctgaaggaaagaatggatgaggaagagaagaaaggaagaagggagatgggagagaagggagaggagagacaggtgaggcagggagcttcccagataagttcagggctcttataaaactagagtgcaggtcgctgggttaggcagcctggtgaatctcctcactttgcctctctgtgttagttggctctggtcactataatagaacgcccgaggcatctagcttatgaagaagaaaggtttgctatggctcacaatgctggaagctccaattcctgcgctgaggtcctgcatcctgacaggagcgtgtgagagtaaaattcttgcattgtggttagaaagaaaaataaataagtaaaatagattaattaattaattaaaaaagaggaaaggagcaggtccccactacttgattaagggagccctctccctagcaagaaaggacatttctattagtatctatttctccaagctcccacaaccaccctggggaccaagcctttgacacctgatctttgggggacaatctatgacaatcgttgttgtaaagagtgtgggactctgagacgtgaccctgggtctcaccagcctcttctttcacttccagggcacctcccagggagccacaggcatcttcccagggtccttcgtgaagatccttaaggactttcccgaggacgaggacaccaccaactggctacgatgctacttctatgaagacacaggcaaaaccatcaagttggtgtcctgctgggagaacgggcctcttactcctccctgccacccctaccatgccactgtctcccagtcaacgctcctgtgttgtctctcccctcccctgcagctgctgctgtggctcccagataaaccatagtgctttagcaagagcttgtttctggcaccacacacgtccctcttccaccctgatgcttgtctcttctactgtcccccttagggacattgcggtggaggaggacctcagcagcacgcccctgttcaaagacctgctagcgctcatgaggtgagaggttgggaagggagggagactttggagggcaatgggctaggaggggacctgtgacagctccagtctctgcagtacacggtgccttagagaggagccaagcaggctgcagagggcaagggctcagtggaggtcccagtgtgtgactgtggatctgctatcagaacatctctctagcgaaaagccttgtacttggacacacacacacacacacacacacacacagagctggggaaattccaggccattgctgaaaagtttactcatagcactgtcccatctctcacgattcaaaacagcgcagtctgtatgaggactatattgcactcctatcgttagctgatgtgtgctcagattctgtcagcacatgcacaaacatgtgtaggcacactaacacacagacacattcacacacacacaaaaaacaaacacacgaaccaatacacacccaaaacatataacaaatgagcacaaacacacagtgtacacacaaacatacacaaacacacaaagatataacacacaaacacataatatacataacatacaacacaaacacaaaacaaacatgtacgcagaaacacaaatatacgtaaatacctaaaacacagacatacacataaaagaagcacacacactcactcactcacaatgtccccctggccatagctaccattctcaagacctcccgatggcttagcccccataccccggttaccactgacaagaatattgtaaatcttcattcacatataccgtctcattatcaagaagtgggattatgggatggaagtgtatgcaagaggattagactgggatggcacatggggagttagttcagatcttgttccctccagccatgatgaagcatggccctcctcccaaagttgtcactggttcctacaggcctcctgggcagccttgctttctcttaggaaactcctaaaccttccacccacttatacacaagaagcttcaggctgtaccattattggattacccagtgtcctcttcctttgaggtctctgtttccccatctgcagaacaggagtaaggctgttggatgataggccccggtaccacttggatccacagactcaaaggccctgggagaagccaggatccatagactaatcctggtgtgttgccctaggcgtgagttccagagagaagacatcgcccttagctaccaggatgctgagggggacttggttaggctgctgtcagatgaggatgtgggactcatggtgaagcaagcccgaggcctcccttcccagaagcgcctcttcccctggaagctgcatgtcacacagaaggacaactacagtgtctacaacactgtcccctgagtcacagggaccctgtggcaaggacggggtgctcagcaaagggcctttactttccaagaacacggagaccttcagggagactgatgtaagatgcaaacctcctggcccagagtgcctactggacaggattctattaagtttttgacactctaccttttggattcaataaaccattctgtctctaagggccacagttgggaaatgggattttgtgtagggccagggagttaagtgtaattgactaagacctcttacctttctaaacgacgttatggggaacatagtgaacccacatttaataggacattagaaccatccgctaaaagtctctaaaagtgcacagtagggagaaaagagtcactgtccatctgcagagtttgggaactgttgggtctatggtattacatccacagctgccctgccccagacccatggggtacaaatcccgccccagccactttgctttgggtaggtgcagtcaagtagatggagtgccctctccctgtggctcctggtcccctgtacaatgggtagcctgccccaatcccctgcccttcctagccccaggctggcctgtggagattcaaggccaggcagttgtggttgatagcctgaatcccagagctgccatgagagtaccacaaaatggagactaaaagacagaaagaaactgccttgtagttctggatggcagaagtccaaaactaaggagccctctccccacaaaacttgagagaaaccatcctccaactctccagcaccccagccagtcacctcagcctgtcggagcttcattctgatttcacaggagttccctcttgtgtgtcccccctctgtgtgcacctgcccctgtcagactggattagagtccacagcaatggccctgatcttaacttgaccacccatctcccagaactgtcgtgttacacgctgcaagtggagacttcaacatgacattttttaacctggacatatccactcaacctgtaataatcacttcattcatgctgttcccactaaaagggcaagcactctgctgtaggccagaggtatgggaaatgcagctttagtaaagatcacggtttccatgacaacagggagaaccagagtccatcagaagacagtccccctctgggatttacctgtagaaaagactccaggagaggcaagctgacttcactgacatcacccaactctgatgcaaaggctctggccatgaagaaaaatggaatttaaggatggggaaatcacattggtttttcttgaagagaaagctgggaacattaccaaaaataagggaccctggaacaagaggccagtgggcaaagcacttgtcacacaaggggattctaatgcccagaaccgacagaaagcaggatgctgcagtcttgggctctgtaacctcagcactcatgaggcaatatgaaaagaggaggccagagatagccagaaactcataggctagcctggcacgcattgaagtgacaactagagaccctgtctcgaatgatgtagaaggtgaggacacctaaggttgtccgatggcctccatacatagcaccctggcatgcacacacacaaaagacttcaaataacagaagctgtaatgagcgataatgccgaaggggttgtcagctccgagacacacaaggtcagaagcatagcggtgagtccagggaggctcagtcaagatgggctctctagaactgggttgcctctgtggcagcatccactcaggagaggttagaacaggaagtgcttccgacttgagataattccctaaaccacccacagctccctggtagaacatatagggagtctagccagctcaaacatggcgagcatggctctggcaggccttgcctttctcctccattcccttggctttgctaaaaaccgttggattacgtccctaaagctagccaccaggctctactcccttatttgtccatgttctccagctgaggctgactaccaaggtccagctatcaatgtattgaagtcaatcaaacaaaagccccctttggctcacctaagtaacatgcccaattaaaattaaatatcccatcctgacatgggatttccccttgtacctttataaaccgccactttcctatgcaccacgtctgtctcttctgcnnnnnnnnnnnnnnnnnnnngtgtagtggtgcatgtccataatcccagcactccaggggtgggaaggattggaggttcaaggtcactttcttgctatcgtaagttcaagaccagcttggactctctgagacaccctcagtaaaaccatcccaccatcccccacaccccaggacacatacccctgccacctttctcttgttcccttccctccgccctcatcctctgtctcttgtctttgttcttattccctgctctgtccctctggggcaaataaatctcttttgtgctgagaacttggtcttaggggtcttgagcttttacttgacagaactcacaggctgactgatcagtagggctcatggctgatgctgactaagccgcaagctactctgacttgaaggagattggcagggaggcaggcttaccagtggaatagcattggtttcctgggctggaagcctgctgcacagtacacactcaaggctgcctgctctcagggcagactggaggaatgaacttgggaccaaacacaggcaaacttaccaacattctgaatgggcagtgtagtctcccacccccaggccttgcccaagctgaaaggtaaaggtctaactggcagagaggcctaaacccaactgctcaccaataaacagcatatgcaaactaagtcaactccaaggaaagggaccaaaaagaccaaggaggaaaaaaaaatcacagtagagatgttagatgttagagactgcacttagtagggaaaatggacttagtttatccaaacactaaaaatgaactaatgaatgaccaaacaaacaagaacaatattaatctttaagggaaagtcagtatctacagttcctataatttgttatttaaaatgttcagtattcagcaaaaatcatgagaaattagaagaaaaactcgtaatgaaaagatcagcttaggaactttgggaaggtcatgagacactcacccctccgaagggagaggctgattagcatttcacagacaacagggaagggaagtccttgtcacctcattccctaaagaccaatcagtttaaaggctgcactgttccgccagtcatattgagcatagttgctgatgctctattctgcccctggaaactatataaaaacccactgaccagtgctgggggtcactgcctctcattcagatctgagatgacccccagttccctggaacagtaaaattcctcttgctttttgcatcgatcccagctctgcatggttcactcagggggtccctggtaagctaaagctccccagagtcttacaataaaccattcctagaggggtgaagggaagtaggtcatagaactgcctttgagggtggactagatgctggactcagcaagcaaggacctcaaagcggatggtttaagtaagctcaacccatgctcaaggaattaaagaaggtatagggggctgatgagatggttcagcagttaagaacactgactgctcttccaaaggtcctgagttcaaatcccagcaaccacatagtggctcacaaccatccgtaatgagatctggcacccaccctcttctggtgcatctgaagtcagctacagtgtacttatgtataataataataattaaatcttaaaaaaagagaaggtatagaaacaatgagtgttccatagcaactcctactactgaatgagggtgagaacaagaattgtgctgtgcttttattttatttttccttttcttggatattttctctatttacatttcaaatgttatcccctttccaggtctcccctttggaaaccccctatcctatccccacacaccctgcctctatgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtatgtttgtatgcatatatgtgtgtgtgtgtgtatatatatgtgtgtgcatgtgcatatatgtatatatgtgtatgtatccatatatgtatatatgtgtgtgtgacatatgtgcacatgcatgtacagatgcatgtgttcatatatttgcttttggatgccaaggagctcatcaagtgtcctgctttataacttttacttaatgtctctctctctctctctctccctctctctctctctctctctccctctctccctctctctctccctctctccctccctctctcccttccccctctctccctctcttcctctctttggatctatagctgttccagtggtcgagcacaagtgagccctagtaatactagtgtttacaccccgcaaggctctttgatgtgtgctgtggacttgaactggggtccttataattatgccacaagcactcttatcctctgagccatctcgacaaccactaaggtagggccttaagataatgtcctgtgaccttgaagagtcacaagaaagtcactatttttatttgtgtgtattatgagtgtactgcatgagtttattgcaccatatatgtatgcatgtctgcagaggacagaagagggtgccacatctcccggtactggaattgcatgtggttatgaactgtgtgatacaggatcctgagaacaaactctagttcctctgaagaaacaatgcttccaactgttgaatcagctctgcagcccagcaatcatcattcttcatgataaaatgttagaataataacaattcctgtgcaaggaaggaagacacacacacacacacactgtcactcagacattcaacattagaggccccagctagtctggcagagctttaaaaagaaatgcgctcataaggtttgagtgatggaagtgtgactgtcgttactcatgcttaacacaactgtatatgccaagacccagtagaacgtaggggcaaagtatttcatgacaccatggagatttgctgggtgggtgattatattgatgctaaacaatgattgcccttcctacatggcagcaaaataatctaaaaaataatcttaaacagtatgccatctgcagcacaacaatatgtttaagagacttagggatagtctaatgatgttcaaaacacacaccacacaaacacacacacaagcaacagaagaagataagcatgccacacacacccacacacccatacacacacacacacacacaccaaaagataaacacacacacccccaaaagataaacacacaccacaaaccatacacacaccagaagaagataagcacacacacacacacacacacacacacacacacacacacacacacaccccagaagaggataataaagatgatatatgcttagatgcccagcatttgacagtagaggcaggggggtcactaactcaatgccatcctcagtcacacagtgagttgaggccttttgggactacatgacactctgtctcaaaaaggaaaacaacgatcaagcaaaaaacagagaattaagagaagctgaaattagaggaaagcaagcccgtgtccatgaacaggaagccagtagttatgacagttcccccaaatagttcatagattgtgatgaggttttgaaacttcctgctctgattagcttttgataacttgccagaaactagagtcacctgtgaaaaggtaactctgctgttgaggaactgacttcataagacacacagataggcaagtctagtggggaattttctccatcaataattgatgtgaaaggacccagctcattgtgggtggttctgggcaggtgtcctgtgtataagaaagcaaactaagaaaactgtgggtagaaagccaggacgcattattctttcatggtctctgctttagttcctgcctccaggttcctattgtgagtttctgccctaacttacaccaggggatgaagtgtgacctaaaagttgtaaaatgaagtaaaacacattttgtactaagatggtttgggtcagtgttttattacattaccagagaagcaaattaaggcagaaattggtatcaggagtggggttgtgttgtgacggacctacccgtgtggtttgtatttcttggaacatcttatgggaggaaagtgaaaatttttggagatttggaggaaagtcattgtgcacacaaagcttagtgagctgttatgactctttaggaaagtatttcctcctggacagcacacaagaacccatagttaagagggtttgcatttcttaaagagactagaacttttgaagtatttggttttttaagactacaggacctttaatgttatactgtgctttatcatgatattatcacaagatcctggga

SEQ ID NO: 1530 - DNA, 1425 bp, Mus musculus
gagaagacgtgtgagggccaggcagctcaaagcctgaaggaggtacttcaaggagggtccagagaagctgggcagggcgggacctcctcaaaggctgcccccggggacaccccaagcttcaggaagctctcagatgcacataggaggaagtgagaggtgaactcggcctggatctggttgggcaaggcccccatccatctgcttttctgactacccacagccatggccctggcccagcagctgcgatcagagagcgactttgagcagcttccagacgatgtggccgtctcagccaacatcgctgacatcgaggagaagagaggcttcaccagccactttgtttttgtcatcgaggtcaaaacaaaaggagggtccaagtatctcatctaccgccgctatcgccagttctacgccctgcagagcaagctggaggagcggtttgggccagagagcaagaacagccctttcacctgcaacctgcccacattgccagccaaagtctacatgggcgcaaaacaagagatcgctgagactcggatcccggccctcaatgcctacatgaagaacctcctgagcctgccggtctgcgtgctgatggaccccgacgtcaggatcttcttctatcagtctgcatacgatgctgagcaggtgccccaggcactccgcaggctccgaccgcgcacgcgcaaaatcaagggtgtgtctccacaaggggccatcatggatcgcatggaagcgccaagagcagaggccttgtttgacttcactgggaacagcaaattggagctaagtttcaaagctggagatgtgatcttccttctcagtaagatcaacaaagactggctggagggcacctcccagggagccacaggcatcttcccagggtccttcgtgaagatccttaaggactttcccgaggacgaggacaccaccaactggctacgatgctacttctatgaagacacaggcaaaaccatcaaggacattgcggtggaggaggacctcagcagcacgcccctgttcaaagacctgctagcgctcatgaggcgtgagttccagagagaagacatcgcccttagctaccaggatgctgagggggacttggttaggctgctgtcagatgaggatgtgggactcatggtgaagcaagcccgaggcctcccttcccagaagcgcctcttcccctggaagctgcatgtcacacagaaggacaactacagtgtctacaacactgtcccctgagtcacagggaccctgtggcaaggacggggtgctcagcaaagggcctttactttccaagaacacggagaccttcagggagactgatgtaagatgcaaacctcctggcccagagtgcctactggacaggattctattaagtttttgacactctaccttttggattcaataaaccattctgtctct

SEQ ID NO: 1531 - DNA, 1020 bp, Mus musculus
atggccctggcccagcagctgcgatcagagagcgactttgagcagcttccagacgatgtggccgtctcagccaacatcgctgacatcgaggagaagagaggcttcaccagccactttgtttttgtcatcgaggtcaaaacaaaaggagggtccaagtatctcatctaccgccgctatcgccagttctacgccctgcagagcaagctggaggagcggtttgggccagagagcaagaacagccctttcacctgcaacctgcccacattgccagccaaagtctacatgggcgcaaaacaagagatcgctgagactcggatcccggccctcaatgcctacatgaagaacctcctgagcctgccggtctgcgtgctgatggaccccgacgtcaggatcttcttctatcagtctgcatacgatgctgagcaggtgccccaggcactccgcaggctccgaccgcgcacgcgcaaaatcaagggtgtgtctccacaaggggccatcatggatcgcatggaagcgccaagagcagaggccttgtttgacttcactgggaacagcaaattggagctaagtttcaaagctggagatgtgatcttccttctcagtaagatcaacaaagactggctggagggcacctcccagggagccacaggcatcttcccagggtccttcgtgaagatccttaaggactttcccgaggacgaggacaccaccaactggctacgatgctacttctatgaagacacaggcaaaaccatcaaggacattgcggtggaggaggacctcagcagcacgcccctgttcaaagacctgctagcgctcatgaggcgtgagttccagagagaagacatcgcccttagctaccaggatgctgagggggacttggttaggctgctgtcagatgaggatgtgggactcatggtgaagcaagcccgaggcctcccttcccagaagcgcctcttcccctggaagctgcatgtcacacagaaggacaactacagtgtctacaacactgtcccctga

SEQ ID NO: 1532 - DNA, 40304 bp, Homo sapiens
  misc_feature (14527)..(15049): "n" at positions 14527 thru 15049  can be any base
atgaggagcgagagatgcttttatttcaatcacctgggtcctggcctcatccggcaagagggcaatgtccgagatcaaaagcccagtcctactgcaagtctacccacttgctttgtctccttcttcactctcggcctccatcctcccctctttttctccctcccttcctcccacaaacccttattggtcctgttttggacactggtgattcatagatgaatgggacatggttcttgcccccaaatgtgcccatgctatggaatcttcagcaggaagaggtgagaagtgaagacgctgacagaggctggaattaaagtgacagctctagctggggagggtgctgccccagccttccagggaagtctttgaccagttttgaatcttaggtgatgcaaagaatcaaatggatgaagaaaagccataaaatcatagagatgggaggaagacggggagaatgcatcaggagaggtcaagttgatgtacaggacaatgagcaggcagaggaagggaggaaggcatgtcctggggcccgggctggagggagggtgcgggtgggtgaggggcttcagagtgctgcagcgcagaggagggaggagagggctgtggaaaggggaggttgccattcctttgtagttaatatttggaggcacgactgatttttgaatatagtttcatgcagatgctggtcagcctggagccacacttttctgctggctgtagatttttccccttttgatgcctttaggaaaatcaaattccaacatgtctgtgctggataaactgcagctagaggagccctcctttcctggggcactttcaaaggcagtggcatcttagcagcatcaggaaccagaggtagaccctcagggaggaggcagccctcaggcagctgctctgcctcacccctcacccaggattcaccttcctgagctctttttaaccctctctgtgaactgtcgcaaggtagtctctttgctgttaactctggtgcagcgtccacacagacctgcttgcttttataaataaagttttattggaagatagtcatgcacattcaactatttattgtttatggctgcttttgtgctgtgacagcagaattcagcagttgtgacagagaccaactccctgcaaagcctaaactatttactatctggcgttttttagaaattatttttcagctgggtgcagtagctcacacctgcaatcccagcactttaggaggctgaagcaggtggatcacttgaggccagaagtttgagaccagcctgccaacatgttgaaacctcatctccactaaaaatacaaaaattagcggggcgtggtggcagatgtctgtaatcctagctactcaggaggctgaggtatgagaatggcttgaatccgggaggcagaggttgcagtgagctgagattgcaccactgcactccagcctaggtgacagagcgagactccaacttaaaaaaaaaaaaatgaaagaaagaaaatgaaaagaaagcatttgccaatccctgctccagtgtactgggtagggtacaggttcagctgctgtaacaagcatcaaagaatcagctgctaaaacacaatagaaatttctttctccctgaaaaatctgaacagaagcagggtcagagatccaagctgttttgttgcttaactgttctccatagctggcctctccagccagctggaaggggagatgggaaatggaagatacaccttctgtctttcacgacacagcctgatagcatgtccatggcctcccctcccattctattggccagcaactggtcacatggccacagggagctgcaaggtaggctgggaaatgttctctttagctgggtggccatgagtccagccacaactcagggactttatcactaaaggagaaaggacagagtggatcgtaggggatattagcagtctctgctacaccttatcaagaagaataaagacagagtgcacaggggaaggatttggcattccctgcagagtattagaaaaaaatttgtaacatgctcaaatgaagtaggtatcaataacggatataaaatacctccttcttccacttcctccctcaaatatttattaagccctcatttatattaggctctatttggatgcattttgcagataaataacctgaagctcggagtgcttgagggagatgtctgagagttcatagccaaagagtgagagctctttctgccttattgccttgcttcccttgggacaccctggggctgggagctgggccttgcagcctgctaggctggctaggtttggtgacacagaaagcaaatgaataatttttaaagtgagaattctataaaggagactgcttgaacagattctgttagactgaaaaggcagaaggagacaccgaggtcaccagagatagaaacttcaggaagcagccatcacccctgcggctgtgggaacggaaggaagagagcggggttacgctagcctggaagcttggaggaggagacttagacctgcggggaggagctgggactcagaactgcagacctctgaggagggggtggggtgagactggctctgggaatgtgaaaaaaactaaaacctagaatcaactgctgctgggccaacatggcttccagggcagggcagttgggtcccgcctgcaaagagaaagaagcaagcccctccttcctctcccatccttccggcctccctccagcgccccctcctggccaagggcagcggaaatcagccagcaaagcagaacaaacagggttttgagtcccagctcgggcaccacaaagcagagggtagaagaaaggtttggagctgggagaaaatcatttaataaccagccccaaggctatgactcatttagacccccagtctgtgcagacctggggccactgcctctgagccagtgcacaccgggtactctggagcctctgtcttctgatacatgggtcagggggaatgcaaaatgattcaaccactttggaaaacagtttccttctttttgtttgtttgtttgtttgtttgtttgtttgtttgtttgtttttagaccgagtctcgctctgtcgcccagggtggggtgcagtgacgcgatctcagcttgctgaaatctctcctgggttcaagggattctcctgcctcagcctcccgagtaattgggattacaggtgcccaccaccatgcgtggctaatttttgtatttttaatagagatggggcttcaccatgttggccaggctggtctcgaactcctgacctcaggtgattcacccacctcggcctcccaaagtgctgggattacaggcgtgagccaccacacccgacctggaaaacagttttcctataaagttaaatatgcatctaccatatgacccagcaactctctcttagatatttacccaagagaaatgaaggcacatgctcactcaaacatttatgcttgatgtttgtagcccctttgttttaacagccccaaactggaaaacaaaaaaaaaaccctaatgtttatgaacttgtgcatggaaaacaacttatgttatatccatacaataaaatactacttgacaataaaaagaatgaataccgatgtacatatcaacactcatgaatttcaaaagcgttatactatgtgaaaaaaaacaggcacaaaagatcacatactctgtggttttgtccgaaatttcagaaatggcaaaatactgtgatagaaagtggatcagtcattgccagggcctgggggtaggggaaggagattggctgcaaagtgtcctgagggatcttttgagataatggaaatgtcctatataatgattgtggtgctggttacacaactgtccaaacccatggaattgtatactttcagttggtaagttttactgtgtgtgaattgcaccttgataaagctgattttttaaaaattgaagtagaacgctgttagaagtggtgcttcctccccttgtttctaatgccaccctcttgcaagcccatatccaagtagtggaccaaggcatcttataaaaacataaattcaatcatatcactccttgtttaaaacacttgaatggtttctctttcctctttgaatgaaatcctgagaatcaccatgacttacaagcctatctgtcctgctcactgaccctgacatttggagggcctagagcaatgggacagaggcccatgtaccacgattctaaatatgtacagttaggaatcaagccaatcaactgctaaaaagtaagttctatccttctttgataaatgtaccttcatgataaactggaaggccaggttcaaatgtagagtttggagttctgtcccagaatgtaaggttaacgaaaggcagacgctagactatagcctactgccattgcctttccacccccggatccatctgaaacctccaggctacctgccaggccgctgtagacatttgtgtccataacctctggggaccgaagacagcactggagatggaatcagagaaactggatgtgaaacatgtatctcttggttttccccaaattgtacttgattctgtatgtgtgtacatgtttgagcatgggtatgcatgcacgtgtatatttgcatgtgtgtgcatgcatgtatgtgcatttctatatgcctgtgtgtacatgcatgtgtgtgcaggtgtacatgtacatgtgtatatgtatgtgtctctgtgtacatgcctatgtgtgcatgtgtatatgtacatgtgtatgtgtatatgtgcctgcgtgtgcatgtgtatatatgcctgtgtgtgcatgcatgtgtatgtgtttatacatgtttgtgcatgtgtatgtgtgcctgcgtgtgcatgtgtatatgtgcctgtgttgtgcatgtgtgtttatttatgtacctcaacagcagtgtgagctacctgagggcagcagttgtgctgaattcatctcaatatcctttctacctggtgcagagtgatactagatgaatgcttgtggagtgaataaatgaatgaatgagggccagtacagcagttattaagtgtgggtcttgaagccagactgatgtgaggtccaaatcttactctgccggtcattaagcaagccgctttggtttattttcctaatcccgtaaagcctgggtttccttatctcccggtggggataagaataccactattttatgggggttggtgtgaggattaggtaacaacaatcagagccaacatggaccaagccaggctgtgggccaggcactgtactaagggctttgcaaatgctagctctcgtgctcctcctggcaatttcacggtgtaggggtggttacacagtcaactctcagagtgacttggctgttaccgtatttatgatggtggagaggagattcaggattcttagcccctgggggaagcttcccctgagtgcagctcagattctggctgatagggctgtctggagaggttgtctgagccagcaggctgcgcgctctgcctggccagctgcaacttgactctcgacttggccgggtccttctagtgcggcttatagcattcaacctcctctaggtggcgctgcggagcggggactcggctgctgatcgcggcgccccctggcggtctgttcccgtcaacatttagattaagcgcagagccggttccgccagggaagtgcgcgtcccggtgcccccgcgtgatgagagcggatgacagattgcgggaaaaagttagaatgtaacgttagttgtatgacagagaggaccaagctgtgcagcagagggagacagaaaagggagggaccaagccacagcaaggaatgatcgtcaataacattaacgtctagaatttattgaccacctgctatgcgcgagccactgtcctaaacatctggtattcattcccttagttaacacacctctagtaagtgcgtgtctcaagaacagtgtctgtgtttcatttagggcctagcacacagtgggtgtctggcacatagtaggttctcaacacatttggaaatgaataatacaataatcctgcaatttttctctccaattaataatgtagaggcaaatattatctccatttagaaaactgaacaatggtcggagagtttgcacaactaatgcgtgacacagcgagggcacacgaggtttagacccagctcagccgtgtgccagggcttctcagagaagagaagaccctctgccttcagggagtttgctgtctaattggccacgtctacaccctccctgcctgggtggcatgccagggatggctatttatggctcagggaggaggtccagtgaagttcccctcataaattataaagggagacacatgtgggtcaagattggggaattcagtgtgtgagggatccccaggaatcttacactgtccaatcagggattttccttctcttaccctggagagtggctgatgtaggcagtggggatttgctgagtacctataatgagctctcaagggtatctcctggtcctgtagaagaggctcacctcctccctatcacagagttccagttcctatggctggagctctcagccccagccgctggctgctcaaaggagagtttcctcatgtccaaaatgggggctatggtttatcttgtataccccagcacctgcatgaggaaggactgaaaagtgctgtgcacttttgtgattcgcacatccagtccccattcaggctctggggatcccccaggcatggtcttggtgtattagactttttcctggagatgtgattatgaatgggcattagtaagtggtgttatgcagagatgcccttctctgaatggcctctggtatttgttttttgagttcttgagaacatatatattttttggtattccatggtctttatcattgtcaggctgtcactgaactgtcgcttgcatttggctgcccctggtaattttcttccttcccctaactcactgcttcaagttcttgagttggcaggaagagaggaccaggctccttttatatttcttctgtgaataaaatatgccagtgtcaatgcatagactttgagctatcaattctaaccattcaatggcttttctctttttttggtttattcacaggctgtgggatgtggaggttatcaaaaatcaggtctccataagtgagaggtcacttcaggcatttctttgcacttatccaaaaaagattccatccatacttgtttaatggaacgtgtgaagagcttggctcctcttccaggtcatccctctgcctcattctccccctgcagcaggagcagcaagagcccggttctggagtgggagtagaaggtacaggcattgctgcagcggcaggacaggagcccattgctgacagagtgcctggcctcaaattacactgtatcagagctcgggcataaaattggcagcagcgttctgtgtatgaggagacagagaaatacctgtattcagcagaaccacgggcagggacagaagaaaaggagagaaagaggggaggaggggaagagctggcccgtcgcgggctcttccctggacatctttgtcccccaggtgcagaggtggcttcccagtggctgagtcagggccacaggaggtttcttggggggttgggggggccggggtttggagggcaagccatgaaaatacctgggaaggtaaacttgagggcttaacccacctgaaacacacacatacagatatacacactgaaaacgattaaaaaaggaataagaaatgtccatgtgtctaggcacttttatacagttttctattaattcctactacaactccattaggcaagactgtttcacagattggtgaagaagaaaggttcaaaaaggacatgttatcttgcctgagttcacctattataaatgtacttgtgtttatactcatttgtcaccgactgcaacctaaacatctaaacacattctctcacagccacaatgccaccactatacacattatatggtcttttatagacacaacacaaatgcacttacacttgcctatgcgagctgtatgtgtttatacacaaatatgtgtttccaactataggcatatactacacacacagtttacacaatcacctacaaattctgtatcatgcttgcttgctaaaattgttttgccacttcctgtccttcctgaccaactgtaggccaatgtcctcctcttccctcagttatggctgtgtgcttgcacctgttggtacttacagacacctgcactaataaccctgctctctgtgtttcatttcatcctctagcctgggagccccgagacaccagcaactcatcagacttattgtttgtattatttctagttctttgggtgtgaattcttcatgatgtggaggctctgagctgtctttcacagctcacgatttgtagttttggtctgtgagttgacagagtaggccctgcagagtcactgactccaagctgtttttatataatgcctcagcttaggatttctgcaccacgtgggtagcttatatcggggccttacaccagtgcagagggcaggcttgaggctgatctggtacacacgtcccttgttccacccatggactgtgagaggacctcagctcctgccgtgactctaggctgatggctgagaaactctgttcccataatcagttctgacacccactttacactgagaactcagatttgactttctgctaacagcaggacctgtggcctgtacctagtcccagatttggcattaaaatctcagcccaacaatgcatatccaatcttggttttcccatgggctgttggccacgttcctctccccctggtatagattcctgacccctctctttgatcctacctaaaaattatgctttcttgttttttttagctgggacttgtatgtttaaagtagtttaaaacaactttctgctctgcatgtatgaatacgagtgtgtgagcgtgtgtagctggcagggagttactgggtgtggctgtgccaatgactcctgtggacctcttctcagagaagtcccttcagaatcaaatacccatacctgttaggagctgcagtcactgactggcagcgtttcattcattcactgaatattggttgagcacttgcaatgtgccaggcacgctgctagccaaggaggcagtcattaaacatacagataaacaaacaaatgtgagatgacaatagttatgagtgctctgcagtagacgtgcagggacctgtgagagaatgtagtagggagggccttaatttagggtgtgtggtcagggaaggcctcactaaagatgtagcttctaagctgagatgcaaaggaggcagtgaagagctttttccagcagagggaacaccatgagcataggccttggggcggacgtcttagaacattctagaaacggaaaggaggccagtgagaaaaagggagctcaggagcagaggctggggaaggctgcagggcctcaggggcattggaggcaggcagggcaaggactctgaactttatcctgagcacagggtgatggggcaggagagtttaagcagggagggtgaaactcactctgattggcagccctgtgaaagaggattggctgggcatggagatctaaggatgaggaaaggatatcccagagtgccagggcgcgcaaaccaaacttcacactctaggaagacagaggccagaggaaccaggagggcttcctggaggaggtggcatttactctgggcctaagagatcacaggaaaatggaggccagcattctaggcctggggaagagtttgggcaaaggcttggcagtaagagaataaaggtggggcttgatgggccagaggataagtgactcctcaaggtcacaagacaccctgatgactgggaccccatctctgatggagcaaggcttctgatacccaactgaggcttggcgccaaggactgacatcaaggaagtggattcctgcaaacctggcacccgagggtccacttcctcaatttctgtgcagctgggaggtgaggtaagaggaagtgtgggccacaggctaggcccagagagcctggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagaggtgagtgccggggtgtggccgcccccgggccttctcactgctcctcataggccttagggacaaaggccagtccttctgcagtccctgatcaacatgagaggctggggttgagtcagaacccaaatactcagaaatgcaacctctcagaactgctttaacgaaactttgagctgtggctcaccaccctcagacacaaatgagaacactgaggctccaagagtgggagtgacttgcccacggtcacacaacgagtgaccggcagtgtctggagaggaatgcaggtgtcctgggtcccaggctggggccctttgcttcacatggtgatcagcaatgactttccatcttctgcgcaaacagaattcacagaatctggcttgttcttccgctaatcagggcttgcctcaaatgtcacctcctccaagaagccttcctgacagcccctacctcattgctgtctgaccctttgccctatttcccttttctgcctggttcttatattacaggaataatattatatgctcatttattattttttcttgaacgttggctcccccatgagaagcaagctccacgaggctgtgtccgttttgatcgctgctgtatcactagaaggtagctcatccctattgagcaccaggaccaagggctcaataaatgttgctgaatgaatgaataaatgaatgaatgaatgggtggatctttgagacggaaaaggtcttagattcttctagtccaaccttgccattgtacagattggaaatctgaggcccagggaggataagagacttactcagggtcacagagagtgactggcaaggttggggcttggagcacggcctcaccagcatctagcctcgtcgcttgggaagcattttcagaatttttcctcagtagccaggtctgagctctaagctgcgggggccctgaggacgcaaagcctggcccctgcaccccctggattggaacagcaggtgacctctgttacctacgtggaggccactcagggggtcaccagagacaggccaggctggtgtgtgcctacgcggggaacagaaggcccatgttggggcctggggctggaagtagaacctgaagcgtgggttggggcaagggcagcagaagcaaatgcctacaggggagtccacgtggccttcctgagcctcagagcggggtgcaggagctgggtaaggctggccgacctgaattccttcctcccctcacatgctcctgggggacccagccgcacgcaaactcgaatcttccggaagcagcagctgtttgaggcttgggcacttcctgctttctggggtacagggttcaggggatgacacggagagctgaccagcaggactgtgcactccctcccccactccctgtcccctttcagctgccttagccctcagagggggagggactgcttttcatgaggccttgagccaggtactaggggcatgggggctccctgtacctcgaaggtcttatctgaaagcgagcctggattgttctgcttaaggtcaaagcagagagtacaaggagagggcgcaggttcgcgcagcggggactttctagaaccccaaggtgagacatccaaagatggggagggctgccttaggggtggcaagttcggttccaacagacatgttttgagcacctactatgtgccaggtgccagaaaacctgccctggctgccctccaagggttcttccaacctcggcctcccccagggcaggctccaaaacctcccccaggccaggctccaaagtctgtgaactgtgcgagtgtgtcttgagccagaacatcccggcccagtagggcctgggtgaggtccccaagggagcggatattccaggggacttccggttgggtttgctgctcttcttgcccgccccacaggcagccaggccattctcatgctgcccatcaaaaaactctataattgcagacgacggtagtggccgtgtattgagcagtactgagcacctactgtatgccgggctctgttctgggcactgggatgtagggtgagcagagtccttgccctcatggagattttagggctgtgtttgttacagatgggactgcatgaccacccggagacataagtacttctgcctgtccccattttacagaggagggaaggagcggagcacagctaggaatcttcccaagggagcttgatcttcttgtccccagtgctgcgcctatgcctcgagcatctgccaatgtctgtcctgcttgactccttcctcagcccccaccaccccagggaaaactcgaggtccctctgcgaggcatcaaggcacctcgtgagcgggccctgcctgtctctccgactggtctctcatcacgttccacctcccgctctgtgctccagccatgctcagcaacctgcggttccctgaactgagcagctgtggcctttgcacttgccgctccccctgcctgaaatgcctttgctgccgtcctgcaaccaactcctctttgctcttcccggctgatcactggtgctgctgcttctgggaagccctccttgaccaccctcagcccaaggatgccctctgacggcgcatgagcctccacagtacaagctcctgctcccaatctctcctgtctgctgcatgattgattatttgagggaatataataatggccaggctcctgttctagttcaaaatgccacgtgcttttccttcccagcactatgcccatttgaattatgtcattatttgtttagtgtccagtgtccccttcccttctccttggagctgtgagatctgagaagcccatatgtcttaatgggcttagaacagtgtctggcccacaggcagtgccacatacaggttcgctaaaattataattattttagacggagacacaggctgagaagggctgggaattttttaagttcacacagcaagttgccgggaggctcagagtgcagggcagtatggcagtgtttggtgacaaatttctggagccagactgctactgcttgggctcaaatcccagcttcccgacttactctggctaattttactgtgcctcagtctcccgatctgtacaaaggtgacactgtcttagaagagcacctggcaccctcaggaaacaggcagctgccattcttattacccaacctgcctgccgccctgctcagggccgtttctaccctttaggttccttcctgtgtgccccccacccccaccttcccacctgatcgtactgcagaggaaattacctaggacaagcacagcctcaggggagaaagtggaggaggaagcttctcccaagggtatcaccacaggggcatgtgtggaaagtgagtggggctgggaggggggatttccactacctgcccactgctatcctgagtcacctccatgtggcagccccctgaattctgatgcagcctcagattctaggtcatgtgggtccggcgtggactgggactactgtgtgtagactccggaggtcccagccagctctggggccttggacttggcagcccttgcaatcccccaaccaccgccacccccccacccccgccactgtttcccctgtttcccaattgccgcaccagaagaatcatagttgcttcttgtttccttgtctgtctccaagtggctggactcagtgaccactcagagactcctggctgtgccttctcctgctccttggaagtctgtttcttcttcccctatctgtccctctcagacccctcctctgttccctgataggtcttcactgagtcaagagcgggggtcttagccacaagccacaggcagaaggttattcctgcctcaccacttttagtcgagacctcgagacccccatgctgagatcctgagctataaagcaggcctctcaaattagcatgccccaaactgagtccatcaactctgccccgtgtccccatcctggccagaagtgtgggtgtcactcttgacagtgccttttctttcacctccacatccaaacagtgcccaacctctcctgatcatgacttaggaacaacaagaaattggtaatgtgtctgttggaaatgcattaggctgcagggaatggaggaactgaccatggcttaaacaaacaggggattatttggtcacctaacaagaagtccactttgggaggctgaggtaggtggatcacttgaggtcaggagtttgagaccagcctggccaacatggtgcaaccctgtctgtactaaaaatacaaaaatcatctgggtgtggtggcttgtgcctgtaatccaagctacgtgggagactgaggcaggagaatcacttgaacctgggaggcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtttggctcagacccgtcatgatctatcaccttggggctaggcacatggccactctgaacaaaaccagtgcttggttagccaggaagaagcagaggatacagtaaatgctcacagtgtccaccaaggttggtggcccttgtgtctatctcctcctgtccctgctgtctggctcacatgcacacaatctcttaatcagaccacttcaggacctcccagtggtgctctctcccctaagtctccacccattctttcctccccacacacctgcctgagctggcccctaaagccaaaattgtatttatgttttactttctttctttctttctttttttttttttgagatggagtcttgctctgtcccccaggctagagtgcagtggcatgatcttggctcactgcaacctccgcctcctgggttcaagcgattctcctgccttagcctcccaagtagctgggatgatgggtgtcatttttttatattgcctgcctcagcctcccaaagttctgggattacaggcatgagccaccattttactttcttccaaagtatgttttactttcttctgaagccctacatgactccccattgcctacataagttccctacttggcccttgggaccctcagactggcctcacctgcccactcagtctcagatcacactggccccagccatacagatccgggcccactccgcaggtcatgctgctcccactgcctggaagaccctccccaatttctacctggcagatgcctattctaccctctagacctgctcacatgtcatctcctttttgaggatttccccaacctgggcacaattaggcagtctctctatgggggtcccatagcgctccatccagggcacatgttgactttgtttacatctgtgacccagggcctaggacagggcctggtatggagatgtttgatgccttattcccaggtgaatctgtgcaattgacagcaatgtgttagactataatttggctattgctatatggtcaccagcttcccattcctacactcaatatggccaccagcttcccattcctgcactcagtatggccgccagcttcccattcctgcactcaaggcctgggctgtgtcttgttatctccgtattcccagggtcagtggctggacctggcctgggaaggggtgctgagagacgaatgttggcttcacaacattagtttgctttgcactctacctcatacccggtgggcccacaaaacacatcagggtgataagcaggatctcttttcccctccttcgcacagtgactttgaacagcttccggatgatgttgccatctcggccaacattgctgacatcgaggagaagagaggcttcaccagccactttgtaagacagactcctagtccttcacccaacaacctctgaacttccacccagctgacctctgaaccttgccctctgacctctgaacctccaattctctgatctcttaacttctatctcagtggttctcaacaggaccgattttgcccatttgacattaccctgggagattctgattattgcatcttggggcaggtctactccacatctagtgggtagaatccagggtgctgctaaacaccccactgtgcacatgacagccctgtccccagtaaagaactgtccggccccagcataatactaagattgagaaatcctgatcgcgtcctttgacctcagaacctccacctggagagtcgggggtgagggactttagtgttgcccccacaacacccctgtcatattcagacacagatggagggggcatcctgcgcccacagcacagccaggggcaggttcactctgcaccatgacctccaaggcatggctcctcatttcttgggcctgaatgtgtgtttggcctatttccaagggctcttgcctctaacactaggtctcacttcctctctttttccagttttttttttcttttcttttctttttttttcgcaaagctcgtctgcttctggggcgccagccttttgacttgacaggggtctccttctccagagacccttctgcatccttatcctcatcatcttcctcctcctcctcctccccttttcccttccacctctttttggcttgtgctcctggcccctgagccctccccacaacctctgtcctccttaggttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccaggtaggcggccactcccgtcctgctgctgcagagctgctgactctccttccttccagggcccctgacactgttctgtgatttgatctcaaccccagtgaaaactgttcatgtagtttatagcccccactcccggcagttacaggctgccaagccctccctgcatggctccccctgcctcacgccatggcttccaccccaagcactctagcctcacagccccggagctctgatgaccatcgtggccactcgctcctgctgtccactaccaggaggccacagtctggagcacttcagcacctggcctcccttcctcagagacaggaatcccccagtctggtccctaaacacactgactcacctccctgcccaccctcagcttcctcccacgagaccagccctctgacttcatggtcttggcttccagcgtccctgtggctctccttcttctcctgtcccgccaggaagctgggtggcctcaagcctctgcttgcaaacagtctccccgccccctggcctcctggtccttcctccccagctggatcctaacgcgcaccttggacagcgccaagcccttagctgctcagcacctgccccgcaggaggaaaccccatcacgaatgggttacacgggggtggtctcagcggcgcccttcgtgccctgcaagttagagacagggacaattgtctcccttccccaagcctcagggacccttccccaagctccaaccccatctccagtttgttttttctgtctctgtttctgtctctctctgtctcagcatatgaccccgctccttctcatccagccccaccaaggaacttgaagctccccctaggagtcttgcctactctaagccagcctcccctctcaggctccatcattttccctcctctctcttttggggctctctcctgacaatctacccctccttttccttgtatattcatcttcctcttgatataccaactccctctgctaagcgtctccacagcctcaaccctcttctgtctttaaacaatcctgagccatgaaacagcattcttacaagcctccctgagcctccgtgcccccagggcccccaaagttctctttcttcttcctttggcatcaaattcacgcactgtctcaccttggcatggccatcctctccttaactcctcagcttggtttagctctgactactccactgaaattcctctcggtgaggtgggccatgacccatcaattctggcttccatggccagtgccaagcctcatcttcacacccccactccttcctctgttaagctttctccaacctcctgaggcaccagtgtctcccaatccccttcctagcttactagagactccttcagcttctctgttacagaatcaaccttctctgctgctccttggaaggtggggatcctctgagcagacatcctctctcccctgccttgtcttctcattccaaacactcaccctggcaaactgacccatgtctgggacttaattgtcacgtttttgctcctaactcccaatgtctagctctagcccagaccctcctaccgccgccgccatcacctctgtccatctcctggacaccaggagccaggcaggtttcagacttgcttcctcgtaggggttctcttggtgaatggttccaccagtgcgcccacatgaaggcacctggaggggacatttgtctcttggtagcccgtcatatttccttttcctccagaacatctgccttgagcttgaggaattgttcattcatccacttaacaaatgctcattcatctgggcatgattctagacccatggttcttaactttggtggtatgtggacgtgccttgagagatggaaagaatcctggttcctgagtcctgcccccggagattctgatttaattgctctggggcaagtgctacacagtgagatatttacaagctccttgggtagcttgaatgtgcagccggtgttgccactgtcctgggtgatgggggtacagctgtgagccaagcaggtgaaaatcctgctctcttagaactaagagtcgtgtgtgtgtgtgtgtgtgtgtgtgtgtgtgtgtgtgcgcttggatgaacaggcagtaaataaaaaagtaagacaagaaaaatatcagctggtgatagcacaactgagaggatgaaagttggatggtgccagagtggccacttcagtgctgtgaaaagataacagggaagaatgctgagccatcgggaaggggctctggccagggttcctggcctgtaggggcagccctgagccccggggccatgttgggccaggctcctaggacagctctttgtctcttctcagccaaagtctacgtgggtgtgaaacaggagatcgccgagatgcggatacctgccctcaacgcctacatgaaggtaccagtgggccttgccaccttggcacgtggaagggcatgcagtattggtgggggagcccacgtaccatccctgggtatggctttgggaactggggctggctctctggctctgatggccccatcttcaatccctaaaggcctggtctggggagtaaaacaggatgcgtccttagggttccagagataggagcaggagcaacggagaaggtaaaagagccacactaggaattgacaagtcttcatttaatgctccaagccccacaggtgaatgtctatgccaggagttaaaatacaaaggtgaattccatccagtgtctgcccccaaggtacccactgtcctatgggaatgccaacaggtggatcataagatcacacggagacatatgtgtgcctccatcatgggggtgtggccaagcaggccgcaggttgctcatatagcatctttgtgcaaactagagtaggcctcctctgggacaactcactcccttacgtgaacatgggctggattttagctacactcatgggtcttggctgggggcccttgtgtattctccgacttgcaaactctgcatctctatgagatgggagcgtagaggaaggagcatcttaaaggcagaggccaaggtggtcaggaaaggacttccaccagccacagccatccaggaaaggggcagtgttcctcatgaggtggcagtgagtgcaccgtcgctagagacctgatagtgacctcaggaagctggcaagcgaagccctcctcccagcccagcggcatcctcacagctggagagcgctgggctaggatcctttagtcttgactctgacactgactggctgggtgatttggggtgagttgcccatcctctctaggccttggttttcacacttgtgaaatggggcagtgccctctagtatcacaggagtgaagttgggatctgtcgagaacaggatgagaaagtgctttgtaaactgtgaacctgcttccagaatgtgagagatcttgactcctgatggagggaaggagcagatggagggcagaggaggtgggaggaaggaggagagagcaggtagctgcaggaatcctgggctctgagcagggaagagggagggaggggagctgggtgggctccagctgctccttcagggtggctgaggctccacccttctccccctgggctagaataggggagtgggctgtgaagggagggagggagggaaggaggaagagaaggcaggaggcgaggctggggaactggggctcctcattccacacctggtcttagcaaccagcagcccagaggatccatctctgcctctttgtgtccaattgggttcctggaagccagagatcattcagggcaggaatctctgccatggccaccccatcctgtgcttgcataccctcagagatggggagctcactaccactccgccctgacccaggctgcctgtcccattgttgggcagctatgagaaaagcccaactctctgtaagtcctacccactggtctcaccccgccctcatgaagaatgtgaatcacatgataatgacaactgcctggaactgcgtgaagagctttgactggcaaccaggagactcttgatacacgtttattgataaatgaataatcttatttaatcccctcaataacttgtgagttaagtgtgacagagcagttaggtaggtgggatgagatttgaattcacatctctgtgactccagggtttgagctcttacccactgtgcctcgttgtaatgaaaatcacagtaacaatgatgacatctaactttgatgggcacctggtatatgcctggtgttgttctaaggattctgcatgtatttactcatttaattctcacacaatcccacgagggagaggctattattgtccccattttattaatgaccatctggagccaggtttgcccaaagccacccagctggtgacaggcagagctgggattcgatcccaggagcccctggctccttaaacacctcccaggctgtccccatatgacagccttttccgggctctgcatccccagttcctctcggacaaagttccccgaccccacctcatcctgctgcccccatgggatcctctgcagggctctgggtgcctctggagcctcagcacccaaagccaaccctcagtgtccccagacctgtgcgcttggagtttggtgagatgaccccgccaggctctgggtgctcgcgtcctcacagcttcaaagtctttgcatcgtggtgggtgtaaccagcttggatgaaacaaggacactagggctcaagtccgggccctgtcacttagctcggctcctctgggccaggtactttccctctccaagcatcagtttcctcaactatgatatgagataaagtatcaggaagcattttgtaggctataatgccaccaactgttgttaatttgggttattttgggagccccccacccccgccaactgttgtctcaccttaagctttgggtagcctttagtggcagatggctctgggtgccccagctctgtcccttgctaggctttgtggccttgagcatatcccttcacctctctgatcctaactcaagggatgtcatgagatggagcaagggcgcgcatgtgatacccacctggtaaagtcaccgccgggtcatgttagttgtcatcaccattactgctgtttctggagaactttaagtcttttccaaatggactcttctcaagcccctggtccctctcctgaccttggacccaggagcagagcttgtgaagtgttaccttcagcatgctgagttttcttattcttttaaacaacgcatttctgttatcaggcatcatgcattagtaaagagaggagggctgatgtcagggctcggggacgggacatctaggctggggtgtccagatctttctgctgactaccccaccggttctgctgtctcacccacacagagcctgctcagcctgccggtctgggtgctgatggatgaggacgtccggatcttcttttaccagtcgccctatgactcagagcaggtgccccaggcactccgccggctccgcccgcgcacccggaaagtgtaagtgaccagcccctgggcttccacatggccagagccctgggtccctgctggaaaagcatctcttttccctgaaaggagagaaggaaaatacagatcagccatatccctggacactccaggatgatttgatttattagatgggtttagaaagtcatgttcaggcttggagggacagagggtgtgtgcctttcaatgtgataataaggattggaagacgaggactgggatattgactccagagagtttggtgccacagcaactactggggatagcccagaagctctgggtgcctggaaagaattgggggcagagaggagggaaaagctgccccatccacaaacattctctgagcatctctgggaatgccttctccctggtgtgttggagctccatggggccagctatggctctagttgtatcatgctggcctccagagcacactgttcctcccttattccaaaaagcccatccttcccaccaaaaattcaagccactcgtagactgctgggcttccaaagcccaggttgctgctactaagaattctgggaaaagcaggacggagctcctgagctccccaccagctcctccctctgcttcctcccaccaatgtctccaagggtcctctccatgcctggcatctcccctgtgcacacaggcaggtgtgtcttaattccagctgtgccatgtggcagccgcaggccccagagcaaggcacttcacctctccaaccttcagtttccctcagctgaaaaattagaaacagtcacatttacatcagagcttggttgtagggagcagaggaacaaacacatctgaacactttggcaagtgaaaggcaccgaatgagcgtgtatccccttccccacctgctttctgagcctggcttcctggtccataaagaagggagaacaatcccacctccaaagaggttgtgaggatttggggacaagtgtgcccgcccagaggagcaattgcagccacatttcagcatcttctgtctcctctgccttccctgctccttgcaaggggctcctctggacacaggagcaggaagctgggccctgagagaatcacagggctaacaagcccctcttctctctccacagcaagagcgtgtccccacagggcaacagcgttgaccgcatggcagctccgagagcagaggtaacccccgcccccacgctggccaggctctcacactgtgggcatctgccttggcccacctgccagccactgggcctctcctgctgggtgctgctgtgtgcctgggacagtgctgggcaccaggaggaaggaaggggttacagcctcagcctctgccactgggggtcccccgagcccagctaaggggagggcatgtgaccagcgtgcggagccagaggagaatgcttccatccctacgctcatccggacagtttacctgggcctcctctgagtcagccctgccttaggcatggaagctgcagagatgactcagacaaggcccagcccacgatgaagcctggggaccagggtgggtgctcagcccagagagttcgaacccttcccctgtgtgctcacccccaccaggtttggaaggagcacccatcctggagtcagggagacctgggttcaattcccagctcctccactaaaaaatggggtggcctcagagaagtcgcttattctccccaagcctcagtttctacatctgtaaaatgggagactaaagtatgtaaggcacttctataggaactcagtgagtgttctctccttccctccttactgcacgcttctcctcaggctctatttgacttcactggaaacagcaaactggagctgaatttcaaagctggagatgtgatcttcctcctcagtcggatcaacaaagactggctggaggtgagttcagaagtgaggatggaggtgagattgaaggtgaggttggagggaaattaaaagtgaagatagaggtgagggtggaagtgcaattggaggtgaggatgaaggtgagggtggaggtgagattggaggtgaggatggaggtaagagtggaggtgaggatggaggtgagattggaggtgaggatgaaggtgagattggaggtgagggtggaggtaagagtggagatgagattggaggtgaggatggaggtgagattggaggtaaggttggaggtgagattggaggtgaggttggaggtgagattggagatgagattggaggtgaggatggaggtgagggtggagatgagggtgaaggtgaggatggagattgagggtggagatgagggtgaaggtgaggatggaggtaagggtggacgtgaggatgggggtgagactggcagtaaggttggaggtgaggatggaggtgagattggaggtgagggtggaggtgagactggaggtgaggatggaggtgagattggaggtgagattggaggtgagggtggaggtaagggtggaggcgagagtggaggtgaggatggaggtgagactggaggtgagattggaggtgaggatggaggtgagattggaggtaaggttggaggtgaggatggaggtgagattggaggtgaggatggaggtgagcgtggaggtgagattggaggtaagattagaggtgaagatagaaatgagaatggaagtgggattggaggtgagtttagaggtaaagatggaggtgaggatagaggtgaggaaggtgagtttgcaggtaaggatggaggtaagattagaggtgaggatgggggtgagtttggagttgaggatgaaggtgaggttggaagtgaggttagagatgaggttggagatgaggttgggaataaggatggaggtgaggttggaggtgaggatggaggtgagaatgcaggtaaggttaggctgagattagaggtgaggctggaggtgaggttgcttcaggcattgtatgcttcagagactgaggatggtctcagaaggcctcagggaagagatgctatctgaggatagccctggagatccaggcaggttggggagcctgcgggaacaaagcctttggggaggcaggtgttcggtggcagcagaacattcttggagctcatgctttggttctgaccctgaaaaatgggttgcttagggcaagtaagttaacctactgagtttagtttcttggtctgtaatgggtgtctcagcaggggcactattgacattggggccagatggtcccttgtggggttgtcctgagcattgcaggctgttcagcaatatccctggcctctccactagatgccagcagcactgctaaattgcaccaatcacatggctctccagatatttgctcctgaggggtgaaatcgcaaccacttgtgtaatatgggacaacagtacataccttgcccacagcagtaaaagctgctgatgaagagtgtgaactcagagtcagcctgtttgggccatttcctagctctgtttttcactagctttgtggacctttggaaacttgctcaaacttgcggtttccttttctgtaaatgtttcttcatcggcttcctggaaagggtaaaggaggtggtagatggccagggctcgccccagagcctgggtgtgcggcgcctggccaggtactagggtcattaggagacttaaatgaaacttcaaagccagggactttcccagtcactgctttgtccctgtgtggcccacagaagggctgtgttctgactcagtgagtggaggtgggaagtggctgtgttgggccttggcctgggaccagccttttgtattaggtcctgtcttcagacttagtgctcctgtggggagtgttgaaggaggttctgggacaggcccagaggcagggtcagcccccaggggtcccaggacctttaagagttgggttgggtccctagcgtccaggccctggagaggagctagtagtgaccactggtttagccagtttagcagtttccattttaccctaatcatagatctccatctcaggaactcagggctcttacagaggcctgaggagtatctctgggccactttccagaaatagaaaacatgtattgccttcctgttttccggaaagtcctacttatcagtatgctggctaacttctggcctcaggttgaaggtgggggcagaggggcagggaggggaccactttgagccttggttaatatgtttgtaaaatggcatgtaaataatccatgttccatagggtcgttgtgaagatgaacagaacacgtgcccaaagcccaggccatggccgggtctgggtctgatttctggctacttggtctagagtagaggcacagttgtatctgatgaatgaatgagtgagtgagcgggatcagcagcaggcccttcctcacccctcatcctcttcctcccctgttctattttcctctgtaacacctgctgccatctgactcactggataggtcattgttcacagcgcgcacagcgtgtcattccccatcatactggaaactccgtgggggcaaggacttattattatttttttattattattttttctttgagacagagtttcactctggttgcccaggctggagtgcaatggcgtgatctcggctcactgcaacctccacctgccaggttcaagtgattctcctgcttccgcctcccgagtagctgggattacaggcccgcaccaacacgcttggctaatttgtatatgtttagtagagacagggtttcaccaagttggccaggctggtctcgaactactgatctcaagtgattcaccagcttcggcctcccaaagtgctaggattacaggtgtgagctactgcgcccggcccaaggacttttatctattttgagagcccagagcctgtcacgtggctggttctcaagaagcctttgttgaatgaataagtgaatgagtgagataaaagcagctttctatataaatccagattctggcatattgtaaaacccaaatataagccttcttagaagtgaccagctcagcgaacttcctcgctttccctcctccctctacagaagaagacccggacctcatctgcctttccccatcactagaacggggctgagggctctgaggcgtggctctgctgcctctcctctcaccagcatggcatcccttctcttcctctgcagggcactgtccggggagccacgggcatcttccctctctccttcgtgaagatcctcaaagacttccctgaggaggacgaccccaccaactggctgcgttgctactactacgaagacaccatcagcaccatcaagtctgtggcctgggagggaggggcctgtccagccttcctgccatccctacgaccaccgcccctcacatcaccttctcatgggtccctctcccactccaaagcccccagtggctcccagatgagccacaatgctgtaacaagccatcaacgtccagggtggcctggccagcctcattcccctttcccccaccccacaccccacttccagcctgatgcctccttactccagcctgtcacccccttagggacatcgcggtggaggaagatctcagcagcactcccctattgaaagacctgctggagctcacaaggtgaggggctgggaatggggctggggagttagatactctggagaagagagcgcagggagaaatgttaagcactagtattaaggtgctggggttttgcgtgtactttgtcttctctttttatccgcagcccagccctgcaggttaggcagcatctccccactttagagatgagcggggaagctgcagagaggttaggggaactggttgagctcacgcaggttgtgggtttagatccggatctgcagctggagctaaagtctctctggctaaaagccttggacttgaaccatccactctcagggactcactacccccccaggtccaggacattgctggacagttattttacagaatggtaaccgcattgctacatttctgactataaaacttgtaccaactcattatatattaaaaaagaaatgtcagtaaccatgtcagaaagatacaaagaagtgaaatcacctcatatttttactcccctcgttatgtgacgtacactcagatttcttcagtacttacaccccacacacacatgcacacacaaaagtcactttggctgcacaaaacctttcagtggctacatcattaacatggccatgcgcttttgctggcctcttaggatttcttctgcttttttactactctaaacaacattgtacagaccatcttagttaacctatttgatgacttatctgatcatttcctttgaatgattttcaagaagtggatttggggattaaagcatttgcaagtctcataggcttctggcccacactgtgaaattactggtagaaagctcagatcaatttctacgtacaccagccaagtagaaggatgcgcatcttcccgcacccaggccagacagttcctgtccttacaaggttctcctcaatagcctcacacaggtgtctctctgaggctttatacagccccactctgtgcccagtcaaacccactcttcttcacaactcttaatcctttagcacatttatacacgagacatttcaggctgtgccactaatttccgtgaaagtctcttctccttctcctttttttttttgagatggagtctcactctgttgcccaggctggagtgcagtggtgcaatctcagctcactgcaacctctgcctactgtgttcaagtgattctcctgcctcagcctcctgagtggctgggatcacaggtgcatactacctcgcccagctaatttttgtatttttagtagagacagggtttcaccatgttggccaggctggtcttgaactcctaacctcaggtaatctgcctgcctcggcctcccaaaatgctggaattataagcgtgagccaccgcacccagcctcttctcccttttaggcctcgatatccccatctgtacaatgggaggttagattacttggatgacacgggcttgtatcaggctctgactttttcttactcctggcttcaggacataaaacccttttcaccccctctccctacccctaccttacgcttaggccctttgattatccctgacttttcccatgcaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagacttcctgtctttgaggctaatggacccgtggggcttgtaatctgtctctttctactatttacatctgatttaaataaaccattccatctgaaaggggcaggctgcgggaaagagtgtctttcatggggagtaaaataccatttaatgagcatccacagggcgtcatttatatctggcaggggccctggctctgagacccctgtcctgccaccccatttccttgctctgtccctgtgttggggggaaacccgagggtccccaagccataccctttctccctcccactgctccccttttcctgggattggccacctgccccacagaagtgatctgctctgggtgccctctggggttccaccaatgccaagtcctcggctgtgtgatgagggtcagaagctctcctctgccttcctgtctctgctgctctgtggagcaggaaggcaggtctcggggttggttgtctccactgtaagtagacacagggggaggactctagtctcatccaggaggagggggacacaaagcaacgggatctccttctctgagctgaatctccttctatcctaatctaccaaaaattaaacaggtgtgactcccacaatggtggtgtgaggagcttggtggaccctctccccagggaaacagcagtttaactgatgagaaatacttaaaatcaactgtttaaagtctctggaaattgttctaagggcacagagcacatggagagacagtcgttcaagtagatcattacgtctcagtaagaacagtgagtcggtggcattggagacacatcgtgttcccgtccccccacccccagctccatgtgatggaaattccactccagatcctccactctggatggatgcagccaggaagatgggctccctcatccctcagctcctaaccttccacagtttcaccccaggaggaacaggctgccagaatctcttctctctgcagccctgtgttgtagaagcactattccaggtcattacagcagagaggactgagtttcctgcagttcccatacaaagtaccaggaaattgagcttaagcaacagaaatcgattgtctcacagttctgaatgctaggtgtccacagggccatgctccctgtgaaatatgtagggaaatccttccttgccttttcttagcttctggtggtttgccggcaatgtttggtgctccttagcttgttgatggatcactctgtcttcacatggcattctacctgtgtgtatttacagtgtcttccctctgtgcatgtctgtctctgcatccaaattcccccttgtataaggacacaagtcatattggactagggcccatcctagtgatcttcttttaccttgattacctctataaacctcctctttccaaataaggtcacattctggagtactaggggttaggacttcaacatgtcatttttaattccaacataacacttcaacccatgacactccctttacccactcagctccccctcctagggcaagggctctgcaataggcgtagcaggctaagaatgctgaaccttaaccctctggtagagcaggggttccatgctgagaggggcaatctgagatcaagggataccgtcctccactccagtgcccactcacagaacaggacatcactcctggagaagcaggctgatttccccatccccagctctgatgcagtggtgcagaggttctgcccagggagagagtcaggccttagggatggagaattccacagcttttcctgaggggactaactttatttgggaagcatgccgaagaagttggcaaaaataatggaaatcttggtggccggcaattaaggaggggctagatactaatgccatcaagagaaatgtaaggccagaaatttaacagagaaccagataaagaaataacgaagaatagtggttctaggactacagtcatccctgaggactcaaaagattgtgctctcgtgccaggctgcacccacacagcagaaatcagagtggaaagtgtggcagacttgaaatcattccctaaaccacatacagatccatcagcaaaacacgctagctcaagaggctgaagcataacctctgaccaagcaatggctgaacaataagctaatctgacacagaggggattcttaggaaggcaggcttaaaaataaaattacactcatttcctggtggtctggaagactgcgtgcacgcccaggccgatcactctcaggagtgactggagaaagaaacgctgggctatcagtttctgactgaacatggggcaagtttgaaccctgtactgtaaaagatgtcttcaaaccacattcacggccaaaagtaaggggtgaaaccaatctaattgagggggcttcagcacaacttttcaccaataggtggtttatgcagacccaggtgcaacctctaggaaaccaggataagagagaaaaaaaaaaaaaaaaacacaagaggaaaaaatacgagcgggggcatcataagctacacattgtaggggaaacggccctcacaaaattagttcagtgaagccactaaacaagtaaacagataacaaaccaaataacaaaaacattaagccctagagggaataggagagcagcatctagagttgcttcaaaatataatctaaaatgttcagttcctgatatggtttggatctgtgtccctgcccaaatctaatgtctaattataatccccaggttgaaagtggacccttatgggaggtggttggatcatgggggtggattctcataaatagtttagtgccattccctccgtgctgttcttgcgatggtgagtgagatctggccatttaaaagtatgtggcacctcctctttctctctctcttcccctgctcttgccatttaaaacttgcccgcttccccttcatcttccaccatcattgtaaggtttcctgaggcctcctcagaagcagaagccactaggcttcttgtatagcctgtagaaccaagagctaactaaacctcttttccttataaattatgcagtctcaggtgtttttttgtttttttgtttgttttttgttgttgttgttgttgttgttgttgttttgagactgagtcttgctcttgttgtccaggctggagtgcagtggcatgatctcggctcactgcaacctctgcctcccaggttcaagtgattcccctgcctcagcctcctgcgtagctgggattacaggcacccccaaccttgcccagctaatttttgtactttcagtagagatggggttttgccatgctggccaggctagtcgcgaactcctgacctcaggtgatccacctgcctcggcttcccagagtgctgagattacagtcatgaaccactgcacccagctggtatttctttatagcagtgcaagaacaggcaaatatagttcccaacaaaaaattataagaattgcaaagacacagcaaagtgtaatccatacacaggaggcaaataaaagcaggcaaaggaaactaaaaaaattgcctttgagggaaggattcagatgctggacttagcaaacaatgactttatattaggaatatgtttaaataactaaaggaaaccatgtttaaagaattaaaagaaagtattgtaacaatgactcttcaaatagagaatatcaatacaaagacataaataattttttaaaagagaaccaaattgaaattctagagttgaaaagaacaataactgaaatgaaaagtccactagaaaggctcagcagtagatttgagttggcaaaagaatgttagcagagaaagtataagcaaactgagagatagatcaatagagatgatgcaatcttaagaaagaaataaagaaaaaggagtgaagaaaaatgagcagagcatcagagaaatgtgggacccatgaagtgtaccaacatatgcataatgagattaccagaaagagaggagagaaggagacagaaaaaggatgaaaagaaataatgattggaaactttccaatttttattttttaaaaaaccaccaatctacatatccaaaaagctcaacaaactccaagtagtaaaatacaaagaaagccacacttaaacacatcatagtcaaaatgttgaaagccagacataaagagaaaatcttgaaagcagaaagagaaaaatgactcaccgcataaaagggaactacattaagactaacagctgatttcctgtcaaccaagaatcttacataaaacaaatctaccactcaaaaatgaaggtgaaattaaaacattccaaaataagcaaaaactgagaatattcattgttaagcagacttgccattacaaaaaaatattaaaggaagttcactctaatggcttcattttaacttgattagctctgtaaagactctattttttttttttttttttgagatggcgtttcactcttgttacccagactggagtgcaatggtgtgatctcagctcactgcaacctctgcctcctgggttccagcaattcccctgcctcagcctcctgagtagctgggattacaggcgtgcaccaccacgcctggttaattttgtatttttagtagagatggggtttctccatgttggtcaggctggtcttcaactcccgacctcaggtgatccacatgccccagcctcccaaagtgctgggattataggtgtgagccactgcacccagctaagactctatctcatgtaagatcactgcattctgagatactggggttagaaattcaacatatcttttgggggagaatacaatttgaaccacaacagtacactagaaaatatccatttaagaaaaattttaaaagaccttgcaaggtgtgatctcccaaacccagttatttggcttctagtttgttgcctgaccacattcaccaagaaaattttctgccacaaaacaaccagacctcagctaggacacaggctttgaggaattatgagcctcacaagaagcaaaggagttctccaatgattcttccactccccaccaaaaaaactatgataggagctgaaaccagaatacagagcagttggggtgttgttttctggagtgcagaggcagtccagaaggcagagccatggggaggccatgagatagggaggctgcgccaggggcttccgtgccaggccaaggccctagatgtgagagctgaggtgatctggagagagtggcattcctggcttcaagcagaagcggaagagggtctcctctggagtaaagtatttccagtttaggctggcaggagttaccctgattaatatcaagcaaaaggctcatagtcaaagatcaccaaatctctgtgagtgagaatgagcagaggcaataaacaatagctttagagccccagggactaccgattaccgaattatgtgactgaaatatttaaagaaataaagaatgtaaccataaagataaacaagcaaaaaagaatgagatggcaaattttcagatgtgtaaaagaaagaaggtatgaacgcatctatgtgtgtgcgtgtgtgtgtgtgtatacacacatatatattattcaatgggtgagttggtaaaaagtccaaatttatcaataattctgataccataaacatagatggattccatgcatgagttaaaagactgtcagggccgggcacagcggctcatgcctgtaaccccagcactttgggaggtagaggctggcagatcacgaggtcaggagtttgagaccagcctggccaatatggtgaaatgccgtctctactaaaaacactaaaaaattagccgggcgtggtggtgcacacctgtaatcccagctactcaggaggctgaggcaggggaatcgcttgaactcgggaggcggaggttacagtgagccgagatcgcaccactgcactccaacctaagcgagagagtgagactccgtcaaaaaaaaaaaaaaaagactgtcagattgaatttttaaaaatctaaatctatgtaagtgtcatatgtacaagagacacacataaggtaaaacgtcatggaaacattgaaattaaaaaaaaagtatgaaaaaagatattcctggaaaccactaaccagaagacagctgggacgtctatacagattcacaatctacttttgtgtaaacttggtactcaaactcacttggtagcactccttgaccctgagctgaatagttaacgcttaccagccatatgtgtctctgctattcccttattttttgatgcttttggggggatgaattttgattttatgtacagctcaagtaagaacccgtcaaaatcagaagtgaaaagcttttgctgataatgaagctgatgaaaattgcatgggtggatttgttaagtaacggtatctgatgaaaaccttggctctgatcaattggcagtgggcttcagtctgctctgcagaatggctgatgaggacccaccaattgcttacaccctgttgactgttcttggcgtaccatgtgctacaggaacacaccagatacatttgacagtaactggaaaaagcctacatccaccatctttgtaggatgtatccaatttaccgtctgtcagtacacatactagacaccatgagtaaccagagaaatattttctgactgattaataacatttttataccagcggtacaaactcattgcagggattctagcttggaaaaaacaattgttagatgttatcattcctaggaaactgctatgcatactccctccctaaacatcttgtggaaaagcagtttcagcttttatttccccttgggggatatgtgcattttagcctaagtgcaaagaagtttagaggaagggtaaacactttttttcaggctgtgctcttgctaccatcacagaacctaagattccatggctcccgaaagagtccagtgttaagaatgtcatgtacacaattgacagtgtttggaatgatgctgattatacattaacacatttgacacagattctgactatactgatgcttgcaaacaagtctgtacataaaggttttggagaatttttgtgacttatgagaaaatgatgatgtaagacttcattcttgcacaaaaagtttatcagctaaaagtggaaataactgagaaaaactgataccaaagaaatgtcaaacaccgtgattcagctattgttcattctttgcatagtggggaagttgctaacaaatacagataagggttactgtgatgataatgactacacaattaacacagagtaaaacattcccattaaaaatatggtgaatatttaattagttaattatgggccttgagcaattctcaattaatggtgagcaggagataatggaaaattacccaattagaaacaggcttctcaagtaggcatctcatggaataggatgctggaagaagtcattaaaaaggcaattgattgcagtgtgcttcttggtttggggaccctgttcctggtacatcatgagatgtccaggagggaatatctggcatcctcaagttaagataattcaaggtgtgtttaataaagggactgtttacaaagacgtagacaacacacaggaaaacctcaaggaatagttcaatatcccagggataggacctcagacctgttacattcctgagcccaaaggaataaagggaaggagtgtctacaaaacctggaaggaggggattgtgtagacatggcctccttagaaggactggtgatctttgactggtgggcgagattgacccaaagtaaccccgctgggaggcgatcagaggaacaaataccccgccctcctctccttccccattctgatctcaggggaggggttccctactgccaaacaaaactggaagccctagggccaggctgttgtaatccacacaggttagcttcccaaggtagacagcagggcggaagagagcacagtgtagatgtgagtggggaaaaatgaagatatctggcatcctccacccgttttgcccctcattatatacgcttatccttcagccaagtgaaaactccatgttcccaagacagggaacacaggaattcccatcagctattttggcattttaggatcatatccatacagacatactcccacctgaaacccaaagtgtgagctgctacgggtattctttatataaagcagtggaggcatgatgaatgaagtaatacacgcatggctgttagagcccctgcatccgcagctggtcacaggtccaaagctgatattttgagctacctgttcccagtgttcatttcatgttcctctttcctctgccagtacatgggtcaaataagggtctttatgtggtggagcaactcaagacttcattcctatgggatctgagttctcgttagacttgtctttatcagattgcctcagtattccattgaccaggactattgggtaagaaaatactgagaggcacctatgtgaatcacggtgggaccacacatagtcctgtctacctcctttcttttttcttttcttttcttttttttttcttttttttttttttttttttttttttgagatggagttttgctcttgttgcccaggcttgagtgcagtggcacaatttcagctcactgcaatctctgcctcccgggttcaagtgattcttctgcctcagcctcccaagtagctgggattacagacacccagcaccaagtccagctaattttttttttgttgtatttttagtggaaacggggtttcaccatgttggccaggctggtcttgaactcctgacctcagatgatccacctttctccacctctttctccacctattggctcagtggcacaaggagggtcaaatggttcaaatttctaaaaaatatcactttgtatatgccacaagttttcatatgccctattgtcatttgattgtaactactatttaaattcaattaggatattatctgagctatcagttacttagaagtgtgttttaaaatttttaaacatgtgaggattttattttttgtttgtttgtttttgggggtttttttgagttggagtcttgctctgtcgcctaggctggagtgcagtggcacaatctcggctcactgcaacttctgcctcccgcgttcaagcgattctcctgcctcagcctcccaagtagctgggattatagggatgcactaccacacccagctaatttttgtattttcagtggagatggggtttcaccatgttggtcaggctggtcttgaactcctgacctcaagtgatccacccacctcggcctcccaaactgctgggattacagttgtgaaccaccatgcttggccatgtgaggactttaaaaaaacacttttttttctttttctttttaaagtatccttgcacgttttgtgcagattcatttgtctttcatgtccttcagttttagagacctagacaagctaagggagtgaatcaaaatcaacagataacaagggtgaggtttctcaaactgaagcatcctgtttacgtctggtaaaaccacctccacagaacatcatgcgtcgtcaggtataaggcctaacacctgtggtgtgtagtgatacagcattttatctcttccttgtagcccatgaaataaagagaaagtttgttcaagagatgatggtagttttcactgcactagagtgttacaagaaagtaagtgagaacaataaccccaggacagggaggctgctgctcactgctccagcatctgcagcattctcctgaggggacacattaaggcagcagagagacatttcccaaaataaacagcgagggaaataaaggtgtaggagtcacagtgaggaggctaaagtgactccatcttggaagctaatccaccatgttgacttctgattaaccccggttctgggaatgccgctaagatttccattttatctattgttctttgtgtgagaacatatgcctaccataaatcctgcctttagatcaaattaagcgtgctaccctttctttatggtgtataatccctgggtctgggggataatagtgtagagatctacctgtctcacagctgcccaagaccatccttcagtccctaagttcccaaataaaaccatcctataacaagctggattcgtctgcttccttctttggtatcctggctcctatgtttgc

SEQ ID NO: 1533 - DNA, 2692 bp, Homo sapiens
gaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggccatccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaaggacatcgcggtggaggaagatctcagcagcactcccctattgaaagacctgctggagctcacaaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatgagctgacggtgtccctggagcagtgaggggacaccagcaaaaaccttcagctctcagaggagattgggaccaggaaaacctgggaggatgggcagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggcactccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaagtctgtggcctgggagggaggggcctgtccagccttcctgccatccctacgaccaccgcccctcacatcaccttctcatgggtccctctcccactccaaagcccccagtggctcccagatgagccacaatgctgtaacaagccatcaacgtccagggtggcctggccagcctcattcccctttcccccaccccacaccccacttccagcctgatgcctccttactccagcctgtcacccccttagggacatcgcggtggaggaagatctcagcagcactcccctattgaaagacctgctggagctcacaaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatga

SEQ ID NO: 1534 - DNA, 1020 bp, Homo sapiens
atggctgtggcccagcagctgcgggccgagagtgactttgaacagcttccggatgatgttgccatctcggccaacattgctgacatcgaggagaagagaggcttcaccagccactttgttttcgtcatcgaggtgaagacaaaaggaggatccaagtacctcatctaccgccgctaccgccagttccatgctttgcagagcaagctggaggagcgcttcgggccagacagcaagagcagtgccctggcctgtaccctgcccacactcccagccaaagtctacgtgggtgtgaaacaggagatcgccgagatgcggatacctgccctcaacgcctacatgaagagcctgctcagcctgccggtctgggtgctgatggatgaggacgtccggatcttcttttaccagtcgccctatgactcagagcaggtgccccaggccatccgccggctccgcccgcgcacccggaaagtcaagagcgtgtccccacagggcaacagcgttgaccgcatggcagctccgagagcagaggctctatttgacttcactggaaacagcaaactggagctgaatttcaaagctggagatgtgatcttcctcctcagtcggatcaacaaagactggctggagggcactgtccggggagccacgggcatcttccctctctccttcgtgaagatcctcaaagacttccctgaggaggacgaccccaccaactggctgcgttgctactactacgaagacaccatcagcaccatcaaggacatcgcggtggaggaagatctcagcagcactcccctattgaaagacctgctggagctcacaaggcgggagttccagagagaggacatagctctgaattaccgggacgctgagggggatctggttcggctgctgtcggatgaggacgtagcgctcatggtgcggcaggctcgtggcctcccctcccagaagcgcctcttcccctggaagctgcacatcacgcagaaggacaactacagggtctacaacacgatgccatga

SEQ ID NO: 1535 - DNA, 33468 bp, Mus musculus
  misc_feature (1578)..(1778): "n" at positions 1578 thru 1778  can be any base
  misc_feature (2792)..(3115): "n" at positions 2792 thru 3115  can be any base
  misc_feature (9060)..(9290): "n" at positions 9060 thru 9290  can be any base
  misc_feature (14053)..(14178): "n" at positions 14053 thru 14178  can be any base
  misc_feature (17998)..(21098): "n" at positions 17998 thru 21098  can be any base
  misc_feature (27074)..(27502): "n" at positions 27074 thru 27502  can be any base
cctccaaatgccaccatactcagggctcaggtactcacattcatttcctagagaacagcgcggggcaggtccacacagcatctctggtttggatccttctccttcttcagatttatctgacaggtctctcagctgaagtgcccaggacagaagccctattctggggtccaaccatcccctctggttacattcatatatagttaagcaatactatgtctatgcctgccacattgctaaaaatgaacctgatatattatatgtatgtaatatatataatataataatataatatataattatatattaatataatataaaatttatactaatttatactaataaaatatgtaatttataatataataaatatataatgtataatagaatagaatatatatatcactttaaatttttatttactttttgtgtttgtgtgtggacacatgtgtacatgggtcagctccttccttctattttgtgagtcctgggcataaaactcaggtatagttcaggcctggcagcaagtgtcatctcgctagtcaggctagcattttgggtaccagataggagattctactactaccaagttccgaagactgtgtaatacatatttgcagtttgtccgcatcacatctgccctccacatcttctccttggtcacagctcatccctacccaccctggaggtccctgtagctgcttggccttttttcctgacttctgccccacccaccctggcctgttcctcatgtggccaccagagggcgggagcggaattcacatcctgcggtttttcattttatgtgtgggaaaaaaaaaatacaaagtagcgtcaagagtgtgtttctgggaccaggggctatgcatccggtgcgaatcatcccagcactactgcatccacagtgagacctccagctgaatccccactttcctttgcaggctaccctcatctccctttcccagtgagatgtctgtctgtttgtctcccagggagctctttgggaaagagatgttttgttggacaccgcacgagcttgttttaatatgttgcgggagccacataacatgttagctatgcaatgcacgtgggatttttttggcagtagaccaatcttctttcagggtccttcccctcctgccttctgaggctcctccctcccccctccccccccaaaccaggaaggaacacaaggcaggagagagcagagacctccagcggttggacagagtgagattgtgtacacaggcaaagccagtcagttccgggttcaatatgttcccgcccctcttgtgtgggcttccaggaagctggacggattgggactggggctgctgtaccccagcggggcccccaccccctttctggctgagtctggagtactagtgagaggtgagcaagggtgttagacctattttagagaagtaagcaggaagtagggacatggttgcagagaaaaggcagcagggcattgggtaagggcctgtcccagggtcaggccagagtccccggagagaagcaagaggcagttggttgggagagttagccggaccagtaggacagttcttatcatagggccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatatacacacacacacatatatatatacatacacacacatatatacatatacatacatacacacacacacacacacatatatgcacatatatcttcagtcatggttatacacttctgtaatcccaacgcttgggacacagcaggagaatgaggttaaggccagcctgagcttcactgtgacactttgctttccacccctaccccaaaaggaaatgaaatatttaagagagagaagagtcctgggtgctggaacccagaaggggaaactatgaagaacaatagcttaggccagctcgactttaaaagtagtttagtaggaagcaggaagcctgtcactgtgaagacacacatcaccaggctgaacggctggctaatgggggccatctggagaaataggaagtaggatgtattccacatggatgggtgatatgagctgtcccaggcaagcaactgtgaaatgttaaaccaggaaacagggcgtagaaatcacagaaggatgcttctaaaacacggcccagaatggcagaaggctttctgggaagctcgcacccacccagaaatgattaaggaagagataggttaattagcgcacgacccatgaagctagaaccgactctcatgcctgatactcgcgatagaaagagcgcatttccctagtaaggaaatcagtgggaaaaaccaacgtaaaggatataaaggacaaggcacgagaaaacactgcggtgggggagaaactgggtgagctccaagctgactggaaaaatgctagctcagaggaagccgaatgcaaatcacaatcaacccactcttcttttcttttttgcctgcccgactgtcaaaaacattcgcgcccgcctgaacctctgagatgatgggaggttagaggaaggggctggctaacgcattgcctgccagcaggagcctgaatgagtcctggagggcagttaaaaacaagcgcctagccctgcacccaatccaatgacccagaggattgggggggggggacggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggtcaggtcagctgatgaggggactcaggcagcagggacactagcctgtaagccaggcttttgactactttgtgggttcttctttattccacccttctgcacccttattccaccgtttcaacccctaatactaggcaagaaagaatgagagaggagaaaggggtaatgttattgttaaaagagttcctgctaattagggccatagagttccttggggcaagtttgagcttccctgtcaagatatctaacaactttcctcctcctcctcctcctcctcctcctcctcctcctcctcctccttctcctttgcacataactatttaacaaacagcaaccaatcaacaaacaacagcagcccaccaatgggtctttagcatttatatattctccgaaaagtccctagaattccaactatcacacaattgcagaaactatctgcagctggcaaaatcagaaccctgctagagcacgaggcatgtcggtcagctgctatggacaatctgaagcagtcccatttcccacacctgggattaaaacgaaaacatgttcttatagtatttctgtattttttaaagaatccaaaattctcactaactagccagagatattctttttgaaaatattttattttattatctttaaattatgtatatttgaggaatatgcatacatgtgtgcagttgcccctgaaggccagaagaggacgctatcccctggagagtactcgctcataatccctgagtcttctctctagcccctttaaatatgtttgagtttggttgtgtgaacatatttcccactcaaatgtaacagggaaatatcacaatgttgccaaaagctctaaaagcttttaaactatattgcttagggttcagctagtgggatggatgagtggaaggctagagtgaaggatcatgggttacctaaggttgagtgaagaaaggtcctcagagtctcaccctgaaccagtctcagagagtgcaaaaagctggggaccaaagagtagcagatgcagcagctagagaggtgatgtacctgaaagaggggagctccatccatccatccatccatccatccatccatccatgcatccatctacatctctgtgcatccacccatgcactcacccatgtgtgtatccattatccattcatccatcgctgtctatccatccacgaatgaaaccatccatccatgcatcatccatctgatccacctctccattcattcatccgtacaaacatacgtatgtgtatccacccatgtgtgcatcattcatccatgcatccatccatgcatctatgtatccatgtagccacccactgcagccatctgtgtatccatctctccattcatccatacactcatgtatccattcatctatcagtatatccattctacccatccctctactcatccatccatacatgaattcattcatttgcacaccatttatctgatccatcacatgtacacacacgcgtgcacacatgcatccatccatccatgccatgattcgcctatccatccatgtatgcatccatgcatctgtctgtctacctgtctgtctgtctgtccatccatgaattcattcatttgtgcaccattcatctgacccatcatgtgcatatatcttcataccatgatccaccacctatccatttgtgcatgcatgcatccatctctctctctctctctctctctctctctctctctctctctctctctttctccctctctctttctctctctctccatgcccatccacacaccctcccatctacctgaagtgagctaggggagctagctgcagaggggacaaggatgtcagatcctagctctgccacatgactaggtttctggtgaggaaagtccctgatggagggaatggcctgcgttcttctggggatttcctgggagaaagtcccctctctgagccctggttgtacctggtacagcctcccaggtggcatctcttgctcagctgtggagaggaaggagtgagcacgacagagtggcttagcgaggcccatagagctgcaaagaacagagaggggcagctcagtggctctggggaaggtcctgccaggctggtgcctgcctactgcttttcaccaattctttgggttaatctatcaaggtagagggcactttgacccatatgctgcccaccctgaactctatcccacacccactagggttagggtagaggcagctttccatttaaaaaaaaaaggtcatttaaaaaaattattccatttaaaagtgtttttggagctggagaggtggctcagtggttaagagcattggctgctcttccagaggacccgggttcaattcctagcacgtactagcagctcatagctgttcaggtccagaagatctgagactctcacacagacttacatgtaggcaaaaacatctatgtacataaaaaattaaaaaaaaaacaaaattacatgcttgttatgcgtgtatgtgcctgtgcatgccatgtgcaagtttagaagtcaaaagacaacttttctttgggggtcagggggaggtcaccttttttcttctgagttctggggattgcattcaactcaccaggcttggcagcaatcacctttatccccactgagccagcttgccagcccctaaatcaatctgtgtgtgtgtgtgtgtgtgtgtgtgtgtgtgtgtgtgtgtgtgtgtttgttgtggagggtgcacttttgccacggtgcctgtgtggaggtcacaaggccagctcaggactcaatcctagtcatccctttgctttgaggcaaaggctagccggcagtgagcttccggggtgttcctccttccaccttctgtctcacagtaggactgtctgtatcacagaatggtccccactctgcctgtcttttatgtggcttctgaagaagttcaggttctcctgctgtgtggcaagctttctacccactgagccgccatctcctctgcccaaagggatgttttcaaacctcttatttccacaacaatttaaagagtcagctctggggaggatcttgagataaagatcagctggctgtttaaggggaaagtgtttagggaggtatagcaattctaaaggtatgtgtggctgatgatatagcctcagggtttagaaagcaaagattggatgggggtttgggcagagctactgttgtagtggagataggacacctggccttggaagggagttctagccagatagtgtcttctttgtgacactaaaaaagactgagcactctcagcaagcatttctgatggtaaatagtttgcagctaacttacacccattcactaagaatgccacaagcctggtactcaagtctgtcatgccctcagggctcagcagggcacggtacatggtgcgtggttcacagttctttgtaagaaaagcatctttgggaggcataggcttcccctggcctgtggacatgagtgatacaccttcaaaggacacactatgaaaaaggagatcacaagtcaaaaacggcgtagcgctaaaacataaaacaacgcacacagaaatatcaagattggtaaattgtgtgtgagcatgtgtgcacacgtgtgcaggtcaccacccgtgagcccacgtggaggcagagtgagagtattgtggggaggggacagccaaacagattgtcaggactgtttaagcagggtgacagacagcacatcagaaaatattgttctctgtagcatctccgttcatatggaaaagtgttcggtgaacagaatgaaaactgaagccactgttaggaggagcagtggcaagcagaggtaatgggcaacagctctctcatgtttcatgttaagacatcagaagcgccttgttcaggccaggactgaggctccacgcctagcactgtgggcttatgcaaccttcccgtaaagagcccaaacaagccaaggaatgactattataacattaagaggaagaacactgtcacttaaaaaaaacaaaaaacaagcaagcaaacaaacaaaaaaaccaactagtgataaaactttcctctgtccactgtcaggtttgttagcaaatttcaaggtatctgtagcaagagccagcaaggaggctcagaggggaaagaacttcctgccaagtctgatgacctgagtctgatccccagggtcccacatggtggaaggagagaaccggcgacttccatgggtgtgtgcgtgggcacgcacacaaatacattttccattttaaaagcagccatgggtctctctttgtgccaggtttccacatacacaaatccaatatgcaaaggctgacatttccccttcatccaaggagtggcaaggaaattcaatttgagaattattagctacagtagtgctgagagtaataaggaagcaagaagtgaatcttttgaaaaaggtgcctgacctttctgggaggaaatggtaaaattttattgaaagatataaaggagaaggtgaagatgctaacaggcagacagaatgactatcacaaggatgtcaggtccctactcgctgctgcaggttgaacgcaggacagcccaggactcttatgtcatttgcttgagcttattccacagtgtagatggaagagcagagattcatcaaacactagaacaatcctgaaggaatgtaagagaggcacgtttctcctaggcttggagctggggtaactgaagcaggcttgtgtcagcccctgggtggatgggaggactagcagagaaaggggccaaggtttggtttgcaggtgacagtcttggtccacgaggcttcttgactgcccattcactgggaaaagataggtagaactttgtttaatagatggcactctgggatgatggtctgtgtccattgtcagcacgacagagtcacctgggagaaagacatctggagcacatcgatttgaggtgggaagatcagcccactgtgggtggcaccatcctgtaggctgggaaactgcattgtgttaaatgaagaaaggatctgagcagcaatgcgctcatcgttgtttcctgattgtgggcaaccagctgctccaagctcctgctactctgacgacttccccactgtgatggattctaaccttgaaccatgaaccagaataaaccctttctcccttctgtcgctgtggtcggagtattttttttttcatagtgataggaatagaaactaagaaagccctagagaaatcaaatcaacatctcacaaaacctactagcagcccctttgtcatctaaaatccactctgtgtatcaaggtcactgtctgtagacagaaactgtacacactttgtagaatatctttgtgaaattgcataggaatgcttaagaaagaatcactcaaagagtatcaatcattagggaagaaaaattaaagttgaccacatacaaataaacctttataaatatcacagcttcaaaaaaaataattccacatactggaaatgaactatgaaacggttatagcaattcacacttgaaaaatcaaacaccgaacttctccaaataaatatgaggggaaaaaatactccagtagagaaatggacaaatacacaaatagtaacttgtgtaataggaaacccaaaagtccaataaacaactaaaaacacaaatgcccaacaaaacacctgcaaacacaaacacccaaccaaacacttataaacacaaatgcccaacacaaggcgagtgtagttgatatcatcaaaacggcaagaagcctacgacagtttgtaggtaggattttcggtttggagtggtttcccagctaggatcttgctgtatcgctcgatggctctggctgccttggaactctcactctgaatcctggactcaagctcccagcaatccctttgtctcagcttcctgaaagcttagattgcaccatgctgtgagaaggtttggacttgccaaacttctaccagcttgctctactgcatctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttccccccttcctccccttcctccttttctcccctctcctctacctcttcccttctctctttccctccccctcctttgccttctctctacacactggcccttgcttaggcagcaccccccccccccccgggccaactttgtttgacatcacacgtcatagccaccagttttccctgctggtgactctgaggtcactctgtagctctcccttggcccatgtctcctgccttgctcacagcacctgtggttgtggtttgccttctctacagagcaggaactccaggacaacctggcttcctgcattttagagtcaccagctcccaacacaatgcctgatacacagtaggcactcaagtgtttgcccatgggagtcaggccaactgacttcttggaggatgcagattcttcgagagcaactttgtccctgccctggcttaggaagtgaatcttcaattctctagggtgcctgggttccctttggagcctaagtcaagtgcccttggtggcctgggcccaacctagcacctgtggggccccaggtcctcttccagaccgcatgctccaccccctcaaggctgtggggcagcagcttgggtaagttcctcttccgtttcctcccgcctcttgagctggggtgctgctcctcactgccgggtacctcctagccactccataccactggtgtccacagcaacgctcctggcccccaactgtcatccctggctgctgggcctcagatgcaatgcaggccatcaagtgtgtggtggtgggtgatgggtaagtacctggctgagttgtctcccacccctaccaggatgcctctgagatcctccctggtacacccacagattcagggctcccaggaggttctggggaaagtcgcttcctttccttgtaagggcttacaaggaacatttggggtgggtctggactgctccctgtccttcagcctaccccactccggaagctacttgggtggagggcctggactgtgggtggggtgctgctatttgcctgtaccctgagagctgggacagggctcctaccgggccagcatcagttcagggtacaggtacgaggagggaaatcagcagcttgcccttcggacctttgtttcccaggctggcccaggctctagttgctgtcttgctgggcctaggggacttctggcaatctccaagctttctgactctcagtccagcctctgctcttaaggactccagagggcaggctggctgcagccctgctaaagtctgatagtcattgtcagatcttgggaccacaggctctcataacccaaggcctgagtttcttcatgtgtctcccatatattccgacacattagggtgcagtcctcaagtctatcttgggtcccgctagatccatcctcacatgtactagacagccatcttcagttcgaaacggggaggggctgaggcctggagagctttcctggcttaggtcccaaggtcacacacactttggctctgctggtggcataggctatctacctcctcagctgactaggtccgacttggtcgctgctgcagccgccaccgcgctagggtgtcagccgttatctgtggcagctgctctgctcacttctgctttgtgtctgatctgggggaggagggggcggacacggagggccggaagtcaatgattctatgcattcaaagttacctgggtggcaggctggggcttgagggcagaggtttagggggcagggacagcagagcaacctcctcgagtgggaagtgacttaacggaattgtactggggaaggcccggagctgtccctctggcctctcagcttcctgctgaatgacctgggtgacctcccagcttggcagggagatagcttaaatggtggtcatctccatttatcccattctcttttgtatgtggtcaccgggctgtggctctctgtatgatctgtcttccaccaaccctacttaccatcacagagttcgttttacaggtgggaaagaccaaaactccgaaaagttacataacctgccttggaggcagaggatttgaacccaggcccctctgacttcaaagaggggcgatgggcagtccctaacagtcattagttggtgccacttctatggcaccgggttcagtgtcttagaagtatcagttattttactgggaagatgggcttgtccttgttgtctacatggggaaactgaggtacaaggtgcttaggtgacttgcaaagttgtgtagatggcaaatgatggaggcaggatctgaagcttaagagagacacgtgacagtcttacccagctctccagggtcctctgttcggccccatggtcatctgtgcctatcacctgtatcccacacactggtacatgtacagtactggagttctcctcagatgtgtggctcacacccatggctaagactgaagtcaggttctttatgggcactgcacggggtagagcacactggtatggggtgtctgggattgggagactggagcctgagtacagttcccgcctccccttcatcttgaccttggtgaaggggagctatgaccttggtctctcctgcatcttgtctcttgtctttcagagccgtgggcaagacgtgtcttctcatcagctacaccaccaacgccttccctggagaatacatccccactgtgtgagtggcttcttgggggctgtcccctgtgggggcctgagaccaagtaggctggtaaggctagagagactctccattgtggggaagctggctggtgatccgacatgcaacgcagtgacttatgctaagtcttagaatgtatgctaaggaggcagaggctccagaaggcagagggactgtggggtgggaaggcgtaaaaggacaggaaggaatatgtccttcaagccagccaggaggagaaagaggggtggagatgggctatggaggtgagggaggaagagtacctcagaaacttagcagcagtgtctggggacccgtgtgctggggtgggcacagtgctagctgtggtctgtgggaagcctatcttctggtgcaggatgtagccatccgctcccacatgatacacaaggagtccgcaggtgtcagaagagtctcagagcatccccatactcacagagcagctccccagcttcctgcatagatttcaagctcttcaagtatcccccaatcttcccttctagagatgttacccactgttttgctttattggatcaacgatccttaggcaaacctaccgcaggacctttgcaccagctcttctccctgccagaaatgccctagggtgatttcttgtctcattctcatacctacaccctccaggcctatccatggtgccctcctggaagccttcaaggctaaaggcctgtcaatcgccagaggagcttgccagctctctctcaagaccaaggacccatatgttgagaaggccttggcttctcaagaaagtggttgatacattgtgtaatatacatatgtctcataagtgatatctgtgcctcgaggtgacgagatccagagaagtcttcaccactagcatctagttagaatgcctttgggttggtggccctgtacaggataccacactagtgattgcattgggtcctcaagggaaatgggtgttacaatatcctgatggccaatagccaatagcagctatgaggcttgtccccctgggtcactcagcctgtctgccttcagtatctcaccggggccttcatttttatcttcatggaagccctgcctggagtagaaagcagagatatacagagggatagtatcctgagcccaaagcttcccacactatcaaaggagccaccacccaaccagtgccaaaccaaggctccgctccaagtccctagtccggctctatagggatccctttctggaacagaggattcagctgcctctaatacctggctaagctgaaggacccagcagggggcagccagaggggctgggcaggcagctggacaccgatttctgcccaactgcatcctgatttgaatgaagactaaaaacttccctggtacacaaagcatgaatgactcctgccattaggcttataagtcagagaggactgaggctagacctgagcaagaacaggatcaaaggggattatggctgaaggtcactgtcaccaggtgtgctgatgctgttcttgtccctgagtcaaggccctagcctgcctttacctgctcaggcagccccgagaacccacttgctcaaggatttccaagcactcactcttcctctgagcccacgagctcagtttccttttctaccagaggcaagccctggactgggagatccaagccttgggaagcagtgtccctgtgaggaggtgggaggtggaagtcagaggctttccagtgtcctagcggcccatgacagaccgcactgctggccagccggtcaggtgccgagggccctcaggtctgtccacgatcaatcaccatgtcctgttcaggtggtagctggggccgggctgtcactgggacttcctcctctgagatgaactttcttccaatgaggttggcacacatattctcagatggggacacctgcccgagaatggttctatgtcaagtgttagggacacagaggcatgtcagcagctccgtgctttcgggcgctgtgatgtgggctctcatcctgtctcctacctgactctgtccaactgaagcccacataaactttaaacttttggttttgtttttcccgtttgtggtaggatatatactcaggctggccttgagcttgtagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaattaatgaatttatttattttccccctagatgaacttttaaaaagaagaacttagctagagcctcaacctggcccaagcccttcatctggccccccctttatgcttaaaatccagtacaaggggttatcaaagctccccaagttccacctcacctgccccatctcttccagctgttcagtcctgtccacaatctcctgggctctcttggctccctgctctccctcagagagccccaggagcacgcccccctttctgacagtgttccctgtctgctgcagcccacccctcccactttatgtcttccccactgagaactcttcagggctggggcagagccgtgcgaggccaggaggctggtatatctagctcactcctgattctagagcaaaataccagtttctagaccatcacacagcagctgctggcagtgggcagagcaccctggccggtgggtggagcctgtccagtgctttgccaaccctctgctgttcattggctggcaccccccaatggatatcataagaagagcagccactttccatgcttctgagccgacctggggcctcagtttcctctctggtctcctgggtcatgtgagacttcaaggcctaatacgcgtagggaatccccttccacctgaccaaggaaggcacttgaagggcgctttgaaaggtcctgaccgttccctaccttctctgggtgtcctgaaagctcagaggagccaaaaagacagatgcctttgcctcaaggcatcttgggacgatagagggtcctgatgtctccagcttgccagaaccccacacagctaaggcacttgccttctgaccttgaccacccttgtctcccagaaggttcttctgagactcacaaggatgcttcccagagtaggcacacagcagccctatgtgccgaccacctattctggactagctttagggcagaaagtaacaagctgggttcccctgtcccccccccccgcccccgcaaggaatgtaattagtggggctgacctggctgaggcagaaaagtctccctggagtgatgcaaagagtcctgttgagggtgagaagcaagttaggatacgtgggactgtcctacgtaggtaagctggaataggaaggagtatttctccagatgtcagtgtgggcaacctcaggaggtgggtggtgtgagcctgccgggtgaaggaagagcagatagagaagctaggagctcgaggtcttagtgaaccctgtcatgagacaaggagtgggtgcatgtgtaagctcagtgaggtcggatgatctctagacccaggggcaggcaatggaggtgtccctaaatcacagctatggcagggcatagtgagcctgttggacacagcttgtcccttaggttggtcactcactggctgtgtaacctcgggtgagtcacgaagcctctctgatcttggtttcgctccacctccccccaccgtaccatgaggagcctgttcttttaacctaggtattcgattttactttcaaaagtgctctctccacttagcgtagaccactgggctggaacacccccatggctcagagtgttccctgtcccaacacgagcttgctgggctcctggtctagtgtttggcccacaccaatacaaggcttagacatgtctatgggtctgtctgtcccttggaactggccctagcacagtcacttgtcatatgagtggagagtgggtcatctgctgagtcctgcccctccaggaggctcaggacctcccttcaccttcccacaggcctgccaggagaacagctcactggtgctggcctggctgtgttccgtctccttcctgtttcccctctgacagcttcccaagtacaccttgcacctcctctctcacccaggattggcttcagggagacccagcttaactcagggacaagccgccactcaatagacaccgtgcgacccacgctaggtgtccagcatagggggaagattaagttcactctgatcaacctgggaaagaatctcacacaacccagcaatcccctttcccagggacgagaaaagggaggcagaaagaaaaaaacaaaacaaacaaacaaacaaaaacaaaaaaaaaaccaaaaccaaaaacaaaaacaaacaaacaaaacaaaaacccaactgatcaagacggtcatcctctttgtttacttgtacttaaggcatttgtaatagtatccattagttgtggaaacagccagttgcacggtgctgtgtgactttgggctggtcacagtccctctctgagtcctggcctcgggagaacaacactggcctgggctggaagtccgggcatctgggttcaaggctgacccgttcctttctgctccttacagatttgacaactactcagccaatgtgatggtggacagtaagccggtgaacctggggctgtgggataccgcaggtcaggaggactatgaccgcctccggccactctcctacccacagacagtgcgtacccgcccctgtgcctccttgtggtccctgtcttgatcctgttccatttactgctgatggccttcaggccagcagtgtctgctcagccctgagtctccctttgaggcctgggggggagggaggggcagagctagggtcctccctcagccatgctgccccgagtatcaccatgccccgagatgctagcctttctcagtgtgtgccaggcaggggctagtgtgcctggagctggggtaggcaggtggcctgctgcaggggactctgtggcttctgggtccctagagctgggctctctacccacaagggcaaagggagtcggcaggtagatggttatgggagccgagggatggtttcccagacaggaccctggcctccctatgctaacctgccctgttctgtatttaggatgtatttctcatctgcttctcgctagtcagcccagcctcctatgagaatgtccgtgccaaggtgagccacgagtggcctgggaagggtgctgaggaaaggggaatgggctatcctgggttaggagaggccaggggagagagggtcactagtaccacacaggaccaatgagaggagagtctccttgggctgtgtgtgtgttgtggggggaggggtgggacagtgagggttcctcctgcctctgagccctgtccctttgtctatccaacctcgtgcctcttcttatcaacacacaaactcgcttgactcttatctccaaaaaagtcttgccatttttttgtttttgcatgcctgctcagatcctgctctgccttgtgaccctcccgctaggggggctcttaccccccttttcctggtgccttgggcgtctttgtcccactccccactgctccctctcactctccactcccccacctccagtggttccctgaggtacggcaccactgccccagcacccccatcatcctggtgggtaccaagctggaccttcgcgatgacaaggacaccatcgagaagctgaaggagaagaagctggctcccatcacctacccgcagggcctggcactggccaaggatattggtatggggcttgagctcagagagagagggtatctgggggttggaggtgcctgaacacagccttgtcttagcgctatgctgcatggtcaaactctgttctcccaaccattgtaccagctgtgtgacctaggctggtcccttggcctctctatgcctgtgtttctctgtcacaaaggtataacagcagtgatggcttctgccatgtcagtgcctgggtaaaatgacttggtccacggtccccagaacatcacagcatgggatgggaggcatagcctatgattgcttggagcacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatcctttgtggggagctgaaagcccctcccttgcagctgctgtgaggatgggcaggtgaatggccagctgaatgcctagggacccagcttcagagtgcctcactgctggtcaccacaagaatggggaacccatgagcccccacccagagtcatctctggaacaaacggctggatgccagggcaggaccctggcttcatcttctcagtgggaatatggagccttgagaactttccaggaacaagaagcacctggtgtgatgcacagggtctggcttcctgaagctccatttcctcctggctgccatgacccgtttcccaagccctggcttcagtggcttcctctccaggggtgaccgctctttgcagttctgtgggcctgtggctgctctgcgctgggcccactgaggcggggagagccaccagttcctcacagctgtcagaagtgcctgccccagaaaggaaagcagaaggagccagggaagtcaccggcctccctttctttccctttccttcctcggaccctgcatctcccagcctctgtgtcagggctctgggctcaggttgcaggggtgggtagccatgcagatgccaccaggggcctgtcctctggagggcacagaagagctcactattttcatctccttactgagttgccctggggcaggcaggtcccacagctgctgttatggtttgcccataaattggggtgtgactaaatgatagatatattggggtttcctcatacctgctcagaggtgtcagctctatgaggaaggctgtggggaacttggtcactgaagcaggtcatctccaccttccaaacaaagggtcttgtgtcctggggtctttcaccatccctactgagtctacaagaagaagatgaagtacagagaggcatattcccattcgggtgatactccccacttgagtgatactccctgtttgagtgatactccccactcaggtgatactccccactcaagtgatactcctagttgactgatactccctacttgggtgatactccccactcaaatgatactcctagttgagtgatactccctacttgggtgatactcccactcaagtgatactccctacttgggcgatactcccctctcgggttgacacagcttctccatgactcaggcccctgctctccctgtctctcctcagattcagtcaagtacttggaatgttctgcactcacccagcgaggcctgaagaccgtcttcgatgaggcaatccgcgcagtcctctgcccacagcccacacgacagcagaagcgcccctgcagcctgctctaggggtattacacctctcctctgctgctggaagggcaccctgcccctgggcccagcccttaggtcactgagagtaaagttagaccaggacagagggccatgggtacctaggtagcctcagtttcccctctctgtcactacctgtgaagagtcttccttgacggatacaacccaagcaagctagaacctgccaatgccctaagccaagacacaagagctgcctggctctcattaagcctgtccttgtcacaaaaaccagagaaccccaaccataccctgggcaggatacatggggggtatgtggggaggagttggaagagagttctggggcaggcagaaattgaaagcagccatggtcccggatggccctgagctgggaccttcttgtctgtcctcggcactgaccctctgctgtctcccttccaggtgtcaccccagtcctcccatcccaatggtcctgaccctccagggtccccaccaaagctcagtgacgtgctggtggaattgctgtttctccgtgtggcgttctttcccagttagctgcagaacttgcctctctcctccacggaggtccctggggatgggcggatgttcataggccacatcctatttgggaggttcctatgttcccaggggccatcagggacccccaagacgcagccatccatcctcatacagagtcatatgcccacctgctccaggccttcctgacacctctctcgaagcttccggtctccatggcctgccactagtgtgttcgccatgttgggataccttcttccctgaaccaaagggagagatgtggaaatctgctcctctgttctcctttttcagaaaagcacagaacaaatctacttcagtaaatctctcatctgcccagccaagtgagggtctgagctcagccaacccctactgtctctcgagacctcctactctacttgaagggtagagctattccttcttgggactgtccactccacctgccagtcaggacccgatccatagcaaatggaaaatacagctctcttgcttacacagaaaataaatgtgttgattcttttggtggaagtgcagtgagttcaggcacagcttgatcaaggtggggcgaagggatcagatgacaccacggagcctggcttcctgcctgttttgggtctgcctgctgctgccaggctcatttttctggccattgattcttgggacttgatcctccgaggtcaagttcaggtgatgtctgccccaggcaagctctaaggaaaggtcactctggttgaaccagcttgtcttaggcccaccttcaatcacacaagtgtgtcagagagaggctgcactgtggctggctgtgagttgtgttagagccaggagcagaggtgatgccagggagctggggtatagaatgggtgtgtgtggcgttgggggaataaattctttagggaacaaccttcttaaaactgggtgggtatccagtagctagggttctataacccccgactgtcagaggtcacggtaagtgtcctttctaccattatcagggacagtttctgccccagctggcactaagaaaaacagatttttaaaatttgttttttttttgtttgtttgttttgttttgttttgttttgtttgagacagggtttctctgtgtagctctggctgtcctggaactcactttgtagaccaggctgtcctcgaactcagaaatctgcctgcctctgcctcctaagtgctgggattaaaggcgtgcaccaccattgcccggctcatttgtttttgagataagattttattatatagcctgggctgacctcagacttgccatcctcctgcctcagcttcctaaattctgggtttacagatgtatacttccgtgcctggataaggttgaaattcttactagagagttctatggaagttgatgtggtgtccatatcaggcacccagggcctgggcctgagacagtcctacctacatcttccctgaattatcaatctatggtcaagaccgtggcactgtctgagcttccacgtccttctcccaacacacttttgatggcctgtctgtgtcaggtgctaccatagtctcagagattcagtgacatatgtgttgttctccacccctcccccaccccccagccctggagtctccgaggctgagagaaaatggctcccccgacattggaaagctagccctaaggagctcagcattttctgtctccaagagttccagagctgccccccaactcctcccccccaaacttaagggactccacctctggaggggcttggcccagtgagggaagcttctgttcttagcttggctcacacgagggcaagatttctctgacacagaaagaaaggttttaagcccacaggtgctgtgttctccaacacggttgagaggacctgcacccccatcgctttggggagttaaagacctggggtgcacccagagtccctcttttagctctctgctccttttctagtgcatgatactaagcaaaaccttacatgattcaaaaccgtagatctaagcccagaacctctcaaactaagcctctaagtagctaaacctccccctcctcctcccccgcccccttctgtaggaggcaaaccccggcctgttaccttgagcctctgtgtgagttgtggagcacacagccagcccactgtcaccttgacagcttatttcacccagatctcagctttcactttaatctgaataaagtccccgatacttttgcaatttgtgtggaattttatttcggttccttgactaagaggccaagaaccgagaaaaccctgaccggactccccaccaccactagtgacctttcttctccttctgttgcccacccacccaggccctgtccctgtgtgccttaaactcccctgtgtgctgggttgggctcctgctgtgggtgttcagctccctgccagctgccctggggtctttgccttaccccaagagtaatgacatgaaatacctgttccaccccctcaccgcacatgtaacctcagtcctgcatttggtcacttggggtgctgctagccattgcagaggaggaaacagggcctggaaagcctaggggtcagtgctctgatggacaaagcagcctgacccctcctgcccctccccgccctgccccttctgcttgtctcacccctccttctctcttccaacctccctaccttctcttacggttgctacccctcccactcctctctccctctcccaccccttccatccctcccactccctcctatcctctcccatccctcccacccatccctatcctctcccacccctcctgcccctcccccattcctctctccttgcctacagaatcccagtttagggcaggacagcagtgtgctcagcattgatgaaatacttgttttcagtgagaggaaaggctgtttaagtgtgtgtgcttgttgctgttagagcaaccaagttttgttcctaattccccctcccctggaggaggatctgacaccctcttttggcttctgtgggcacacacacacaccccattaaaaacaaaactaaacctttaaagtaaatatacgtgttttctcagcctttggggctccgaggtcacactgttttcaccaaccacatccacacaaggaaagtcagtcagagatgctgtttcttggaagaaagataacaaaagtggtctcttgctctgaaaactgatgggatgtccagagcagccactgtcacctggtgagcttgcagcctacagcatcaacagcagaagccaacggcttcaaacagagacagaaagataaaccgggccggtgctgttagcctgcatcagccttgcttccagaatgaatgctggaggacccagttactcgtttttagcacacttggccagacttcccaccgatgttccctgttagtacctgaggccctagaccctgagtgcagcggctgaggatcagaggcctcctgagcagcgaatgacaagctgtgagatggttttgaaacaggaggaagtgcttgctgggtaggctcagaagtgaggcttgctccacagcattcacctggtaccagagcacacagtgtgtggcctgggaggggccggggctctctactctatgctcagccctcttgtccatggcatcatggcccaggagtgaggtaagcacctgctggaccagacctccatctcttccaaagctctcagcctccagctagctgcttcctgctccttcttccgaagcagggacctcttagccccaccatctcacgtccacactcacaagtcaagcctggatgactgtcatcctagggtcccctaattcaagcccccaactgcactgcccctcctgagctgagccttggccctttcctctggtcagcagtgacgtctttcccaggatgcctcctgctttctctctctcagtccccgctccaaatgcaccgggaagtctcagtaggatcgtgtgtcacagactgtgccaccccaagtgtcatcctaagatctgctgttcgctggagccgggactcatctgacagactgtcatggagtctgggggctgcaccgtgccctcaggagctcacaggctatataggaggtccccatgtcagcagagaacagggaagtggtccctctgtgtagctgtcccctgtgctttcagtcccatgtgctctgtcaacatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagagagagaaccagccatgcccataatctgccatcctgctgaagcaggtttctactgcccaccaaggtgtagccatgcctgtgatccatcttgtgtgtgccacatcagctgagtcccctctgactgccccatctactactaatgtgagcgaggagagcggcctggatgagcccagccatcccggatcatgagggggagcagcacagctcctctgcaggctctgagtctggagaaccttgatgtctgcagctttgctctgtctccccacccccacctgcctctacacaggcttcatgggatgtcagtaaaggacacagtaaagggtcctgcagatggcgaggcagagctagatgccatgagaggacccccaggaaggcaaaaggccacaaggcatagaagaacactggcttctattcactccctgtgtccccactcctctgtgctaagactgcacacacagagaaggatgaggcccagtcttttctcaccaggggctcggaggtcaggagagacagacacgtggatacctttgcccttgtgatttgttccacacatcagaatcttctgtacagaaaggaagagctctggtctgagggtcagtacatccggggttggtataccatgggatggtacatataccctaagtccttataccctggccctgtggaaaggtggccacgaaccgaggacagaagaaacagaaaaaaatctgtgtgcagagaaactgtgagacagctatgacctcaaatcctggtagttgaactatagagcagagggcggtgaaggctagacctcagggcatgatgggaagagggaaggatcggggaggggtgcagatcaaaacgacacagagaaagcccacctcctggaactggggggtggggtgtctggatctggacactgtaggctgtcgatgacagtgatggcttaggacactgaagagcctgcttgagggagcagttaaccttctgagcctgcttcaagaaagccagggtgaagacccacactgggtttggaagatgtgaattcgatcttacttggtaatccctccacagggacaagttagccaagatatagcatttaagggaagaaagatttgttttggcttgattccaaggctttggttggtggttggtcaattcctcccttttaggccagtagcgaggctggaacaccatgtaggaaggacatggagcagagcttgctcatctctgtaatctgccagcaaacggataaagaacaaagagccaggaccaaggtttacccttccgaaccacggtctgagtgacctgcgccgtacgttccgcagttccacttcccaacagtctgtctgaaattagactctcggggggttaaatcagtggttaactcagaggctccattatctagtcgtttctggaaatgatcacactcaggctgttctttattaatttcctaggtgtctctcaattcaatcaacttgataattgagattcacctttgcagtcccagcccatgtcagtttgacacctaatgcatttccttagatcacacttaatctccaaataaagacgtttgcagaagacgaccagtctactcaagacggctgccctgttcataccccggactacacggaggttttctccaaacatctcaacaatttcaatattgatcaaaagttcaaactgaaactgagagtccaggcaaattgacaaaatcaaaagtatataacaccacacagtaaacactcttattcttttgggttgaacagggtgtagagagactctttcgtgcactgggtgggagcatcacctgtcaataaaaagctactggcctattagcttagacaggaagtaggaggtgggagtcttggcaggaagagagggttctgggatagagtctgctgtgggaggatatttgcctgaactcggaggagacagatttatgaaactgagaagaggtagccagccgtgtggcactcatgaaatagaataaacagttaattgagttacgagttagtcggggaacaagcccaagcttgtggcttagccatttattaattcaagaagtaattccgaaggcgggttctgggccgcagcaatggcggaggcggcgggctggtaacgtgaaggtgggttggaaggaggaacagcagcagaaatgcagacagcacacacaggtttaagcactgcagatggcgcctacggtccgactagccgctgctgtcctggtaatgcaggcacaaaggcagttattcccagtggagcgcaccctgttggaagaggactggaagcctcccgaaatcccagcaaaagcatcgtgcctttaacccaaaggcctggaagccgatatcgtagatttgccctcttcgtgcctttcccgacctctttggaggcagaaatcgcctgtgggtccctagttccagatgtcgaaccacaccgagaactggtagggaaggagcttaaagtgagcggctgcctgctggaggtacgctggatcgcggaagattctcgactcctccgaatttccatcatcaactttcttgaccagctttccctagtggtaaacaccatacagctttttgggcccccggtttcccattaagtctggctggggacccaagactgaccttatttccatctcctcctaagcaatataattttccctagggaaaagattctagaaatagtaactactgcataaatgtgggggcctaatatttttttcctgacttgatcctcaggcacttaggggccatttagtctggtgcttcaatgtttgttgctgaagaaaataaagctatgctgctaatctgcatttggaaaaaaaaaagaagaagaagtaattcagtctcagagtctatttctggaatttaggcactggtagaaaagctcatggttaagcaggagaacagaaagatgtgaggccaaagacccaacaggtcaaacatcaaatcctgtatatcatgttttgcatctggggcacacggtgtcatgatgtgaacgtcccggcacatatctcactgctctggccttgctggctctaatgcacacggtctctttcctgggttggctctgctcactgctcatggtttcccttggcagctcttccaagtctctggcatctccagcttggcctggtctccacagcatcttcacctttctccccagtttcacacaagaggggactcttggggctgacccagacacaacccccgtccccagcctcccaggattttctttggaatctgcgtggttgcctccgtgatcttacaacccttccactctttgtggctgcaaaaccagcgtcgtatgaacaacagaaggtctgccactgtctctgtggaccatgactgtggctgatgagcatggtgaaaggaattctgggaaagtcttttaaaagattacattaacagtatagacactgccaatggctgaggtctgaccaattcttgagatggccttgaagtactttttcctactggtcagatacaaggtcttggcttcttttgttgtttttgttattgttgttgttgttggtttttgttttctgaggcaggttctcactgcacagacacaactggcctgggacttcctttgtagaccaggttggccttgaactcacagagattctctcctgcctgtgcctctcagggttgggaataaagacgtgtgccattacaccagctatccttttaatggtgtgagtctctttagcaatctacttctcctctttgagctaactttaaccattccttttctgagcaatctgcaaggttttcaaatccttctctgttctcaccatcaacatggctaaaagcagctagcaataaccacgctgtaacctaaatgctgaaatgccttaaaactttctctgccagattagtcagtcagccaccttgaagctgagactcacaaagtctcatggtatggggaaaacagagttaggttcttggacaaacataagcaaacataaatggtgtgtggtctagttcctagagcattcatgttcccgtcagaagcttcacaggcactgactctgtccacatctgtcttagtcagggtttctattgctatgacgaggcaccgtgaccaaaaataacttggggagaaagggtttatgcactcacagttccatggaacagttcatcatcaaaaacaataagagatagaactcaagcagggcaggaaccagaggcaggagctgattcagaggccatgggggcaagctgcttactggcttgctcagcctgatttgttatagaacacagagcccacaatgtgctgggccctctcccaacaacttctgaaatcccctacagccagatcttatggagggatttttttgtcctttcaaatatctctaccttgtatcaagttgacataaaactagcaagcacaattgacctcttgttaacttgacacacaaacccatcaccattaaaccataacctttccttgattgtacttccctacaaccacacattaatattgacattacaatataaacattccaaattttagaagttccagagtctttaaattttttaaacacttaaaagtccagtctctttaaaatagccagtctcttttaaaatctggtcttttaaaattcaaagtctctcgtctgtgggctcctgtcaaataaaaaattaatcaaatgcttttctacttcaaaagggaggaaccagggcatggtcataatctgaacaaagaaacaccaaactccaaaagtgtgaataacctaaactgtccaattacctgggatcactcacaatcttctgggttcttctaaggggcttgggtcactgcttttcctctgccttctgtagcatgcacagcttgtcttctaggctccgtctggctacaccccagtgctcttgctgctcttggtgatcaccccatggtacgtgtgtcttcaaaaatgctcgagttctgtcttagggcttctattgcagtgaagcgccatcatgaccatggtaacccttgttgagggaattatttaatcgaggttgccttccagtttcagaggtttagttcattaccttgacaagaagcaaagtgcatgaaggtaagcatggtgctggaaaaggagctgagatgtctacatcttgatccaaaggcagcagaagacagtgtgccatactgggtatagcttgagcatatgagacctcaaaacccactcccatagtgacacagttcctccgacaaggccacacccactccaacaaggctacatctcctaatagtgccactccctatgggccaagatttcaaacacatgaatctatggggccattcctatccagaccaccacaggtttcttgctgcaactgagctgcagttttaccaatagcctctcctggcctctcttcagggactccagtcaggctacacagtgccaaatctcagctgctcttcatgacccatttgtgtcttcaaaatcaggaccacctgggggtactcttgcactatcaagtttggttgccagcataaggtacaatcttggctccttctggaatacagattctgtgtgctgactcccagaagacactttccagaagatttcacctcaataatgctgtctcttaatcacagctaattctttagccgaacctgagcagaaccaaagattattcacataaatagcccagcaatctgcttccctctgaacttcataagttgggcatccattctctgcattgctttcaacaggtttatcttccaagctcctacagaacggctcactgagctctcaacactcaacgccttttgcagcccaaagttctgaagcttttccataatcctattcaaaacaacatggtcagttctgtcacggcaattaccccactcctggtaccaatttaacttagctaagttttctattgctgagataaaacacggtgataaaaaccacacagggagggaaggctttaaggcttcatttactcatggttccatataatatctccattgcattccagtttc

SEQ ID NO: 1536 - DNA, 1255 bp, Mus musculus
ccaactgtcatccctggctgctgggcctcagatgcaatgcaggccatcaagtgtgtggtggtgggtgatggagccgtgggcaagacgtgtcttctcatcagctacaccaccaacgccttccctggagaatacatccccactgtatttgacaactactcagccaatgtgatggtggacagtaagccggtgaacctggggctgtgggataccgcaggtcaggaggactatgaccgcctccggccactctcctacccacagacagatgtatttctcatctgcttctcgctagtcagcccagcctcctatgagaatgtccgtgccaagtggttccctgaggtacggcaccactgccccagcacccccatcatcctggtgggtaccaagctggaccttcgcgatgacaaggacaccatcgagaagctgaaggagaagaagctggctcccatcacctacccgcagggcctggcactggccaaggatattgattcagtcaagtacttggaatgttctgcactcacccagcgaggcctgaagaccgtcttcgatgaggcaatccgcgcagtcctctgcccacagcccacacgacagcagaagcgcccctgcagcctgctctaggggtgtcacccagtcctcccatcccaatggtcctgaccctccagggtcccaccaaagctcagtgacgtgctggtggaattgctgtttctccgtgtggcgttctttcccagttagctgcagaacttgcctctctcctccacggaggtccctggggatgggcggatgttcataggccacatcctatttgggaggttcctatgttcccaggggccatcagggacccccaagacgcagccatccatcctcatacagagtcatatgcccacctgctccaggccttcctgacacctctctcgaagcttccggtctccatggcctgccactagtgtgttcgccatgttgggataccttcttccctgaaccaaagggagagatgtggaaatctgctcctctgttctcctttttcagaaaagcacagaacaaatctacttcagtaaatctctcatctgcccagccaagtgagggtctgagctcagccaacccctactgtctctcgagacctcctactctacttgaagggtagagctattccttcttgggactgtccactccacctgccagtcaggacccgatccatagcaaatggaaaatacagctctcttgcttacacagaaaataaatgtgttgattcttttggtgg

SEQ ID NO: 1537 - DNA, 579 bp, Mus musculus
atgcaggccatcaagtgtgtggtggtgggtgatggagccgtgggcaagacgtgtcttctcatcagctacaccaccaacgccttccctggagaatacatccccactgtatttgacaactactcagccaatgtgatggtggacagtaagccggtgaacctggggctgtgggataccgcaggtcaggaggactatgaccgcctccggccactctcctacccacagacagatgtatttctcatctgcttctcgctagtcagcccagcctcctatgagaatgtccgtgccaagtggttccctgaggtacggcaccactgccccagcacccccatcatcctggtgggtaccaagctggaccttcgcgatgacaaggacaccatcgagaagctgaaggagaagaagctggctcccatcacctacccgcagggcctggcactggccaaggatattgattcagtcaagtacttggaatgttctgcactcacccagcgaggcctgaagaccgtcttcgatgaggcaatccgcgcagtcctctgcccacagcccacacgacagcagaagcgcccctgcagcctgctctag

SEQ ID NO: 1538 - DNA, 38764 bp, Homo sapiens
  misc_feature (26811)..(26830): "n" at positions 26811 thru 26830  can be any base
gctacttgcgaggctgaggcatgagaatcactggaacccaggaggtggaggtggcagagagctgagatcacaccactgcactccagcctaggtgacagagtaagactctgtctcaaaaaaaaaaaaaaaaaaaaggaattccaaatagtcctataccccttaaagaaattgaattagtagtttaaaatctacccctcttccccctctcccccataattctgaaaccaggtccagatacagatggctttataaattttataaaatatttaagggagagataatgtaatattatccaaactggctgggcgcggtggctcacgcctgtaatcccagcactttgggaggccgaggcgggcagatcacgaggtcaggagatcgagaccatcctggctaacacggtgaaaccctgtctctactaaaaatacaaaaaattagccaggcgtggtggtgggcgcctgtaatcccagcaactcgggagactggggcaggagaatggagaatggtgtgaacctgggaggtggaggttgcagtgagccgagatcgtgccactgcactccacctgggtgacaaagcaagactccatctcaaaaaaaaaaacaaaacataatattaccaactctcataatgaaactagtataaccttgataacaacaacaacaaaaaaagacaaagacaatataaggaaaatgaccggccgatctccccaccctacctgtaaatattggcaatttcaagccagcaatacacaaaaggcgatgcatcatgactgactgagtgagggtgtgactgaagctgctgtaacaaaaagatctgaaaacgcagtggcttaaagaagcaaaagtgtatttctctctcaggtctcgagctgagtggtctggctctatgttgcccccacatggttccaggattgttctggcgtttttatttcctactccgtggggagaggggaaaatgctgtacaggataaatggtttagcttccaaggagatgatgcagaagttgctgacatcacttccatttgcacctttttcccccagacatgatcatagggcccactctgctgcaagggagactgagaaatgtctttagctgggtgaatgtgtggctagccccaatgctgggatctctgttattaaaaagaagcagagaacggttgcttagggatactcagcaatagtccccatattaactaaattagacttatctgggaatgcaaggagaattggacatcagaaaatgtattaatataattcacaacatttccatgggtacagaaaaagacattcaatcaaattaaacgcttaataatgataaaacaaaactgccgtttctaagaatagtagggaaacttctttcagtgacaataatatccaccaaaagcctgcagtagacatcaggttcaatggtgaaacattagaaacagtctctttaaaatcagaaataagacaaggttgcctgccagcactgattcccttcagccctgtaataaaagatctagacaagccaaggaattaacgttataaaaattgggaaggaagaaataaaactgtcacttttcataaatgataagactgtctataaagacagctgtagacttgttaggagcaaaatctttacgtaaattagaatgagaatttccatccaggtttctatataagttcaatatacaaaatgtgacattttccctacgtatgggcaacaaatagaaaattcaatttaaaaaatattagttataatggcactgaaagtaataaggtatcaaggaatgaatctttcaaaaaatgtgcatgacctttccggggggaaattataaaacttaattgaaagatataaagaagcaatataccatgttaatggacaggaagactcaatatataaagatgtcacttctccccaagttcctctagaaattgaatacaattctaatcagaatcctcacacagtttttcttggaacttgacaagcttattatgaactttatatgaaagagcaaagtgtcagtggtaacgataacaattttgaaaacattcaagagtggatgatttgctctgctgggtataaagatctgatatagaacttcagtagttggctgggtgcagtggctcacgcctgtaagtcataccagcactttgggaggtcaaggcgggcagatcacctgaggtcaggagttcaagaccagcttggccaacatgtgaaaccctgtctctactaaaaatacaaaattagctacatgtggtggcaggcgcctgtaatctcagctatttggatgctgaggcaggagaatcacttgaacctgggaggtggaggatgcagtgagccgagatggtgccgtcgcactccagtctgggcaacaggagtgaaactccgtctcaaaaaaaaaaaaaaaaaagaactgcagtaattgaggcagtgttttaccggcttgagggtggaccaagagtccaatagatggagaggctaggaaaagactcatgcacttatagactcttgacatgtgatatgatttggatctgtgtccccatctaaatctcatgtcaaattgtaatccccaacagtggaagtagggcctggtgggaggtgattggatcatgggggcggagtttgcatgaatggtttagcaccatccttcttgggtactgtatagtgagtgagtttttgtgagatctggttgtttgaaagtgtgtggcacctctcacccccttggtcctgttcttgccatggaagatgtctgtttccactttgccttccaccacgaggcccccccagaagcagatgccaccatgcttcctgtgcggcctgtgatactgtgagccagttcaacctctttttcttagtaaattacccattcccagatatttctttatagcagtggaactgtgagatgcgagatggcttgaccacagcttactgggcaaaaagcaggcagagctactcaataaatggttctggaacaatcagtcatggagataatgatgttaaatacatatcacacaggccaggtgcggtggctcacgcctgtaatcccagcactctgggaggccgaggcgggcagatcaccagaggttgggagttcgagatcagcctggctaacatggtgaagccccatctctactaaatatacaaaattagctgggtgtggtggtgcgtgcctgtaatcccagctacttgggaggctgaggcaggagaaccgcttgagccccgtaggcagaggttgcagtgagctgggatcatgccactgcactccagcctgggtgacagagtgagactcagtctccaaaaataaaataaaatacaataataaaaaaatacatatcacacaaaaactaaaaacagtcaataatctcaccacaccctaaattccgtctgaagtgtgtaaagacctactcatatttattttcttttttctttcttgagacagggtctcactctgttgcccaggctggagtacagtggtatgatcatggctcactgcagcctcgacctcccaggctcaagcgacctgcccaccttagcctcctgagtagctaggactacaggcatgcaccaacacatctggctaatttttgtattttttgtagagatggggtttcaccatattacccaagatggtttcaaactcctgggctcaagtgatctatgtgccttcatctcccaaagtgctgggattgcaggcatgagccactgcacctgacaagacctgtttatgaaaagcaaaactttaaaagaaaatgaggatattcgtcttcatgaaattgggggaaggaaaggaatttttaagtaagattcactccaaaaaacacaagtcattatgatgcagggcaggtgagcctccaaattggggcttagctttggaaggttcttgggttctctcaggaaggaattccgtgctgagctgacggtggaagaaaacagctttatggaggtggcagtgttacagctgcgcgagtgcccctgcagagtagggctacctgacgggcagtgtactgagagcagcagctcaggggcaggtccaccgtcatatttatacccacttttagtcacatgcaaattaaggggtggggtatttagaactttctagaaaaagggtggtagtttccgggctgttgctatggaaaggggtggtaacgtccgggtgttgccatggcaatggtaaactgacatggcgctggtgggcatgtctcatgaagaggtgctttcgcctcgtccccatttctgctagtcctcagtctggtcttgagtcaaaccctgcctcctacctcaattaggagagaaagtggaaatttgactacatgcagataaaaattgtgtctattaaatgtcacaacatattaaaagacatcccacggactggaagaaagtatgaaatgcctctagcaattcaaatgaaaatcagaatatgcaaagagcttctccaaataaatgtaagagaaggataaatactgggcctggcacagtggctcacgcctgtaatcccagcactacctgggaggcagaagtgggtggatcacctgaggtcaggagtttgagaccagcctggccaacatggtgaaaccccatctctactaaaaatacaaaaattagccgggcatggtggcgtgtatctttaatcatcgctactcaagaggctgaggcagaagaatcgcttgaacctgggaggcggaggttgcagtgagccgagatcacgacattgcactccagcctgggcaacaagagtgaaactccatctcaaaaaataaaataataaaataaaataaataaaataaaatagataaatgctccaatagagaaatggagaaaagtgaagaaaaagcaatttatggaacaggaaacacaaggtccagtaatcacttacaatgatgcttaataccactgggaatcagttaatataaattaaaacctcagtgagatgccaattcacacccatctagctggcaaaagtatgaagtcttacaggccaagcatgggctgggagtagacgaggaggcccctggagatgggcgtagcactgtccgttgaagtgcaagatatgtgtgtgtatgctaaacctcacacaccagcccaggagcacacggatgttcacagcagaatcgtttgtagtgcaaacattgcaagccacttacaaatcctggcccgggagatgtaggctgcagtgagccatgattgcactccagcctgggcaacagagtgagaccctgtctcaaaaaaggaaaaacgaaataaatatgagtaggtctttacacactttggacagaatttagggtgtggcgatatattgactgtttttagtttttgtgtgatatgtatttaatgtcattatctgcatgaattggataaataacatttcaatacattcatatactggaatatttaccagaaaaataactaaactggaactctaagttgaacatttcccagcacactgctgggtgggactgtgcctcccaaattcgaaggcctgtggtgaggaggagggagctgactgaccctgagtggccccagaacaagaggtagcacctctatgaggacaatccaagggaaggatttgggctgaaaatgaggaagggttttctaacaggccaggctagccaggagtgaaagagactgccccttaagggaatgagctccctgtcattgaaggtatgtaagcagggactgggcagctgcatcatgggcagtgagccaagcattgtctatcaatggcacaagggtgggttgaatacagatggccttaggccccttctaagcatgcccagaggcctcgtggttctgtgattcagtgagtttgcaaagtgtagtcaaaagaggatgggactaaatgaataaccaaatgtgacacatccctgcggtgggacactactcactaataaaagggacagacacaccatgacacatgtaacaacaagatgaatctcgaaaatatgctgtgtgaaagggccttggatgagatgccacaccgtgtgatgccgtttatgtgaaatcctagaaaacgcaaagtaatctacagaggcaaaaagcagatcggagcttgtgtgtgtgagctgggcggtggctgggggcgtggggagggagaaacagggagaggtgggctgcaggggggtgcaaggaagcttttcaaagtgatggaagtgttctgtgatgttctgtatcttgggaggttccatgggtgcatatatctgtcaaaatgaatggaattatatgctttaaatggatcacttattgtattcaaattatacttccacatagatacttttttttttttgagacggagtctcgctcggtcgccaggctggagtgcagtggtgcgatctcagctcactgcaacctctgcctcccgggttcaagccattctcctgcctcagcctcctgagtagctgggactataggtgtacgccaccatgcccagctaatttttgtatttttagtagagacagggtttcaccacgttgaccagaacggtctccatctcttgaccgcgtgatctgcccgcctcggctccgaaagtgcatatggatacttttaaaaaaagaactaaaaggcgaggagggctggagcagaggtcagtgccgctgcatcatggacttggtcacgtagacttgggcctgactgctgtcgtccaagtggcttcactcctccatctggccatcctgccaaccctggcctgtccacacaatcccaggaccacctgcagatgggggacattcccagagagtggttccagggctcctgtgtcattctcggtgtgggttagagtgcttcagggatagctttctgttcttccatgttttgtattcactacagtaccaagcccagagctgggtattcaggtggtgtatcattgatgcatgcagaatgaaggagagaatcaatggcttaagctaaggagaatttttgcttgggctgccctggagaagtggctttcttgggagggagggcagttgcaattttaggaccgtcatggccatgtacagttgagtgggttgtgtactgcaaaaaaaaaaaaaaaaaaaaaaaaaaaaggccgggcgcggtggctcatgcctgtaatcccagcactttgggaggccaaggcgggtggatcacgaggtcaggagatcaagaccattctggccaacatggtgaaactctgtctctactaaaaatacaaaaaaattagctgggtgcggtggcacgcgcctgtagtcccagctactcgggaggttgaggcaggagaattgcttgaactcgggaggcggaggttgcagtgagccgagatcacgccactgcactccagaccggcgacagagcgagactctgtctcaaaacaaacaaacaaacaaacaaacaaaacaaaacaaaaaacaacaatctctgctctagtgggtgaacgaaggataaaactcagtatctacactgctttccaagtcaggtggctgcacccattggctgtgcattcctaaagaagcgcattattcttttctcttcccttttttaaacaaaaaaatgttttattctggaagaattttagatgtacaggaaaggtgcaaagatagcaggagtgttcacatacattttcacccagtttctctctatgctaacatcatttgtgtaaccacggtatatttgtcaaaactaagaaattactattcttaacaatactatcaaaaatttcagacttgatttggattttactactttttccactgatgttcttattttatttttattttattttattttatttttttgagacggagtttcactcttgttgcccaggctggagtgcaatggtgcgatctccactcactgcaacctctgcctcccgggttcaagcaattctctgcctcagcatcttgagtagctgggattacaggtgcccgccaccacgcctcgttaattttttgtatttttagtagtgacggggtttcaccatattggccaggctggtctcgaactcctgacctcaggcgatccacctgcctcggcctcccaaagtgctggtattacaggcatgagccaccacacccggcctgatgttcttttttttttaaagctaatttaatcgtttaaattgcttcaagaagctgcatgtatagatgaaacacttgtttttttttccccctttaagaactagaaatgaattcttttaaaaaatgtattaaaaatttttaatttgtaattgacacataataatcgtacatatttatggggtacaatgtgatgttccaatgcatgtatacaccgtataatgatcaatcaaatccaggtaattcccacatccatcacttttaatatttatcatttctttgttgcgacatttgaaaccttctcttccagctgtcttgaaatatgcacgagattgagatttgctgtagtcaccctactgtgtaacaggacaccagaacttactctttctgtcttactgaagctccacaaatgttctttttctgttccaggttctaatctggggtaccgcactgcatttaatacattattattattattatttaaattaacacagaggttgccccgtggactagcagtggatggaaaaagaaaggggcatagagaagtatccagaacaaagtcctcaggtggcctgtgagggaggaagccccagggtggtcacggggcacacctggcctctctgacccacagtctcagcacagcgtatgcaaagtgcagaggaaagacaccggtttgctggtagctttaacagttgacttgcccagcgcttgaggaagttgcatttccctttctgtaaaagtcaatgttgtgaacccagtaacttgtgtgaattgctctgaaaaggttcagcctccgggtgcctggtgggaatcctgcgctctgccagccagcaggccctggccctctgcaccctcctttggagttcctggcttgtcccgagtgacgagtccggggtgggtgaccagtggctcttcctctccccgcccctccgtcccttccccccggagctggaaaggtgtgtgggtggggagtgatagcaatgaacagtgaacttggtgccaactggggtggtcgaatattcacccgagtccacgtggagagccctcgtggcgaagggagcgccctgcaagctgcagaactcaggttttgtcccttcaaacagcagccggagccaatagctgcagcttggagaagagcttggagtcacctgagcctagggctggtttcaggctaggtggtcaaatgacttctcagaccctcagttttcgcatcagggaaatgggccacagttctagctccagggtgcctggtcccccagggcggcctcagaataggcttggctcctgtggggcactgcccgccacttcccctcaatgtgcccttctccatcagcggaccccaccttcccttcctgcctcatcgccccacatcctcccacccagggactcccacacaggcccttgcctgggggagcctctgggtcctggctcaagcaatctccccccacctggagttccctctttagggcgcacgtttcaagagccagctccaatgctagcttgcaggcccccagctctccatctcggtaaccctgaggtcctctctgtagattcccccgttgcctcaatcacttcctgtctctgttatgatctcccatgatgaagtcatgcctccctctctgcaaagggtataaactccagggaccagctgtctcttgcatcctgggatcaccagcacctggtactgtgcctggcacacagcaggcactcattaaatgctctgcttagaattgaagtgcactgaattcttggaaccctcaagttcttggagaacagcctctgggcccgccccgtggacaggaagtgagcctcccagcacagagggcccccaggtctcctgctggagcctccacgcagggggcctgtggggatggccagggctcagcccagcacctgagcgcccctcccaccagctgctctgccagaccgcatgctccgccccctgcaaacgaccgtggggagagcagcttgagtaagttccccttccgtttcctcctgccccaccaccgctgctcctcagcaggcgcctcaccagcctccacaccccttgcgcccgcagaaacgcgcctggccctgagctgtcaccaccgacactctccaggctccggacacgatgcaggccatcaagtgtgtggtggtgggagatgggtaggtacctggctggacttcctcacagcccccaactgggatgccctgagatccttccgccctggtgcccctggggaagcccctggccctgcagaactaggcgtccctggaaggcagcttggaggggacgcttccttctccgagggcccacagggagcacccgggggtgggctgaggggagcttcaccctcttcagccccaccccaccccagaagccatctcggtggagggtgcaggactatgggtgagagtgcccagggctcctcacctgcaccccaaaagctgggggcaggtctcccacggaggcaagcctcagtctttactctgtggatgcaggagggaagtgggaaacctgaaattcagcctttgtccccaggctgacctgggctgtcgtcactggcttggtgccgctgtgtggccttgggcaagtcacagcacctctctgaacctcagcttattcatctgggaggaggcctatgccctggggatgctgtggggtcgcttgagataagctgagtggctgtcttgcttgtagtatgtgccttctagcaccccctccactttctctcccctcccctcagcctaccgggttggggaggatgtgtgggggatgtgggtgaggagcagaagaggcaaggggacattgagagacagagagggaaggaggaggctaaaggatgggagggtgattgtggggtcggcaggggaggggcaggctgggctgagacccttctcagttgtcagatcccagtgacttcaggctgtcttgtcccctgggggcctcagtttcctcatctgtaaaatgacaggtccaggccaggtgcagtggctcatgcctgtagtcctagcattttgagaggccaagatgggaggattgcttgaggccaggagcttgagaccagcctaagcatcatagcgagaacctatgtctataaaaaaatttttttaagccaggagtggtggcatatgcgcctgcagtcccagctactggggaggctgaggtgggagaatcgcctgagcccgggagtttgaggctgcagtgagctataatggtgccactgcagtcggcctgggtgacagagcaagacgctgtctcttaaaaaaacacaaaataaaaggacaggtccaatttgtcaatctgtcatgcctgccagcagccacatcttagggtccagcctacaggctcaccctggggcatgttctagctggaagggggcctcctgtccagccttcccattctacagaggagcagcccaaggctttgagagactcagctctcctggcctgggccctgtggccccgactttggctgtgacccatctaggtgggggcgggcccatttgtccaccagcctcagctgattctgatgcatggctccttatctgccctcgcctgccccagccctgttcacttctgctttgtatctgatcggaggaggggcgggcggaagtcaagggttaacgttccagtcattcaaaattacctcggtggcaggcccaggggagggcgatggtaggaggagaggatgagctgtcttctctgagcaggaagtgacaaaaccacgcagggcaggggaaggcccagagctgtcccttggcctctgggcttcggctgagctacctgcacccgctcccagcctcgcatgctgagggtggaggaggcgcgcgttatcacttccttcctatgtaccagctctggggttaatctagccttctctatttatcctctcaccaaacctaataggtccattttacaggtgggaaaatgaaagttcagggaagctaagtaatttgcccaaagcctcacaggatttgaacccagaccactctgactcaaaccctgacctggtaactgctctgctccacgggggaggtgagagggaagagcagggtcaggtcttccctagcagccatcggctgctgccatgcatcaggccctgtgctcagtgctttgataggcctcgttggatttactcctcagcacactcctatgaggatgggctcatctctattttctagatggagaaactgaggcagaggcaggttaagtgacttgtccaagatcataccactggtaggtggtacagctgggatttgaagcccaggtcaggcgtcgggggcccctcggcattgcctgggtctgctgggcaccctctgtcccacatcactggcccctggagaagcctgtgggaaaagcggattgccagctctgcgcacacctgtggatcagaatctctggggctggaccctgaagtctccactttaacaaacatccacatgacttgcaggctctcgggtgtgagaacacagacagggggcatctcacatggggagacggaggcccagagggctaggctgggtggatgctgaggtctttgcagaggaccaggcagaaacctccccacgtctccggcagagcccatgaccgccgccctcttgcacttcctgtctttcagggccgtgggcaagacctgccttctcatcagctacaccaccaacgcctttcccggagagtacatccccaccgtgtgagttcctggggatatgtggggtggtgggaggaggggagagaccgtcaccaagtcgacccccctttcaggcacttcctgtgggccagaccctgtgtgggcacccacagcctccagcccagtggagctgcctgacagtccagccaagaaggcagcactggcgctgagaggtgctgggggctcccagaacccgggatggggtatggaggaaggggtagaagggaggaggggtggcctttaggctgggcctccaagcaaagggacgtggaggagaaggctggctcaggcaagagcaggagctgggagaggagcttctgcggaagcaggctgctggaggaggtgatccagagagcctgactccaaggaacagggacacctggggacaaggcatgctgaggggtggaacagagctgtctgcaggcctgggaggccctgcgctctattgcaggatgcggaggcagggctgtcatcggacgtggagggagcgtgttggtgtcagactcaggagggaaggatgactggggaggcaccagcccctccctggccagccctcaggggtccccatcactcctaggacatttccccgactccctagcatggcactcaaggctcctgatggccttcactcaacctcccacctggccttattacccattactttgcttcacactctgcctcctccggaccctactgttcgccacaagctccctgcacatttctaccccagggcctttgctcaagctgttctctctccccatagtgctttttctccccacatccacctgtctaaagcctccaggcgcagctccagtgccccctcctccgggaagcctttctgatctaccacgaaggggtctccactccccagagtgactttatctgatctctcccatgactatgagcctgtggagggcagggagccatggccagctctttgtgggtctcccattatctcagcacagtgtcttctacatggtatgacacatgcattaccttacacacaacacatgtgttttgagttgacctgacttggacatcgtggaaggaccacaggaagatcgatcatagccaccatctagcaaaggcctgccacatgctggcccctgcgcaagatgtcacacatgtgtgatctcatttgatccccctgggagatggctattagcatgcacaggacacccatggggaagctgagcctcacagccactaagaggcttgcctcccaggcttacacggtcctgtccagcttcagagccaaggtccatgcagaacctcgctggggccctcatttcttgatcttaatgaacccccctttcaggggcagggatcaggctctcctaggaagaggagggcaggcagaagggagaagagagcctggagccgagatgcttccaacccaccccagaggattcctcactacccaacccccaaccccagacttgggtgggctgggctctctctgctgctgtctctccccgggacactctgctcagctgccttagatgccctggcccaggctagaggaaggcaggcagccaggagagggcagggaaaccctagcagagagcctagaaagccgcttttgccccagctcggtcctgatgctggtgagtgcccctctctggtcctgtccttatatacaaaatgggaacaaggattcctgcccactcaccatcaactatcaaacgtttatcaggtgcctctaagtgccaagggagggctggctgcaaacctgagcagggagggagaattaggtgaggcagctcctgctcaaggccatggtcaccagcagtgtgttgtcactgcctctgtccctgggtctctggatgctggcttgagaccttgtcccgcctttgtgcatcttggctgagttgaaggacccacttgctgaaggaccttggaccaatcacttcccctctctgagcctcaatctccttttctataagaggtagaggcttggaagtcccaagctccttccccaggcacctcccttgtacgttgagatggatggctgaggctgctgaggccaggttatggccaggtgctctcagcagcctggaggtccctgatccctggtggcccctagtggactttgttgtcctggacaacatcacagaagctggagaaataggcccgaccagatctaccttcccaagtctctccgaaggattgggtgaaggtatcccagtagggccagctctatgcgtgtggccacctatccaattgcacagggccccatgctcagaagggtcctgcaccttgtttaatactctgatgtctacatcttgaaattcttaatcatttttgagcatgggccctgtacttccattttgcactgggtcttgcaagttctgtggtgaatcctgcctcacaccctcatatggcttcaggcacaaagtttctcagccccagacgagaccccagagcgggatcctgctactgccaatgcctgtgcccctgtgaagggagggtaaaatagtcacactgggcccttgacattggagggggaagagggagagaaggtgggttgggaaaaacaggcagccccaaatctctggcacctgagattaaggtggagagagcttctgggctgaggatggtaggtttgctgggggttggggaggcccctgctgcagatacaagatcagataagcctgagagctggctccccatgctgccagccatgaggggttaacagcaaagggatggacctgaaccttcggaactgacaccttcctgagcagccaatcagttgccaggactcgtggggctgcaccgtgattggctcttgccgcctgctctgttgtatagaccctatattggagccggcagggccctgtgagttctttgcatcaaatcccccgtttcgcagatggggagcctgagtctgctctgtggatggccccgtgctaggtgttggggatacagaaacatggcaggaagacagtgccctcgtgtgcctgtggcatagaggggcgcccccttacacctcacctcgttagaaccaagctcgacggaagccctggtgagcttttaaaactgaaagttaggctgggcgccgtggctcatgcctgtaatcccagcactttgggaggctgaggcaggcagatcgcttgagcccatgagttcgagaccagcctgggcaacatggagcagaaaccccatctctacaaaaaatacaaaaattagccgggcatggtggtgcatgcctgtagtcccagcgactcgggagactgaggtgggaggatcgcttgagcctaggagggtgcggctgcattgagctgtgattgtgctactgcactccagcctgggcaacaaagtgagaccctgtctcaaaaaataaaataaaataaaaagagcctcccaaaaaacaactgaaagttaacctggcctaaatctctcctgtggctcccttcacacttaaaactcatcttaatgcgcaaaccgtgaacaacagcccccgtctccccagcctcatttaccacaccccttacccacttcactccaagtacacagactgccttgatgatctctgcctcccccgaacctcttcactcccctttatgacacccagaaccctccctgcttcctgtcattcagttccctgcttaaacatcgcctccttgaccccctgtctacagcagccccccgtctccaacctgccctctccatcccaccaccctgcttggctgtcttcataggccccccgacagcccgacttcatcttgctgctcctttgctgccactcctcctcttggatggaagctccctgaggacggggcccttatctgcctcactccctgccatcgcgccagtttctagaacagagctgagcccattcctgttgctccgtcatgactgcctccccgaccccggggaggaaggcagggctcagctctgcatggaagaatgtgtgctgctaattgaggttgaatcatttggcacttaattttcactttcatttgaaatcctctcttcggtaaactggcgaatccagcctgggattccagtggacaggatgacatcagcctccctagctgtgtgcgccaggccccaccaggttctgcctggcctctcggcagccccatccctgctcctgccgctgtgtgtgtgggtgcctcatgatgtccagtggctcaagcctctgccttagctcaggcaccccttctgttgggtattctgttccctcctgctccacctctccctgccccgtgacacctccagctgccttcatctttcaaccaatagcacggtaagggcctcccctcctggctgatgtgccagtttccccctctgttcccctctggcccctccctaagacttctccaagagggtccctccctccctccctccttccctccctcccttcctccctcccttcctcccttccttccttccttcctgacggagtctcgctgtgtcaccaggctggagtgcagtggtgcgatctcggctcactgcaacctctgcctcccgggttcaagcgattctgctgcctcagcctcccaagtagctgggactacaggcatgcaccaccacacccagctaagttttgtatttttggtagagacagggtttcaccatgttggccaggatggtctcgatctcttgacctggtgatccacctgcctcagcctcccaaagtgctgggattacaggcgtgagccaccgtgcccagctgggaccttttctaaatgcaaatctgatctcatcacctctgcctggcttggccccttgctggttccccattgccctgagaaccaagacctgactggtccgtgcccctatgacatcaatcctttctcacccccaagtcactagccatgcgtgccctgtggtctctgggttccttgaatgcaccatccttcctccgtgggggtgggcttcggtggtggtcaggtgatacctgggtgctggggccccttccacctgccccattcccctcctccactccattctagggccaggcctcagagttctacaggcactagatgaaaacatggtctctgctctctccaactccatttccagccatgaaatagcagcgatgcttaccatgtgggcctttctgaattgggtaacaggatctagccttgctctgccacccactggctgggagatcttgggcaagtcccttcctctctgtaagcctcaatttcttcatccggaaaatggggtgagggttgcccatggtggtctgtgcataaggttcctctctggtcctggctgcctgtgggtctcttaagtaagggggaccctcaggggtgtcacaccattgacacattcctgcacctgtccctctggtcctctggggaggggccctgtggcaggggcatttggggacatggaaaatgagactgcttagcttctcagcatctcccagtggggtggcttgaacatcctctgtttttttggattctcctaatggctccaagaaataggtattttcccctccacattaaagagattgaggctcagagaagttaggtcactcacccagggtcacacagccaggatgtcctggcttcccaaggaactctgtgttcccgcccaacaagaaaggtccttgacctcttcaggcctcagtttcctcatctgtctaatgggggtaacttaagatccttttgtcttggatcacatgagacttcaagacctaacatacaaagaccctcagccccctgcctggcctcagagaaggtggctgttgcttctcaaggtcccagctctttccccatcaccgtggccctgagattccagggatgacccagaggagacaggtgaatcttgtggggcttcttggcactagcactgtggctggacattagaggagagagtgtccaagcatttcccaaaagtgtgtttctggtcaaaactggaaaaacaacacaggtgtggcttttcccatcatgcctcactgtgtctccctggacagcgccttcttcctgaaatcccacagcagtgtaggtggtacccagagtaggtgcacgccagcacctgctgtgcaccagaccgcgggctggccccagggtgcagcggcaaacaaatgaggcttagtgcctgccacctgggatgctgagttccccaaggagtgctggtttaggtggggtggtagccccgacatggctggaagtcaggaaaggcttcttggaggaggtgacattgagcaggggctggagggatgagtaaaagtcagccagcctggcagtggggaggaagagaagggagagaggaaggagagtgggaagtcaggggccactgtttgcaggcactttccagacaggcgggaacagggccgtttgaggaactgagaggtaaccaggaattctgtccagggctggacaggcaaagtgtattaaaaaggctgggctgcccactttttgggggtgtgggggactcctctcaggagaggtgtcttttgtgttactctgaagtgttagcgcttctgcagcctaacattgagtagcgttctctgaggacttcctggaggaggtggtttaattcccttccacctgcattcactgggtgacaggcctgagactgtggagaataagcaggcatcggcctggcccacacagaacccacagcccttgaaggggtggagactcaccaagtgcctgctcgtggtccaggcaaagtagtcacctgagagagggaaccatgggctctttacaggtagaggacgacgaagctccgccagagaggaggacttgtctgggcagggttttgaagcatgaatagaagttgggagtgaaatggggctggaagcgtattccagagggagatacagacaggatcaaaggcttggagggctgggcagcctggagggtgtgggggccagagaccaggttggtgagaacatatggacagctaaggtgggaaggacattctgggcaggggctttgtgtggaccagcacagggaggtgggcagtgtgagcctttcccgggaaacggcttggctggtgtgcgaggggaggagtaggaggagaagtcagaggagccggaggtctcagtggaccaggtcagggcctgtgtgggggaccacagcgggaaaagtgacagtgattccctaaccctcaggggcaggcggtgagggcattcccggaggcacagctgtggcctggggcagtgagcactggtcgtggtcactggtttctggtttcttacctagttgggtcactcactggctgtgtggccttgggcaagtcactgcatctctctgagccaagttttcccttccacagcgtgggtagccagcaccttcctcgcggggatgtgtgtagcaagaactggcttgcaaaacctcccctattccgagcttggagccctgggatggccctcccagcattcgttgggcttccccgtctctgatatttgtcaggcccctcaccccgtgtctggccttccgccagctgtgggggcaggatcaggcatgtactccttggtggccccagcgctggctctgcacccgatgcatagtaggtgcctagcaagtgcatctggaggctcgttcgatggccctgcagggctctctgggtctggcgggagacattgggagtcaaggtcagtgcctcacaccatctcctcggcagcatgtgtctttctaccgtttgccgtggcccttcccatggccagtgactaacagctttcacgcacactctggggtgggctgaaaggccccggaagcagccctctttccctggaagatgggagatgaatgacagcaccctagcttcctgccttctctggggacgccctgagcacggtccgttctgtctcccaggtggccccagcaggactgagagcagcagcagtccacagccatgacaactcaaccacctgccctgtgtcagctgctgtcccctcctttattcctccccactccccttctgcagcatcctggagtcacttcccgaataaacccctcacatcacctccttgtctcagggtttgcttctggggggacccagcctgagacgggatgaacattcattcgacaaaatattgcggctgggcgcagtggctcacgcctgtaatcctagcactttgagaggccgaggcgggcggatcacttaagttcaggggttcgagaccagcctggtcaacatggtgaaaccctgtttctactaaaaatacaaaaattagctgggcgtggtggtgcatgcctgtaatcccagctacttgggaggccgaggcaggagaatcacttgaacccagggggcagagtttgcagtgggccgagatggtgccactgcactccagcctgggcgacagagcgtgattccatttcaaaaaacaaacaaacaaacaaaaaacaacaaaaagcaaacattgagtggcagcatagggagagaggtaagtttattctcatcaagactgggaggaaaagttacacagcctcaattacctttccaaaggacaggtacgggtaggaaaaggattaagagacaatctttttttcttcttgttaacttgtattacatttttaaaaaatataatgaatcagtaatgaaacaaataaagaaacccaattgcaaatgctgtgtgactttgggccagtcgcagactgtctctaggtctcagcctccgaggaatgacatggagctggaccacaattcccaggttctggggtttgagattgaccttacctccgccttgcctgctccccacaggtttgacaactattcagccaatgtgatggtggacagcaagccagtgaacctggggctgtgggacactgctgggcaggaggactacgaccgtctccggccgctctcctatccacagacggtgtgctgctcccacctgccttgcagtcctgacctttgctgtctctgttccctctgcttgggatgcccttccagccagctcagcctgggaaaccctacctctccccttaaggcccagctcagggagtctgcctgccttgcatgtcccaggcagagaagggcttcctcttgcactccctcagccctgcattggttcccggtcctcaatgtgcccatcttcccaccccattgcctcctgggctctggcaccccctgtttccagtggtggggcaggtggattctgcacagggccccaggaggcagcccagcatggtgagccctgggagtgctgggggaggggagaggtggaggatgcctgcaggtggctgctgggtcctcgcccttcctccagggtatgcagggaggcggctaaggccggtaatcagatggtggatagtatatggattggagtatggactctagaatcccagatcctcccctcaccagagtgcacgttggcaaactctttaacctctggaagcctcactttccctgtctgaggaatggggctaccagcagtgcttgctgcagagtgacatgtgaggataaccacttcgcagaggccctggcctttagtgagcgtcctaacaaacagcagcctcgtggtagaggcgagaagggtatctctgctctgcccagatcctaagtccccagcattccctggggtgttccaccctcagggagccccaagctccacctctcggtggctgccatggtgggacacctctgggccctcctcactagcaaccctcgcttgctctgtccccaggacgtcttcctcatctgcttctccctcgtcagcccagcctcttatgagaacgtccgcgccaaggtgagctggacagggtgggccttgggggctctggggcaggtaaccctgagggacagagggaggaactggtgactctaggctggtccctggggcagcagaggtcgcatacagagagggtccccagtgtcaaccagggctggcagagggacttgagggggtaagattcagaggacctggggtggggggtgctgcgatagttagctatacccccactttccatggctgcattctcctcctccccacacaacctcatgtccgcctccgattgtcacataacctcatgtttgcttcttatgtctgcacaaaacctcgcctcctcctttcctacaatcatgcgccccctccttcctgcacaacgtcgtggcctcccctccctgtgccacctcacgtctctctctcctcaccgtcgtgcccacctctgatcttctggcaacttgctgcctctcctctccctacaccctcacactccctctgatccccgcacagcctcgcgccccctcttgacccatacaaccttgtgtccccccacccacctgcccagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattggtatgggcctcgggctcagaggggggatctggctgcgggggaggccctgacttggcctcgtggtgtgattgtaaacacgggctgcagggccaggctgtgcagtttgaactcagctgtgctgtgcacttgctgtgtgaccttgggcgagtcacgtagcctctctctgcctgtgtttccttatcagaaaagcatgggatagtgatagctcctgcctcctggggtggttgggggaattcagtaacttattccaggtggagctgccagggcagcacctgtgtgtgagaagcactctgtgttagtagtagtcgtcctagtagtatgagtagtatctattaatagatactgaaaataaggaggtgtgctttgagcagacagaagcagagattgagtgggggtgctgtggttgcttggaggacaagtggcaagtcaaacttgggtgttctgggaaggcttcctggaggaggtggcgctgcattagatctaaagggtgacacatttccttccaccaccttctctcctccctttccccactccctttggtttctcagctcgacccctctttgcctccaaatcactgggctggagaaatatagtaacttctcaaggtcacccagctagtaggtggcccagccagatttgaaggaaggacagcaaattattggctcactgctggggggtgcttctttgtagtggctcagggctgcctgcatcagggaggcgatgaccatgggtctggcttcatgcatggtacccaggcctgctggctgttcctgtccctgtccctggtaggtcccaatgtgtctgtagctcagggatccttgcccaaaagcccaaaaccaccagctgggtttggtcatatgagctgtgccctctgcctcaccacaggactctgcaggcccagggtttggcccccaaattgaatccactagacctcctcccgccccaccgccccagccccgccccacctccccctgccggaactgggagggccctggggactcacatctcttcacaggaagagaaaccgcagccaccacctccctccttctgtgactagcgtggtgacacagccatcttccccgggggcctcagactatggctcacaccctggctcccttcccctgtcctagggccacagctccccagcctgcaagtctttccttttaaatatcaaggattcatccctgccttctctttctgaccaaccagcacccctccaacccctgcccctggactccttctattcagggtgcagctctccagcctgtggcctggctgtcactgacctctcccttgtaaagcacatgctttgggatcatgtggagggtgctggaggcctggattctggtcctggctctgatactgattggctgtgtgaccttgggttagtggctgcccctctctgggcctcagtctccctctccacataagctgacctggacaatccccaaaggccctctctcctccataaggtggtgactcagagttcttgccttggcctctagccagtctttcctggctgaccctgcatggagctggggcaggggcagtgattttaactgtgcctcagaccagcttaggcctagggggagtcctggggggactggcagggatagtgagggaagcagcaactgcctctgcccacctggactccccagccctgggatgacaagttttgggggcagccctgagcccagctgataatcacagctgatgtggactgagcacttcctgggagccacttcattctcacagcagctatgacgaagagctcttgtcaccttcactttacagagaggaaacaggctcggggggacatgttgctggcttaaggccacccagccaggattctgacaggggtggactggctccctaagccacaaagctgagggccatctgtcctccctgcacctccactgcccccaccgccccctcaccctccttgccctctctgtagctcccctgccccctgcctcagcttgatgagccatcgcatggcaatgagtcctagacagatgggagactgaggcccggagagggggaactgactaaagtcctagagcagtgagaggccgagccaaagtgagccctggccccccagctcaggacccttgtcctgggtgagtgggtggctgggtgccagggaaaaggcagttggtggatgtgggggaagtggacgcagatgtggtcccttataaggagacagtggccaagtgcccagtgacacctcctcaacacagggggctgtggtgaccagactccgggctgagcccagggcaccctgctcttgccagccaagccccatgacaaccactgcccatgatccctggtgggcgtatatgcctccaggtagaggggagacgcccagcatgtgactcagagcgagtgacatcctctctgagcctcaggctcctcgtccctgccccacccttcctttctccccagcacctggcctcagtgggctcccctgttccaggggctgcccctcctgccatcccgacttctccccccagctctgtgccttcgggccttggcttccccactctgggcctgtttcctggtctgtgaaatgggaactcaccccggtgttgttggaagcacccagctcagtgcctggcacagggtaggtggtgaccagcgtccatccccttccatcctgccacagagaagcaagcgggctttggcggagggcccagagttcccctcccctcccttctccttcctcttggttctgacatcggcccccaggcctgcatagcatctcggcagaaggggttttgtggtttttcacttcagggaaactgtgcagcttgaaatggacatgggaagtcacacggactctttgcagaatgtcatggaacgccgtccctgggggtgggaactaggcctgcctttctcctcatctgtgccccgggctctagccctgaggggtcttcatgtgggagaaggctgggcctcccatggcaggacagaggagctctccaatgccactcctcccagaaggcccccagctgggcccaggttgagggaatacatccagcgtgtgagtttggatgagtcgcatactctccaggagcctcagtttccttgtctgtaagacagggacggtgctaaggaaggggctgatgatgttgggaagttcctggggagggggccctgagggcttcaggcctcctggggattatttgcaaccctgggagaatcctggagggatgggcaagacaattttctagaaggtgaggctcccagagatttggtcactgatgcttgagccctttccttcacagaaaagcatcaaaattcccgccctccttccacggactaagggctatgtgtccaagaaagacacagacctgccctggaggccttagtctctcactgagttcacgctcgctattacagacatgaggaaactgaggcacggtgacgttaaactccttgctcctggtgacacagcctccaggtgaccccactgggactggatggcggcccccagagcctggtgttcagttgtatggcttgggagggggtgtacggcatggaggggtgtatggcgtgggagggggtgtatggggtgggaggggttgtatggcataggaggggtgtatggcgtgggaggggtgtatggtgtgggaggcgtgggaggggtatatggcgtgggaggcatgggaaggggtgtatggcgtgggagggggtgtatggcgtgggaggggtgtatggcatgggaggcgtgggagggatgtatggcgtgggagggggtgtatggcgtgggagggnnnnnnnnnnnnnnnnnnnnggcgtgggaggggtgtatggcgtgggagggtgtatggcgtgggaggggtatatggcgtgggaggggtgtatggcgtgggaggggtgtatggcgtgggaggcgtgggaggggtgtatggcatgggagggtgtatggcgtgggaggggtgtatggcgtgggaggagtgtatggcgtgggaggggtgtatggcgtgggagggagggtgtatggcgtgggaggggtgtatggcgtgggaagggtgtatggcacgggagggtgtatggcgtgggaggggtgtatggcgtgggaggggtgtatggcgtggaaggggttgtatggcataggagacatgttggcccagaaccccccccgccacttaggccttggctctcctgtccatctccccaaccagactcggtgaaatacctggagtgctcagctctcacccagagaggcctgaaaaccgtgttcgacgaggccatccgggccgtgctgtgccctcagcccacgcggcagcagaagcgcgcctgcagcctcctctaggggtaagagtcccccactctagtgcccaactcccatacacagcaggccctggctgagcagtggcctttggttcactgtgagtggcatttaggccaggacagaaagaaggtgggtatggaggttgcctcagtttccgcagcctacttgtcatctgcctgggccagtctcactctctggagctcatcttccagaggcaaggcccaaggtatgaatgaatgcctggtaaccccccacccccgggccagggagtgggtgtcacggagccccactctgcccattcctgcaggaggtgatggaaaagatgccttggtccctggccctaggagagcccagtcgagccagggagatcctgcacccacatatgtgggtggaggtgggagagcctgagctatgatccccagggggcagatggtggggtcagtgagttggaggcagcccacaaggcctcctggaggtgtgggaccagaaggacagagaggactggtgaggtggggagagcagcattggcagtcctggtgggagtcaaaccttgagcaaagacctggaggtgggaatgagctgtgagccaggaaggcgagagctgtggattctgcatgtccccaaattctctttccctgcttatcttccttccaggttgcaccccagcgctcccacctagatgggtctgatcctccaggatccccacccaaagcctgatggcaccccggctggccatgctgtcccctccctgtggcgtttcttagcagatggctgcagagcttcgttgatggtcttttctgtactggaggcctcctgaggccaggaacgtgcaaatttgcaggtgctgcatcccaagcccctcatgctcctgccttcctgagggccagaggggagccccaggacccattaagccacccccgtgttcctgccgtcagtgccaactgccgcatgtggaagcatctacccgttcactccagtcccaccccacgcctgactcccctctggaaactgcaggccagatggttgctgccacaacttgtgtaccttcagggatggggctcttactccctcctgaggccagctgctctaatatcgatggtcctgcttgccagagagttcctctacccagcaaaaatgagtgtctcagaagtgtgctcctctggcctcagttctcctcttttggaacaacataaaacaaatttaattttctacgcctctggggatatctgctcagccaatggaaaatctgggttcaaccagcccctgccatttcttaagactttctgctgcactcacaggatcctgagctgcacttacctgtgagagtcttcaaacttttaaaccttgccagtcaggacttttgctattgcaaatagaaaacccaactcaacctgcttaagcagaaaataaatttattgattcaagtttggagatatcgtgatttcaggtgcagcttgatcaagggattcaaatgatgtcatcgaggcttgtttagctctgggctctgccttctgctggctggttcattctcaggcaggcgacttagggcttcatcctcccaagttcaagttcagggttcatccttccaagttcaagttcagggcctcatccttccaagttcaagttcagccaaaaagagcaaatgtctatcccaggcaaagttctaactaagatttactgtgattggaccagcttaggtcctgggcccccttttaaccaatcatatttgtcagagtggtgcagtgctgtgctctgactggccaggcatggaccatatgccatgctggaacagaactgtggcaaccccagcgaaagtgtgtgtactgggggggagggtgagttccaaagtgggctgagagcctggtgggaatttgggaatttgggcgagaaaccctcaacctccactactggaggtcatgggaaagtgttcatttcagcagtgacatgaaacaatgctggaccccgaaggtgataagcaaaggggagtttctttaaaagagaggcggggttgttgtgaggatttaagaagttccgacatgggcacaacagtgcctgcacagtcagtcccacctcaggacttgctaagttctgtggaggtgccagacctccccctcctgcggacaattactctcctctatctcaacttctcactcattcatcaaacacacatttattgagcacctcttctgtgcctggcactgttctaggtgccagggatccagcagtgctcagaagtccctgccctcaggaggctgacactctagagaggctaagagatctaagaggctgcccctgacaacccagaagaccccaatttccagcccatgaaatgcttgagtttccacattgtgctttcccagagctcccagccaaccccactatccccattagtccccatgttctgaggcaggaccccctccagctcactcacctcctgggagccccccttaaaagggattaggtgcagaggggaaacccctttgcttttcttagtttcagctcagacaaagtcatgatgttttcaaagttacttctcttctgaaacagaaaggaaatactaaaccccacccatccatggcaccatacagatgcaggcggccaggaccccactccctagtatgttcgatgtctaagatccctgaggcaccccctgaggttggccagagtctgagggagcctctttctgctccctcctcttcacagagccttgggataaactccagagcctccgcaacaaaccatggccctgaaggtctggccatcctctgcctcccactcttattgcactcgtgcctctaccatcagactggactgtcatttcttccactccacattcatgcttctttcattccaggcctttgaacatactggacccctttcctttgctcctggaacttccctgcagggcaaaggtgggcccggatctccttccatgtgtgttcagcccgttaggtcgaccccagtagagacaatctttgcttctatacgataataatgtcagtaaataacttcctttactcattgtcttggctcccatgcacatattatctcatttaatgttctaatagccttccaagataggtactcttagccacggtttgcagaagaggagatgaggatgcgggagggcacaggtttggctcaaattgacaaggcagacactgtcctttcccaccctctccctctgttcccaccctccttgctaacagaatcctagttttgtgcatagcagcaccgtacctaacaccgacaaaatacttgtttttccagctggttttgtcgctggggttttcaggccacatagttctggccgagaagccgatgtgaatgaaagtcagcgggagagatggcttctgtgaaagttgttttcttccttaaaaaaatgacaggcccaggccgggcgaggtggctcacgcctgtaatcccagcactttgggaggccgaggcgggcggatcacgaggtcaggagatcgagatcatcctggctaacacggtgaaaccccgtctctactaaaaaatacaaaaaaatagccgggtgtggtggtgggcgcctgtagtcccagctacgcgggaggctgaggcaggagaattgtgtgaacccgggaggcggagcttgcagtgagccgagattgcgccactgcactccagcctgggtgacagagcaagactcaaaacaaaaaaaaaaaaaaaaaaatgacaggtgggatgtctggagctgcagcagccgtcttgtgagctcgaagccacaaacatgaagatacaaggccccgtgctgagaggggatgagcagaaagataaaaagagcgtgagttcctggcagcagcagtgggcagctgagccaatgctaacagctgccttgttatgggaactgaagaaaatgaaaccacccaattgttaatgtcactgttggtcacaccttttgttacggtaagctgacagcatttgtcactgaagcggtaggactcctagcgcagtgctcttcccactgtataactgttcccagcagccactccaagtggggtgagccacttgtttctgctctgcaaattggctgaggatggaggcccctcatataggaaagagaaagcttatgggaagtcagtgagaacctgttttgaaacaggaagacctgccggttgtgggcaggagctgacaccatggtttgctctttcatgtgacaacaacccctcccaagtgcccacctagtgccaggcctgggctggcagcaggttccatgcctcacttcgccccttcttgcaatgaaatcatggcctggtggttgaggaaagtgcctgccagacaaggccacttcatctggtgctttctattctagagactggctgttccttgtcccttcttcaaagcggaggcctggggtcccccatactcctccgatcctttcaccctggcattcactggccaccaagcttggacaattcagcctctgtctattaaatccaccccttgtccccacggctgctccctaacctaacccctgccatgtctcccctggacagtagccacagcctcctcactggcctcctgtcttccctctctctgcctctactccatttgccaccaggtggcctggggattttcctcgtttacaaacaactgtgcagtcaaaaatgctgatagaaccacagacttattcaatcatcgaatccttcagcaaatagttattgagaccgtgtgtcaagcccaaggcttgggggtgggtcaagcatgagcccgctctcaggagctcacaggccagtggggaggctgtccagccagcagagagccccaggaaatggcccttctgcttggatgtctcctgagcatttcaaactcacacgccccgcccagccttcatcactcagtaaatgcatccaggctctcaaatcaaaaacctgggagtcctccttgacaccttctccctcaccttccacttccaacccatcaccgacaatctcctcagtgccccccttctctgcattgtcatggtttctaatgtccaaaccagcactgtatcctccctgtggtagcctcctgtcatagtcagcaattggtacaataatgctgtgtaacaaaccaaactgccttgaaatccagaggcaagaagcagcaggcctgtattctcacactcactagttgtaggtggacagtgggtctgctgacttaggagggtttggctggtgacttggcttcgggctggggatgggtggtctcggtcctggctgtgggtgtgtgtgggtcggctccacctgtctctcatcctccttagaccagcattccctggggcatgtccttctcattgtggatcacaggagcatgagaagccaagccaaaccatgaggtgtttaaggcctctgctcatgcttcacatggccgagcccaacaccaccaatggggcagggacaggaactcttcccagacttggaggaaaggaaatatttgctgagcaccaactgagcaccaatcctaatgctcacacctcctgactggccttcttgttttcactcttgcccttggccatggtttatctccacggagtggccagagtgatcgcgttaaactaccaatcagatcagaccactcccttgtataacaccgtccagtggtatctctggacatttggcacgaaacctcctccctcacctacaaggcctataggatgttgtcagtttctacctccagatctcacttggcactatcttccctttccttgcaaagctccagccacaagggctgtgatctggtttggctgtgtcccaacacaaatctcctcttgaattgtagttcccataatcccaagggaggaacccagtgggaggtaattgaatcccataatccaggtgggaggaacccagtgggaggtaattgaatcccataatccaggtgggaggaacccagtgggaggtaattgaaccatgggggagggggacgattacctccatgctgttctcgtgatagtacgtgagttctcacaagatctgatggttttataagggttttccccttttgcttggcacttcttcctgccatcatgtgaagaaggatgcgtttgcttccccttctgccataattgtaagtttcctgaggattccccagccatgctaaactgtgaggcaattaaacctctttcctttataaattacccagccttgggtatgtctttacttttattttttattttgttttattttttgagatagagtcttgctctgttgcccaggctggaatgtaatggcatgatctcagctcactgcaacctccacctcccaggttcaagcaattctcctgcctcaacctcctgagtagctgggactacaggcatgtgccaccacacccaggtagtttttgtatttttagtagagacggggttttgtcatgttggccaggctgggggtatgtctttattagcagtgtgagaacagactaatgcaggctgctcccaggattttcactgtgtgccaggccccttctaccttgggacccttgctcaagccgctccttccacacatagcacctactctcccagatcttcctccacaatcaccccacactcaatctcgatcacctcctcctcctgcttctctcttggtgcctctgttgaagaacagtcttcatcactgtttataattgtttattaaataggtgtatttattcaaaaagtgcttcccgtctagactgtaagctcaaacacacagaaggacctgcgtgttttgttttacactaaggccctagtgagtcctggccacctaatccatgcagaatgaatgttatttgtacaaatgagtaagtgggtgaaagaatggactttaatgaaaatagagagactgaaccatgccagcgacccagctgagcccagcctccaaccaccccagccaggtgccagccatgtacaagagctgacctggatgtgccggcctagctgagtctccaggtgactcgcagtcagccaccatcaaagaaaaagaatggcctgaatgagcccagccaacccacagaatcatgagggataataacatggctattgtaagccactacattttggggtggtttgtgacacaggtactgatactgaaaccttgactttttggagtctagactcttcgttatctgctcctccgatctctgacctctcctctctacccaccattcctaccacgctccagagagatactgacatttggggacatctgactccatccagctctcacatgatatgggaggcagagcaggacaggtcccggagagggagaggcagatccaggatatccctagaaggcttccggagaggacctcaaggaaggtaaaatgagcagttttttgcagaatccaaaattcaatcaatacagttcccacctattaactatgtgcttcacaccaagctgtggcaggagctggaggtgcagagaggggtgaggcacagccccttgctcaccagcagctcagaagccagtgggagagacagacgtgtaaatagacatccaccatgtggcttgatccacagatcacagaaatatattcaatacagaaaggaagagactctcgtctcaaggcgctagggtagagatgtttccacccccgcctcctcgctgaaaagcagccacgacaagaaggagaacaagaaacagaaacacaaactcccaccttcaaagaagccaggagacacctgtaaccccaaaccacaatgtatgagcagcaagagcagatggagggtggtaaatgattgaacagagctgaggaaggcaaacctaagtgcctgctgctacatggtggggtggagtaggggctttggagacagaaaagatgcaaatcacctggtcttgcagaaccctggggaggcttagaattagggaacccagacatcatggatggtgaggcaggaggctgaaaacaggggttgtgtggaagtctgcttaggaggagtgagatcccccagcaccaccccaggtcttctcttttccattacgtggtcaggcacccacccctccctaaccccagcaaggagtattcagccagagttctctggacccagagacattcgctacagggcagagtgggggtgaggcaccacaatgcttttggagatgtcaattcgatgatgccttgcaaataatcactcctccactcctaccctccctacccatcactcctaccatgctccagagagagattgacacaccctctatgggaggggcgtgtttcccctctcccctgatgctgggcttggccatgtgacttgctgtggctactgggatgacaacctccacctcctgggttcaagcgattctcctgcctcagcctcctgagtagctgggattacaggcatgcgccaccacgccaggctaattttgtatttttagtagagatggggtttctccacgttggtcaggctggtctcgaactcccaccccaggtgatcctcctgccttagcttcccaaagtgctgggattacaggtgtgagccaccatgcccgggcttaatgcctcattctgaaacaggagtggctaacacaggatgactggttgaagaaggctctaatgatagcattgccccaaatgataaatgaaagagacccaatcaaataagtagaagaaaaggaatatcagtaagcaataaagatgatgcagtgagcagaagaaaattttgacaaaaccatcattgccatccttgaagagataaggaaacatatatccacaaatgagtacagaatgccatagcaaagagcaggcagaaatcaggagagagctggttgggctcagtagctcattcctgtaatcccagcaatttgggaggccgaggtggatggattgcttgaggccaggagtttgagactagcctgaccaacatggtgaaaccctgtctctactaaaattacaaaaattagctgggtgtggtggcatgtgcctgtaatcccagctactcaggaggctgaggcagaagaatcacttgaacccaggaggcggaggttgcaatgagctgagattgtgccactgcactccagcctgggtgacagagtgagagagcgagactgtctgtctcaaaaaacacaaacaaacaaacaaaaaaataaaataaaaaacaggagagagctcttggaaatgaaaaataggttgatttaaaaaaagagggactggaagagaaaaacagatttttttaaacctcccaggaagtagaacaaaattataaagatgagcaacaagaagaataaagatttcatccaggagacccaatattcaaatataataggagttacagaaggaaataacagaaaaatgtgtctcagaactgaagaacacaaatcttcagattaaaaggctacttggtgcccccgaagacaaatgaaaaaagaatcaaatcttgttataaaattttcagaaatttaaggataaagcaaagatcctagaagattccagaataataataataaaaaaattagcttaagttacacaatggattgggattaagaattgtgctggaagctggagacaccgacagacgccttccatcagctgagtcagagtcattctcaatctcaaattctatacctagcctacctatcaacatgtgtgagaggggaattcactattttgaaacatgcacaccttctctgaaagttactgggagctatgctacatcaaaatgagagaggaggccaggcgcggtggctcacgcctgtaatcccagcactttgggaggctgaggcaggtggatcacttgagcccaggagttcaagaccagccttggcaacatggcaaaaccccatctctaccgaaaatacaaaaactatctgggtgtggtggcatgcacctgtagtcccagctactcaagaggctgaggtgagaagatcgcttgggcctgggaggcagaggtggcagtgagctgagattgaaccactgcactccagcttgggtgacagagcaagaccctgtctcaaaaacaaaacaaaacaaaacaaaaaaaccccaaggcccccataaaatgagagagtaaaacatcaaaaaggaagacatggaatctaaggaactggattcatacaggaaaaagctgaagggaatccccaaacaacaatggagagagaatctcgggatgtcagctgcgcacaggcccaaggggcagctggcccagataagaggagctcgtcagtctccaggacgaaatcgtccctgaggctggactctggaaactccactgtgtggtttttacgaagctataggaacgtgtggaaatgcttagtccaagaaatcgaagatatttttaaaaaccaaaaaacgaagcaattatgaactcctggctgagcaggaaataatatttacattgcattaatcatgggaacactggatatgcatttaaccgaaactcatattgagaagatggggagaaggggtgagagtgcgtaagaaatgtaaacttctcctgtactgtaagaggagtcagtagataatgggtaaaattgagggattaagacataaaaaaatcaatatgatatttagcgagaaagagcttaactgagggagcaattgccgagcgggtgggattacctgtgggatgggggggtgggagggatgggggaggactgctgttttttgctgttacaaaccttttcagcgctacagtagtccacttagcgcagtttcagttacctgtggtcaaccacagtctaaaaatattaatagattttgaaagaaaaagagacagagaggtcaccatcatataacttctgttatgatatattgttatattgttttattgtatattgtattattaattattgctgttcgtctcttaactgtgcctaatttataagttaaacattatctttctccaccatcgtggtgtgtggttgactccgtttctcgccacagcttctcacaagactttcaggatcaagtgattcctgcacaagaaacaaaagcaaaattgtcccattccccagtggatctgtatgaaaactggtaataacatcaggtacagctccaaaaggagatattggaaagaaccaagctgggtctataaggaattgagcatgagatgctacacatattcatgttgtatcaaggttgtgatcatattaccatagcaagctgaaaatgtcaccactatctggacagctggacatgtttgattgggaaggtactttttctctttgttcatatgctctgcactagtaggctgggttcagtaatacataggtgagatcttttatttaaaaaaaagttatcagcctgtaatccctgctactcgggaggctgaggcaggagaatcgcttgaacctgggaggcggaggttgcagtgagccaagatcgcaccactgcattccagcctgggcaacagcgcgagactccgtctcaaaaaaaagaaaaaaattatcaggctgggcgaggtggctcatgcctacaatgccagtactttgagaagctgaggtgggaggattgcttgag

SEQ ID NO: 1539 - DNA, 833 bp, Homo sapiens
aacaagggtcaccaccgacactctccaggctccggacacgatgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagccctcacccagagaggcctgaaaaccgtgttcgacgaggccatccgggccgtgctgtgccctcagcccacgcggcagcagaagcgcgcctgcagcctcctctaggggttgcaccccagcgctcccacctagatgggtctgatccgccgccgccccaggcccgcgggctgctgacagagatacgcgccgtggtgcgcacggagcccttcacgggacgctacagcctgtgccgggccgggagctgggcagggggaaattagcagtggtgagaaaatgtataaagatagattctgggaaagaatttgctgcaaagttcatg

SEQ ID NO: 1540 - DNA, 579 bp, Homo sapiens
atgcaggccatcaagtgtgtggtggtgggagatggggccgtgggcaagacctgccttctcatcagctacaccaccaacgcctttcccggagagtacatccccaccgtgtttgacaactattcagccaatgtgatggtggacagcaagccagtgaacctggggctgtgggacactgctgggcaggaggactacgaccgtctccggccgctctcctatccacagacggacgtcttcctcatctgcttctccctcgtcagcccagcctcttatgagaacgtccgcgccaagtggttcccagaagtgcggcaccactgccccagcacacccatcatcctggtgggcaccaagctggacctgcgggacgacaaggacaccatcgagaaactgaaggagaagaagctggctcccatcacctacccgcagggcctggcactggccaaggagattgactcggtgaaatacctggagtgctcagccctcacccagagaggcctgaaaaccgtgttcgacgaggccatccgggccgtgctgtgccctcagcccacgcggcagcagaagcgcgcctgcagcctcctctag

SEQ ID NO: 1541 - DNA, 96597 bp, Mus musculus
  misc_feature (419)..(438): "n" at positions 419 thru 438  can be any base
  misc_feature (8061)..(8267): "n" at positions 3061 thru 8267  can be any base
  misc_feature (17660)..(17679): "n" at positions 17660 thru 17679  can be any base
  misc_feature (40373)..(40392): "n" at positions 40373 thru 40392  can be any base
ttaataaaccattggcagtgatttgagtttgttgttaaatatggttgtgttctgatttgccacgggaaggtggtcattggtttttaagagcgtatgatgctggtggaaattcatggagctttaatcactgtctcattaacagggtgtagtccgcttttcatgtttcttcatgtgttacagcttttccagaatgcacagaaccttatgtgcaattaaagtaattagggaagagcagtttttcctctttagcaaagggatcagatttcaaactgccctgctaatttggttaatatgtacttcttttagaaagtaccaaattctgataaattctttgatttttatctcctgagaacatgcctttatttctatcctgacaacagcataaaatctcattatcaaaacaagaataggagaagtannnnnnnnnnnnnnnnnnnncccaagtcttaacattttctccttcccaaatacttagggcatatgaattattttatttagtaactgaaaagtgtgagtcaacagagtgaggggaaggtgcttttatttttctaacaagacaaatgaacacaggaaaactattctgcaaatgtattatacctactgtattagtttaaccggaaagtgcaagcaagctgcttcctgaagagcctgctccagatacctcagtgactgaagtaaaacccatatggtgtatgtgtttaggcttacagtgggtttgcggattctgttgtgctttgataactctttgtgtcgcttatgggagttgttagaaatatgacctttgttcagtctctaatgaaggaggagaaacaaggcatgttctacatttatagaaatcatgtataatgaaaacatttactttaatcatatgacatgatagtgcctgaaaatcttcatatgtaatgtttttgtaggtaccttacactgcttatatactattaacaagaagcaaacattttgtccatccccacgattgtcgatggactgtttattcaagattctaaaattgacaaataattataaaattcaagaattgtacatacttactttacctatttcttttctgagcaaggtggtactttactttgaattagcaagagctggaaactgatgttataaatgacccatgggctggctgacgtaagtggagcaatactgaaccgattttggaggtatagaaaaatgtagattatttttacagcaaaaggcatttcatacttctctacatatccccatcagagagcatcgcagtggggattgaggtatagtgtcttctcaagttactagggaaatttcaacagtaagagtatgctttattgttgagcaaaagctctggtaaatgctttcttggaagcagtgacttgttcaagttcagacttaatacatgaacatgccttatggtccaaggatttatgttagtaaagtgatgcaaacataagaacaatcttcctatgagcacttgcagtctcgctgagaagtcaaaacctgacattgatttaggtcactactcacaaagaaggggcactgagtgaaggaatttatagctcttagcacgtaattatgttggcctgtttcatttgacataaatccttataacacatataataaaattaattcagattgtatctattttatattagaataacaacatttgttgctatttagcatcttgggtctaggtaaattgttaatttcgttgaagccagtctctatttacagtacattgaagcaccacagtgagagtgagttactggtgagtctttgttttctgacatttcttactgaaagcaatcgtatgtgagcttatgacttaaaaaagctctaatttgtataataatctaatatggaataactaatatatgaaatctagattgctattaagatcaaatctatttatcagaagaaatatttttaggattgaaatgatgaattttgcagcagccatgtggcttgtttttatgattttggaacatgaaatattttggtgaaaaatacttcattgatttttatgggaagaagaaaatatttgtgtgtggtatttccttatgagagcagtactaattcatttcttagaatatttccaaataatatatacagataatatatacaaataaattacacagatgattatacagtatacacttttatatgtcatggtttcattgattatattctaatgaaaaatacattttaattataaacaatgcttttatacttttctcataataataactgagcaacatatatagggtaattttcaatagacatagtcctgaaacttttttctaacctagcttaccgtgctagaatttaaaaccaatgtatgaaattgaagagctcgctgttgaaaatcacagagtaggaacccaaatctagttgatagtagtgagaccaattgttacaatttcagagatctcataaaatacagggcagagtaagactggtgcttacagaggtaaaattatattttgggtaggttttaaactatatatgccatttcttcacatgtcatttttataatttatgccacttgagtctgctaaaatgaaatatgcatatttaattatgtacattgtagggctagtcaaagggaagccagagcatcttagtgaagggtctcaaccgcaggtatcactgaagtactaagaactctggaaatcttactcccctgttgatcaacttcatgcttttgaattgtgaagtgacatcattgccactcatctgtagcatcttttaaaacctttacatagaactttcaccaacttcataaaggagcttggtgatgctattcacaaaaagagaagttgaatattaaattttacatttgctgctagttactatgttgaataaacgatttctcctttgagcaggccttatagtcatagtccacgatcagagtatcactggggcctaacagcatcaccaccaggcttccaggcttgattagcagtttggacaggctcatttcacaaggatgaactctggctttttcagtgtttttttttttttcccctgaaaattccagggaggtgattttcccgatttcttgtggaagacttaatagcattaacttcattgttgcctgtgttctggtttctatttatcactttgaaatagtaaatgttacaggcagatcagatatggtaagcgaagctagcaagataatgtctatctaatacatgagtaaagggctgggatctcctcaggaggaacagtaaaatagcatgcagttctctctcctgtcttcttggataacagagggaactgcttcagcgctggctaagtgtcataggaaactgcaaaggaattatactttatattaaagcaaatcttttcacttcacaatcagggaggcatttaaatggggttctattgcctcctattctcttgccagttggtattgctttcacttaattataaagatgaaatcaccagtgtttcaggctgtggaactggagtccatacaatgtaacttgttgaatgcattttgagactagtatctgtgtgtgcttatctgtatctgcatctgtatctatcatccatgtctggctgtctctatctctgtctatcgctatcttctctgtgttccttattcatatgtttatctatctactatctgcctaccacctatgtacagtctggaagcagagattatttgtttcctttggtccagtggagtttcagtactgattatagagaaaaatagcctgtgctcatgggatttctatgccaagactgaaacagtcaatgagataaatgtttctacttctctacttcttctttccgttatttcttctggttgatatatgatgtgatatcatgtacttctcttacaaaaagttcgtactgctctgaggaggggaaaaggttggtcacttttgataaaggtgaaccaatggactgtttggctacaaagctagtgactagtatatgaagtacagccatcattatgataactatcttctcttgatgttaatattttaaaacttattttcttatagacataaattcaacattcacttttttaacataacttttacttttttacagtctagtcattcccccatcctggtcctccctcccacagttcctcatcccattccttctctcccctgtctttaagaggatgttcccaccaccctaacctcctgccaggcctccccactacctgggacctcaagtttctggtgggttatgcacatctcccactgaggtcagaccaggcagtcctctgctctctatatatgttgggcctggggtggggtgggggactcaggccagctggtgtacccacttttaaatcattgcatgcatttaaatatgtattttgtttaaaattttctaatttgaatacagttctgtcattctactctttaacaatggtgtattaagtaacctgtactccttcattatctgtcctgctatagctatttgactgtttagggaacctgtgaacgaatcattattttaaaagcttgtattgacaaacctcaggttctttgtgcgagttagtaagtacagacttttcttggcatcagcatttctgtaatgtgttagaccaggaggccgcattgacagtctctgatagccaagagggtgtgtgattgtaggttagcctttttttttagcagttcttcataacttcagtcatttgcatgtcaccatgattttattgccaacacattagcttggtcttagtcttctaattttttttttaattaaagattgatgtctgtgtaagtcatcacatgacatattacaggctgtacaagctggtgtcagcactctgggcacctattatgcatctccatgccatgtccaggcacaccctgacaagtactgagttcagcagctctgctctaagaagagtgacccttctgaaggttatcaacctttcataccacagcctatcacaaagcacagttgtgactttaagctgggacagtatggctgcagagctctgcagaagcacttagtattattttcaccctgaaatctgttaatatttgggataaatgctgagaaaattattgtgtgaggaatcagtcttgttgatattggcaaccaagaaaaaatgctttggacaaggtcttcctttttgttacctccaaacttacacagtgaaataattcatattttctatttagactaaaactatctaataaatcaaaattgtaatgagaccccacattttaattcctcaatacataacatatcttaatatcaaagtatcagaaaaacatctgtcagatgtcttattgattaccttgggatataattggagttacttacttaagtttgtcttatagcttaaagggctagtaagtgggtagcctaagacattaaggtccttcctaaaggctgtttagttcactgaaagagaattctgcctcatacctggcaggcacatgtttcctgcacactgtgatgcatgccctccctagtcagtgtccagtgccgtcagcttactagaacagaagcaaagaacaactggtaatgcttcctcatgattttctttccctttgtcattttcaacacatttttcttttttttttttttttaagatttatttatttattgtaagtacactgtagctgtcctcagacactccagaagagggagtcagatctcattacggatggttgtgagccaccatgtggttgctgggatttgaactcctgaccttcagaagagcagtcgggtgctcttacccactgagccatctcaccagccccctcaacacatttttctttgtttttcttttattttctctctctttttttgtaatttttactttcttgattatttcatgttgtttcctttttacttcatagaatgtacacatgatttgtgacatcactttaggtgaaattggtttttgtggcagaatttatttggctatagggcatgccatatgattcaaggaaatgcagtggttggaaattgatcagcgagtcacagagaatttgtcctataaatatcagaaagtttgaatcttgttcaaaaatctttaaatttccaaacaagcattttgtttttaaggtaactttatttgcttatagtatattgaaatagtcagaaacatcacagaggcaatttacctgttattaatcatcttagaagtagattaatttcacatgataattattaaaaaaaacccttagtttcagagataaatgttgtgaaaaattcttataatttgtatatcactcatacatacagttttcttttcctctcctctcctctcctctcctctcctctcctctcctctcctctcctctcctctcctctcctctcctctctctttttcttctttgttcctcctcatcctcctcgtcctccttgtcctcctcctccttctccttctctgtctccttgtttatgatacagttttcattatatagctccaactggcttggaattcactctgtagcttaacctggcctcagactcttggaagtcttcttactttagtcccctaagtctgagggcgcatacactgttaaatattatctcagattctctctgcttttagggccagacactgttactagtcaaagttacattctgagaattcaatgttgcaaatcctttgcagtattacctcaagcagagcaatttcatgaaattaattaccaaatgtgtacagattgatgtccattctccctattcactctcttacccgcctaatcataaacatgctgattatcatctctgcctatgttcatagtgatcaatttacagacatgtttataattttctagttgtaacttttgaataacatctcttatatggaatgaaaataaaatagacaaaagtatgagctacaggcaaaattttaattaatatatgcttcatatatctggttttttatcaatatgaattaaatcacacatatgttaaacatataataatatctgttgtgttttaagatctagggtttaggagaaattgataatataccttgctgtcagggagatggtaattttaggcagaaggacctaaagtgagaaacatatttatgggatggaattgtggtgtgttgttgctcatggttggtccagctttacagagaagatggtatctgaatagcaattaaaaacaagaatggatttgccaggttgcatggcttcagggtattcagccagattgagtgatagtgtgtatgtagtatgctcctggggttccagtagtctgttttgggcagaatctatgatagttcatctctgtaaacatagggatatgggatcagaagctaaagaatgatgtgtgttggttcattcatggagaaaggcctctttacagtggcctcttcaacacttgtgaggactgagaaccaactgctgtttgatagagaatgggcgcctctaggtctagaaaaggaaaggggtcttgagaaggaaccagtcaaggtggacgcttgtagacgtttcctgctggggataactgccacagaagatacagacagacaagcaggaagtccagggggaactcctacccaagggtgacgtttgaacaaaggaataaatgtgatatatgagaccgccaaccagtgagagtgagggaatcatggaagaggagagaaatgaggtagagaagacttggaggatgctgtgtaagagagggaaccatttaatgcttgcctagagactgctgggcaaaggagggcttgcatgaccctgggatttgtagtatgtatttgattccagtcacatgtgattacatgggtatatggatgtccgtgtgtatgttacttttgtgtcctcagtaatctgagtcctgctgtagtaaacaatcatttatacacctatgcttttgggacagctttctcgcgtttgttgttgttgttttgtttatttgtttatttttgtctgttttttgtttgtttgtttgtttatcactgttctcaggatactgagatgatgtatgttgtttctgcccctggaaacgtggtttagtggctccaatgtgtaaggaaataaacatgcaggacagggatggagatgtggaggcaatgcaaaaatggtgatattagtgtgtaagcgaacagagatgtgtcannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttttttttaaaaaaaaaaaaaagagagagagactaatcgctgtgtgttggtggtggtttgtacaagttagaagccttactttcctcacagcgttcaaaaggaaaacaaaccaaaaacatacatgcttttattttttgtaaccagttaattttttttgagaaacatttttttcacttgattgaaagagaaagtgagctatttagcagtgaaactgccctgttctaaagagtgggctcctgagttaagagaaggcagctgcctcagcccctaccctccagcatagtgtggggctgaggccctgaagtgcatcagactgcccaaatcaaattgctcacttaataattaatgttcctgcaatggaatcgctttctccctggaggttggctttcagatttaccagacatctgacaacactgcaccccttattctcgacacaagacctcagcttctgctttaagaaacatctgaataaaggatgcttttgttcatccctcgcctgcctgtgatagagtgataaagtgtctgatggctgaatggaatagttttacagtgtgagtgctgctgtcagcagaggggcagggcttgggttttaggaggaagtgaattggataggtcaggagaatgtaccatttgtaaacacccctttccttttttattcacgtgtcaggacagccacggcaggctgctgagtgtccacccctgcacagaaccagagggaaagcagctcggacttgagctgtagtttttaaacattgctcttgattactcgggagtgattgtcaagtccttggacttgcgttagaagctgtttggaaactaacatggtttagtccactaactgcatgttgggtaaattcaaaacccacatgctcgtcctcttgcagtggaataagtcacatctgatggacattttctgtgcttatagcatagtaatgaacgtctgacaggcgcgacctttcataagacaacccacactattggctttctgcccagaatattgctgcaacactatctgtgattggttatctctctatcatgcattgcttcacaaggggaaacggccccctttttaataaatctacgatggctggctgcaatatgcctcactgtaagtatttgtgtgtgtgtgtgtgtgtgtgagagagagagagagaaagagagagagagggagagagagagagaaggagagagagagaagcagaaagagaggagagagagagagagaatatgaagctgactttgagttgcttagtctgttatcacatggcaaggttgtgctgctataggacatcagtgaatgctacttagtaaatcttaacctatctcttttctctacaggttggtactaagaagtgcctttcctgacgtctctgctgcttggaaccgcttctagagcagcctctgcttttgccttgcttgctgccagctagactgacgacagcacatccgccctccacctctagcccagacaccccatttctacttctaatcaggagaaaagctctgagtatctgccattgccctaggctgctttagtttagaagaaaagtttgctgaaaaagtaagataccttctgccaggaaatcaaggaggaaaaaaaaaaatcattttctcgattttgctctaaactgctgcatctgtctatgccaaactaatcaataccgattgcaccaccaaactccatcgcaaatcagctgtgaggagattccctgtcagacaactttgctgaaagcagcttggaaattcggtgtcaaagggtctgccacgttttcatgcttgcattttgggctccaaattggcactgggaaggggttactgagcacacggctgagtccaggcctcctctaaacacccatctacttacagtcctggtattcctctcaaaaccaaaacctctttgaattaacagtttcatgctgtgaatttctagcggaggtctttccctttatattgaagtcacacttttccatgtgccgttaaatcggggacgggggaagcagcctttcggacattttcacagttatctcacactctgagttttatcagttcctattttgtttagtttttgtcttttgttttggttgctgattttttttctatttttctttttcttttctttttgttttttccttttttttttttttttttttttttggagaggggttgggtttgttggtttcattaaacatttaactacctgtaaaatataaacatggctgttagtgtcacaccaattcgggacacaaaatggctaacactggaagtatgtagagagtttcaaagggggacttgctcacgaccagacacggaatgtaaatttgcacatccttcgaaaagctgccaagttgaaaatggacgagtaatcgcctgctttgattcactgaaagtgagtaaatgttacctccttttaaggatatgcaatgattgattaaggggtatgggtacatggtactctaaatttggaattatgggttgttttgttaacactttagttactcagaatgttctggctcctgaggctggcctggggctctcaactagatctcatagaatcaaacagagccaaactttgttataaataactttgtcaggcctttaactccgaactccatgcctcccctcccctccctttcttttcttttcttttttttttttttttcctaaagcagaattgttacacgttgatgtagttgtgacttagtgatagcaagtcagagtctttgttcagcaatggtaaatgtttacattcaagactttcatatataataaggccaagattgaatgaatatatgttgtatgtctttgttggtaaactttgtcaagctgttataaatgaatggcaaattctgtgtcagctgatcataggtaacatttttactcttttttttttttttttttttttttaatgagatgattttaatggctaaagccatgtcctttttgggaaaacatgactagaagtgagagttttgtttcggttgctctggtatcttatccaaagcatatactatattagatgtggactttgtaaataggcacaaactcctgtgtcctgttgttcattgggattttcatattgaggcaatgcagatgttcattttctgtgagattcttgccagttgttacttatagtgttctgtcagaaatgttaaaagttagccttgtgtgtgtgataagaagaaatggtttatttatgttagaatttttgacattcaaaaaactgtcattggacttgtaagccctgtatcaggtttcaagtgggtcttgtaaagatagcacacatgtctttgttttgatacaaggtcaaggctagaaatgtgttctggggtgtcttcaacctgcttgatttaatcagattaatttttgaatactaaatgcctacagctaattctttgactcttccaagatgggtcaccatcatatggaagtctgtgaagaagtctcagagacccatcatgtttaaaaccaaaccatacagtaatccaagtgctttcttacatcacgtcagggtgagttagaagttaaccgtttcagctcactttgtgatgctcgatctggtaaagtttttgccaaatgtttaagatttgattttcagaacaggatatgaggaggtatgtgttagtaaccacagacctctgttaagatggcatgctatataggcagagtcctagttgaggtgaataaggggaaattaccactttctctcagcttggccttaagggatgcctttattataaaggtgttgatacctttgtgaacattaatcctgaattaatgctcaccaattcaggtgtaatgagagaaggatccataacaggaggagcaaaggactaattgcttttgtcgggaaacagctgtgtccataagtaactcctttttgacccaattcctagtaaatccagtttataatcctatagataattggtggtaaactcctagctcagaaatgaaggacattaaatttggccgtgacattgaatggctttacagaagacctgccggcacagggtttggaaacattgtgaaacattagtattcagttgctatttttccagctccaaatatttttttagttaccgttcacttgtggtcagagaacagttcccctttgaggaaagcaatcgtcctgcttacagacacccagtgtccctaacgaggttcaacccccacatcaaggactttaaaacaaacaaacaaagaaaaccacaagaaaaaaaacccaataacaaatgaattatattaagttttaaaaattatttgtgaaatgaatttactataccagcaaatcacagtaaacttcatccttttgttttttactaagaaaagctggaatttttagtttcaatatttggcaaaacatttgtgtgtttgtgtgtgtgtgtgtgtgtgtgtgtgtgtagagggaaaattcaacacaaatttatttgcgatagagcttcatacccagacaatacctccttagatgttagtgaaataactgttaagaatcagtcaacagagtttctatgtgcagttaagtatttgttggacttctgcctattaggtagtcctatggtgttcagttttgtggctaaaatagatccagtacacatctcaaagcacttaaagtatctgcctgactcatgcttgaagttctgaagtttgggagcattctgagacttggcagctagcaaccaacagatcatctccattgtttcagtaaatgaaaggtattttaaaaacttataatatcctgacttcttcaatgaaatgtgctttctgcattactttttatttctgctccagcctcttttgagttcttgagccatgagatggaagtagcttgtgtaatctactatttttagaaagttaggaaagcaaaccaaatactctcagagaggaccctgtgaaatggctgtacccttcagccatgctgtttcaggctttggctgtgctcccaggtgacttaggtttatagctgacttctggttagaagagaaatcctctctctctctctctctctctctctctctctctctctctctctctctctctcactctctctctctctcaacacacacacacatacacacacacacacacacacacagaacacaagttgagcagaaaaaaaactatttatctaaaagaaacccataacattcctgtaattttaaatgaaagataggataaagcagtccaagtttataataaatgtgctgcaaaaatggactgtgataagtaggaatatatgtgtgtgtgttaggcctttccaaatgcaaatactgaaaacaaaagaggagtaataggtcaagtgtataaattaaatagcatttaagcactttattaacttagtttaaattcattgtagtctaagagtatattctagccattacttttaagtgctgataacttacaggtctgggggctgtaggcacttctcagaacaattgatcaagtgcatttgattctgttctgaagaagattttttttctcttatggcttatgaatagtactccaaaagaggaggcaaacgattaaaagagaagactccaacactgcaagctgccaataaaatgatgccatgtttcagaaatggtaattccagcaatctgactgtcatgatctcttcacagttctgagtttgtgggaatggagtagatgggatacatttttatgtgacgccaaatgtattacagtctcaaaaataagtgttcactatatcatcagtagaaataaacctctggtgttaacatcaggattacatggcatgactgacttgaagaagtgcccccgaagtgatggcagttaatttcagaatatcttccatgattgtcacagtctatttcccccagagaaatggttagtctcattgttgttcttacaaaggcaccatcgtggtcctttcatcatgtgtttaaagcagttttagcagataaacctgcagaatgaagcacaggagattggcaagtcctggataatctaaattctagtgtccccaccctcagtgacctttgatgagcatttgctgccttgtcttgcacacacacacatacgatgctacagttttgaaggatattaacctcctgtattctgaaacttgtgcagacatgagtgtgtctttagcaacaggttgacacagcagagttttttctacaaaagaaacagcttgtagagcagcctgggtggtttgcatgttcctgttgtatccagtaagcagaaagttcacaactctgtcaagttcttcctgggcctgtgaggcaaaaatcatcaattctgacagcaatatttccttaacaaaatgctcagcagctatagctgcctcagcagtactaataatagctttagacacatgctgttcacattcttaaattcttaaactttccttaaatagggacttttattaatttttcttttattttttgattataacatattatattattttccctttcattttctcccttggaaccctcccatatacttcttgcattccttcaagtccatggccctgtttttccttacatgttacatgcaaatgtggatgtgcctgtgtgtgtgagcatttacacacacacacacacacacacacacacacactcacacacacactcacacacactcacacgcacacacactaatatttttattttttccttaaatacattagtgccaccagctcagtctgtataatgtaatttgcatgtacgttttaagggctgacattttggtattggttaaccaattggtgtgctctttctcagagaagacagtctctcctactctgagcattcctctgctgcctgtggctttttatgtagggtccaggcctccgggtatttccactttgctctgtccactatggcactatggcatggtgattgttgtccatggtcagcttgtatttaagggctcatattaattcctgacattactaggggatgcagtctcatagcaacgttcctgatctggcttttaacaatctttctaacccctcggcttcagggttccctgacctttaggtgcagggctcttttgtagatagatccgtttcatctggattccacaactctgctttatgtttgtttggttttggttgtggtttaaaaagacagtcttttaagtgactgaatgtttttatactgtcaggcaaacaaaattcaagacataaagcctgttaaggtatagattcatgctatgttgcattcttttgtaagattttaatatatttctcctttttctcatttagtcttgcttcactgtgttagcatggtcaactaaaaaacgatctaaacccaaggcagcttggagtgtaaacaggttcaaagtttacctgtgtgttggacatctaaaactacttaaagtttaagtagctttaagtctctgtgatatgtagggtaaatgtactgctgaacatggttcatacaagcttccaagtccagaatgcttctcagccccaaaggacacccaggccagtagcctgggaggcctgttttgttgttctctttgctaagggtaagtagaaggtttgagcttatcatctttgccagtgcatcgcctttcatgctgagcagtgtctctgcttccctccagacctagacaaagccttttattttctctaaagaggttctaatgaggaaattacccctactccacccttttaaactttagcagacacacattctgtgctcttagataagggaataattttccatgttattacttaggtcagaatttctgagagtcagtagcaatgggtaactaaataggtgacctttgactgttctgctgatagagattagtgtgcagagactccaggaaaagtgactggcaaggctgggttgagaagacttcgttgtacggtgcattgtatgttagagcggtaatgtttcgtgagttccactgaagtggtgacactaaacagattaactctagtaagcatgtagctcaacactcatttacaccatgctggcccactaaagagttttgtaactaacacctatcatgtaaggtaatcactaaatacacttctactgatcagctcctttctggtattaatatttgtgattattttaaatttcgatttatgcttgatttattagaagaaaagttttttttttcttaatttttttctttacacaagtctatgctttgagagtttagtgagagtttccaagctgtagaacccattctatactatacctttactggcagactaaccgggtatttttgggcctggtccttgtcacacatacttctttctcatcctggtgactgcccacacaatgtcatttcaccttccacctcacctgacaactgcccttaattctgatttaggggatagttaaacaacccgtacagttctggagttgttggctctgatctttctttatgattcccagagatgtacagggcccaaataattttgtatggcaccggattttgttgttcctctaatttttatttgtacttccttcacaaatacattttttttacttctttagtttagaataaagcgagtgaatagttactaaattgctctgtgttgatcattgttttcattttatgataacctaagcctatacaacaactctgataatagtatcaaaattgacagacagggaagtacagaggagccaggcgctgctcaactgtaagctatggacctgatgcctggtagtctaatttcagtttctgtactcaatcacaccattccaaatgctgcttttaatttacatatccctgtgctgaggaatcaaccaagaagtcatacaccattggttgagcatagctaaatgatgattcccagcacattgaaggcatagggccagtaagagtaaatacatataattgtgttatgttttgagttaactggtaggccatgaagctaatccaaggtagcaggaagattgtggtggtgttagacacaaagattatgagtctgtcctaacatataagaaaatgagcttaagtttactacctcagacaataaatcaatgtgtcagctagatagctgcctccatgtctagaaaggggggctgaagaggtggctcagtgcttaagaatactgggctgcccttccagagaagccaggcttagtttccaggtcccatacagtgttttatagcttgctgtaactccagttccagagaattctgtgcctttttctaaaccatggttaccagccgtacatgtggtacttatacatggatgtaggcaaaatacccatgcataaaaataatatcaatatgggagaagaaaaatggcccaatgtcttcattgtttagaacatagttaaaacatcaggcccactctgagaagccaaacaactataaggttcttgagctatgctttaaaaccctggctacgaattaaaccaggaagactccacaaatatactgtgagctccatnnnnnnnnnnnnnnnnnnnnccagatttgggttgtgcttgtttcctgcagaggtcttcaagagcagagttgacagcagtgtccacattttgtgggcatcacctccaaggtaggaaggctttcattgtcaaattgtcttctaagaagcccgctgggctgggctgcatgaactgttgtagcttcatgaaggtagtcctggtgaaatacgtggcagaaatacagagtgtcaagctcagaattttattttgattttttcttgccattttataacagtaatggttaacgggtcagacatgaagaacaaatctatttaaaagctaagaaagtataaggatttaatatttaaagaggatagcaagcatattctgtcttggactttggcaaagcagatgtgagaaatgctgtcctcatggtgctgattgtttctaagggatcctgtgttaggagcgatgaggtggagattaggagggaactttcaacagtaacaggaaggtcagcgtgagagcaacttgaggaagggggagagggatgtctttagtgtctaagctttactctccctcacaactactgactcaaaccacagatgggaacagaccagagagtaccaaaaagaaagaagtcccaagtcccaggcttaggcctatgtcttggatgaccttgctcagaggggaaactccactttaacctgtagtctcaggttcagggctagaagaatacttctgctatctgagtttatctactgatgcatatgttgtgttttgtgtcagtatgagtttgaggcttgaccatcaggttcccaaaccttgttgcttcaaaggccctaggactccagtatgcttttagagttatctctctgcctccaatacagagacttatgctgatatctaggtccaggctgtttgtacttgaggcaggaagcatctgcggttaatagttgacagtaaattacacaaaataaaacatggaaaatttaagttagcaaagctggggaatttttctatcattttcaatttctctacagatacggacataattagtgtttaggatcgcttgtgatggataaattacatctgtaattcattcttgccatgttactgcattcagagaataatttgctttcagaaatcattgctcatataatattctaaaatcgttcttagactgaaaacaagtttagtagcatgtccctatcgagtaagctcttatatccatcagtttcagactagaaagaggtattggagaaaagcagccaaatgccttcctggtggatgatggggtttcttaaaagattattctccttcaggggaggcaaccacaaagaaagatggagaaagaagaaccacgaaaaaggaaatacttgaagaattaatttttaaatgaagaatcctattaaggaagatttgtgttctgaatgcaatatccccacattatctcctgtttctccatggctatgtgatgactaatgaaatctaagtctagccatgagagaagattatcgtcatggtcttatttattgggcttttttctctgaagaacttttattactagatattgcttcccatgaattttagcacagttaaaaaaccaaaaggagatgtccttgaaagaactcagatatatttacaagtaacaatcagaataagcaaatctccaaacaccactaaatctcaaaactagaacaaacaaaccccccaaacaaccctttagcctagcccctgatgagctataaatcatcattcatatttaagaaaaatcatttatattgccaagttttacagtgggatctattaaaatagttcctgtaaaactcaaaatcaatgcttgaagattaacttaatattacactatcgaataaaaaggcttcaatgggcagaacagtgaacgcagaacggccttagtagctactgtcttctgtcattcctgccaaggatgaataatgacagagaagagattttcatgagaaatatctattttaagaaccagagggttggggggtgggttcagtgggtcacagcactagctggacgagtgtgaagaccagaatccaaatgccttacttggggaagagagaagcagatcctagaagccagctggttccgtgagcagcactgtgtaaaggcctcaaggtggagtttagcacccttgtcacctgcatggccaccagctctaaccccagatatctgctgctcacacgtcctctgtgcagcagcacatgttgtgcttttgactgttcacttgatgtactaggtatttgtgacatcttcatggaagtgtaaaacacacactatttggcctctctggttgttggtagatgagtggctattttaagatcataaaaataataaaaatttgattttattctgaatttgttttgaaacactggaaattttctgtataggagaagccaaatactcggcatgtttttattggaatggtcactgctgactttcatatgacaggagagttagctaagctcctcatcacagtctgccattttgtgacataaattgagacacattgacttttggacaacacatttagaaattgtgaagtttcctctgctgatttgttcaccagctccctattgtatagattgggaaagttcagagcagttaagttacttctccaagcttgctcagtgagaggcagcttcccggggcttaacacaggcaatctgccttcacagcttactcttttagcctatctcctgcgaaacttgtttaaaaactattaatactgagaaatcttatagcatgaccctgtccatacagcctgcatttaattaccaaagagtttttctatgaaaatgttgaacaagtatcgattccgttacagcagctggctgaatttaagatgagggtactttaaaaaacaaactctttcacatgctttcttaacaataccatccctgaataattgctagcaaggtattctctttcaaaatttgaaacatgccctttgtagcctgcagccttatatagtatagatctctggtcaggttacatctgcatagtttcacaccttgcagacaacaaaggaggtagaaaatcagaaaacagtttgttctagaaattgaagaagagacacactggagttccaacctggcagtgatatgaaaagggcattagataaggaggcctctcagttcatcactgtccttatatctttgggttaaagtggaatgtctctttttattcactgatacgtaagcccatgcagctgttgatatcattttgtatgaggctgcaggttcagcttattttgtagttttcctaggaactataatattagaagcaaaatatgtacttcaaaacctttgttaaatcttccatgtattgatgttagaatttagacgaaacaactgaaatctttgtttcccaaaacatcttcctgccatgtgttatatttatgtatttatgaccctaaaaggatatttcagaaattatctaggactaaaatttttattctttgcatatcgtcaatatttactcactatactaattatgccaaagtaattttcatgtgatataaataattttattaagtattttaaaacaatatatatatttctttaagatttttgtaccacagttagacataatgaaaatgactattaataaaagaattgattccatttttatacaagatgtggaataaagagtatgttgtgctaaaaactttgggtttcagaatatgaaataaattcttatgcttcttagatatttaatgaacactgtgtaaccctgacctcatattgaggagatattgatcaagtattagtgttcttggtgtacagtataggatgacacacgagtcttctcagagcagttcatttccacagtatgagctcgtgagacaagagcccctaccccagaggatcagcaactcatgtctgttagccagtttcagcaaatagccatttagaaatgtttctgtttaaagtggaaagctgcataggtttgtggattctgatatgccaaactgacttttctctagagctccagagattacagagaaaagtgtgtagtgttctttgtccttagatttcatttttctggcttgtctgtttcctttattaatttgctgtagattgagttttgcttgccttgttccctttggtgttttctgagtgtctagtttggacttcattctgtttttcttggagtgatttttttcctgaaaactctattattgcaaataaatattgatgccaagagcgatgagcaagtggccaccagtggtccacacttagatgcttcagctgcctctagaatcctagtcaaatttggatcttcataatgatcacacaaagccatatgctaggcgtaatgtaagttagaaacaaaacaaacaacaaacctattttctatggcaccgacaaggccttgtaaatagatcagacagtagatccagccagggcttttattgcagaggagttcctgtgacttcagactctttattgtcttatgcattttttttctcacttataacatgaatctgatgcttcagtaagaggattcaataaaatatattacaaacatcactaaatgtatggatatactctacacaagaggcattcatactgttctggtctgaatgttggtagtcagtcgaaattatgatttccctctgtatgaggagcctcgccttaggttagaataaataaatgtgactgttttgcatattacactgtcagtagattactgtgcattgtttcattgtgaaatctaaaccattctctatgacataggtataaatgttacacagtagcttatttacctacccttccttaacaggagacaaccccaactgagcatgtgcacaacttcatgctaacgagtcagtattagcacaataaatttcatctgttcctaaaatccatttaataaaggtagttatctatgagtggaaaatagttatagtcatctgttctgattttaatcctatttaatacaaatgcctctttagttctgtgctgttctacaagaaataattcatattttacatttcaaatgcaatatgtggatttcatattaaaagactcatgtgtttgaaagattttatttttaattgtgtgtgtgtgtgtttatgcatttgcatatacacatgtgtgaatacaggtgttcatagagaccagaggtattagatctctggagatggagtttcagatgaccatgagccttgtagtctaggtgctagaagcactacttgggtcctttaaaacaatggggtggactcttaaccactaagtcatctccctataatccacaaatgttaatgtaagatatatatttatccaacaaagttcctgcacaaacagcatcaacttcaagtcttcctttttgtattttattatcttcttcctttgatctttttaatgtgtatatctcaaactatagattcagttaggatttcattagattccaaagggtttctgatagcataaagtataaaccttagatctgtctacactccttcctttatggtttaaaagtaatatccaactattctgattgttccaacctcattttttctcttgtacttgtaattaacagggcagtgctgttaggtattaatataacccaaggtattaacctaattcataagtgtaagatgtgacttgggtaagagaagaataaatgcttttatttttattttttgtgagcaagggaacagccttatttgtaaaagcttcagtgacatcctaagtatgaggtatgtgctgccttcttagttattggttattgcccatgctagagtgttgcgtattgattttgtgtgtggcaatgagttaggtttatgatctaatgttaaaggaggttcaagtatgtgttcagtggatttgcttgtagacttctaattgaataggctatttggggtatttaccgcctagagagactattagggaaaaaagcagatacctctgagggcaggaaaaataaaatttattttcaaatctctaggagttgcttgaagtggcagaaccagacctgccaggaattctgtaatcgctttgtagtgagttagctgatgcctaagatttgaaatttcatttacatgtttcttataaaaattaatggtttaagcaccacaaaatgcttagttttatcttgagaaaatctcacttgtctttcagagtggtttcatggtaaaactgtattataggatctgtaacaggaaggaaactgagctgcacagtgtgttgatatttggggtgtagtagagatagaaaactaagctaaggattaagttggggattagatgagatagtttgtttacttacaggattatttcctgtttcataattttttataaaatggaacagatagggctaatatttacttatcttctttgatattcgtaaactgattttccaaacttctttctttttctctttgtgcatgtgtctgtctgctgtgtgtgtaggtgcacatgcacattgtgcaaacccacacatatggaggccagttgtatatctgatgtgccactcaggtgctctccagtttatttgctgagggatggtctgtcactgaacctagaactttctgatttggtttccacatctagcagacattgctcatctatgtctcctgagtgcacgtgaaataaagacacatagatacctattcccctcaacagagcctcctccatagctcccaaacattagataattctcacccccttctatacacacacacatatatgtatacacacacacacacacacacatatatatatatatatgtatatatatatatgtatttatatatatgtgtatatacatacacatacacacacacacctaccttagactgccactctggtcactcttgtctgctaatgaacgcaattttttattctaacaactcacttggctccaattcatggaaaagttttttcaacccttcagctccaaggtataaggcaggccagtgttaaagaaccattttcagaagccaagtttctctagataacatcagtagtaaatgtgcatatggttatgcttacactccccctcttgtttgctctctctgaataaaggcatgctttgttaatcctaagtgacattatggtcccagttttctttgatgtttttgaaattaatttgctttggttgaactgaagcagaacacttgcctaacagtaacacgtgccagggcattctgacccacagccttttgctgtccctgacttgtttgacaactgtataaattttgaaaatgtgaccaaattttagaatgcgtattaaatatttacctcagttgtcctcattgggattttagcagtagacttgtgatagtgtgtattaaaggtagagagactaggagagatgctgtgcaccagacaacttctaaatgccttggagagtcaccttccaaggaagccatgtttataatgagttgaaaaagtacttcttttagtaactattccagagatcagcagattagcattggggttaaaaggcaagtctgaaactacatgcactttgagctcaatattaacagtaaaatgtatttatctcgaaaactttcccgaaagcaccctgtttaatgcatttaaaattgatgaataggtcatgaaacccagcaggtaattctgtaataccattctttgccagtattatttgggtcgtcatgttggaactatggagattttacttcgtgaagtgtgtgttacattctagtaacataaataaaaccatatcagcataagcagaaagataaagtgttttagctgtacagagttattgtaaatttctttcactgtctggttcaatactgcatttgaattaaaataggtcttgatcgatggaacgtcgtttgcttatgggtttagagatcttgttctcagtagtttgaaagacgcattgtccagcagaggctattcacctacactagtgctttgcgtgagcttgatgcatttagaccccaagttgatcgttactgcttaggtctgtgaatggaagagctgcaatctcagttctaagctgtgacccactattaagccaatttgaggaatagcaataaatcaatacggactcatagaaaatacagagattgcagcgagctgtcaaattataaaggctgttagctttttgtaattattgtgcttttctgtattgggtcagggtgtaaaatgtcttatatagcctaccctatttttattttactagaaaagatactagtaacattttggagtaatgtggaaggaaaagtagatttcactggctgcatgaagcccttatcagagtaactaatagaaacaattcattgagtagtcagatgttcaaataattaaagtgtgaaataaaacaaaaacaaaacaccttaagattgaaaaccttgaaggtagagaagaatctaagcttttttggtttatgtttaaggtttgctattctttgtacttagattattcgtgtggtttttaatggtttttcttagtgcctagagatgagtttttcctttgccactttcagcattaaactcaagtgaaccacagactgctgcaagtattaattagaagaagcttaaggaatgaggccatgtggcacaccccttttacatattaccgtaacaaggagtggaaagggacaggcttaattatgttcataaagttgtcaaggtcaccaggaccttgaaacacaggtacttgccaagtcaaataaaaaacctgatgatactgtcttcattttatgagaataacatcatcaatacttacagctccaattcactcttaggcccagtctagctgagaattttttaaataatctgataccttgtgtgttagtagtgtcaaaatccatactatgttttttttctccaacaacaaattctccaaacaaatttatgcttacatatagatacatacatatctatttatctgtctattcatctttgtatctatcgttatctatacatgtgcacattataagtttttaatatcagctgtgatatctagaatgttaaattctacatgatcagtagattcttaaagaatgccattttgatttcatcaaactgtaacctgcttgaataacctcctcctaaaagccctgacattgtgatagctaccaatcgagaatccttcatagtgtgggtatttctttcttccacattccttagatattatgtattatagagtaggctatattgtgttgaattttatagtcagtctacctatttttcctcataagctctaaaggccttgaagtttaccagactctcttgataaccttgtatctgtggttcctggaatatccttgataattcattgaattgaaagcaatattatttcctaatcatggccaataatttttagctgatcaaaaatgattttaaattcagttttagggaaatcattgttctgcagttgtcaatctctcctctaaggagcatagctgctgttgtggaagaggtttcacccatagcttacatatatagttctctgcaagggttcatgtacctctgattcgctctggcagagtagaggatcctttttattctgtgagtgaatttctggatcaggcccctttggggggggggggtgcatgctattgtttatgttatcttgctcttgtacagtcctacctctttggctgcctgtctctgtagatcgatacattgctcattgcagtggcatgatttagttatttgggtaaaaatattagcacccacacatgaatgtgtgttggaggaactgtggggctttcatacagcacaatgtttagcctctgacagctgtgcatggagaaatggtcacattattaggattcactttcacaacataggaacactatgttgagaataatgtgaacacctttaatagttttgttacattatatgattaacatctagaatccagactacagttatatcactgttgccttcagtacagaataaataacactaaaaaggggatatcattctttgcagagtttcacatatctatgctatgcataaaattctccatattataataatataaaaatgttttatcttctaagtccagatattttatagtttccatttttctttttacatttgaagttgaaggaagaacccaaagacatagactctgctaggtgcttactggctcctattcttaacctgctcacagccctttagagaggtgtgatgctagaagtcatgctgtgtatgtcatgagagtttctagagagaaaaaccctccagatgagtgctggtgccagcacttctgcactcaagcatctgactctggagcatctacagttatccactttgaaaagggatcatcaagatggattaaaaatttagcacttgaggcttattaagggttagagtggaataattatttatgtagctggcgatactgcagtcctcacgagaacactgtgatatgctgggcacttcctgcctcttgtcaaggcctctcacagtttttatctccctaagaataagtcttgctgttccttggttgttcatgcttcctgctttcttactgtgtatatgatcagaggagataaatcttactgaaatcctatgaacatacagctttgtaagccatcgttccttgctgtgcagcagttgtctacctcagatcaatgaacctttgttctcttggtgctcaaaggagatgagtgtggactaggccttcagactacatccatttcagttgttgctaattatggagccaggcttgttttttttctaatcttgaaagttggaaaataaaaggccaagaggcagtggtggatcttggaatgccactcttcatcaggctgtgagatattatatattgtgactgcagttttgtgttttggcaaggtagcatattaactctaacagaaaatttagtcaaatctagttttaaattcttgaggatttttgttctttcctttaaaaatcttgacctatcagtttcttcctaagaggccctcttagtccctaatctgcagtttcttcatttacatttttgaaaatccaggtagtattgctacactctagaaatattttaaacattttaaaatataatttttgaaatatagtcatatagctgccccctcttcttcctatctccagacctgctcatatgtctcactccctgtgtaaattcatggcctccttttcttttactgtcattaatgtgtctttgtatataagtgtgttcctaaatacataaacatgacatatgtagtctgtataatagtaccttttacttgtgtgtatatacattcaggtctgcttagaacagaagaaataatctacccgagagaaggtaccaattggttatgtaatactaaatggtcagccctgaaaacaatatcagtaatttaaaaatggagtggtacttttattgtgttattttactgtataaaattcggcaaaagagagacacggcaaaactttctgttcttccactaactatctctgtgaggtttttaactcagtcctgtctggaaacttataaaagcaaaggatatgccatagtcacctgtaaaatatcctacccaagtgactagcacaggatggctgcaaatagataccctttgacttgtgttggatgtcaagctgggtagagtatacaacattatgaaaataagttaactctctcctcatgcccaagctttcctccatttgtatgattaaaataaccagttaatcccatcacaacaggtaggtcatatattatatattgaagaaataatgatttggaagacagtgtccaagctatgaaaacagtcatgaacataaaatgctaaaaatattttaattgaacatatttaagtaagttggagtagcacagtgacaaaaatcatatatgtataatctgttctcagtctgtactgttggactgaaaaatacattgatttgactaatgagattgtctgaatcattttacaagctagacagcaatattatggattgatttttgtctttaatcagatttgtgagtttttcttcctaatgcagaatactgaaaacatgacctttcccttaccatttataagcattaggagtgtaaatcaataattaaattgaccccataaaatattttgggtaatacaattgggacttttaaaaaatgtagcatgtaatagacaatcaatgcatctcagaagcacctttcatataagtgtgataagtgtatcagtgtaatgaatcacatttgctctcagcgtccagttaagcagtggattctggtagatcagctgtgggcttctgaaaaccagatttagtcacaagtcagcaacagatttaccatacgccaaatggggaacatgccagtctcactttcactttagctttctgatcactggttggttttctttagtatcatattcagttaaagtgtgtgtgtgtgtgtgtgtgtgtgtgtgtgtgtgtgtgtgtgtgtgtgtgtgtttgtgtgtgtgtgtgatttacacaggtcagcctctaacaaacattttatattccatttggatgctgtatctagtataacaattcttgcttcctgttttcccctaatgccctttgcctctgtcctgtaaaatgcctaaaattataaattcaactaactgcttctatatagcgtttctattttctttactctttgcatactagaaaatgaatccaaagttgagtttacttctaatgccatttggttttgtgagataatccttcttacaaggtcctgtatacttgttatttcatcatagcaaaaggtataacttcaattatccccactaaggatactgaaatctgtcatttcttcttgactcttgggaaaagaccaagggttggttggacccaatgtttttacttcattgttgatcatgttctagaaccatgatattttttaaggattacaaaggtttaacttttgatcatgcagttcctcctatgttactactagaaaatttctaaacaaatgctcttcttcagttttatgagacactatgcgatgtaatttgtattacattggggacatgcatgagttttatcaacatttaaatcaaatatcttctaatataagatctaaacaaatttacacataccttcaaattattctaggttatgatgcttcttagtgggtaatgggctatcttgctaaccacaggactggaccacagacctggagcctgaaatgaagcagcagaagtgctcgtgcctggcatcccaggcacagccgaacccagagctggcgggtcaggcttgcagcttatgctagccagctggagtctaggctccatcaaattattctaatatatttcaagacttttcttttgggaaaaatctttgaattgcttctcctgatcttttttatgataatatattttggtgacaatgcatttccatgatatcaggagtcgtctgacacttcgtttctgtttagcacagatctgttcctgagaatttgactctctctctctctttttttttccccatttgggtttgttttgtgttcatgatgcaaatgaaaaacataagacaaatgaaaaaaaagtccatatgtaaatctggttttccttattctaatatttggtttcatatattaaaatcagtatttttagctgacttcaaattccttgactttattatttaatatcatgacagtcagagaattgggggttggtgagtaactcccactgacccagagaaacagaaatgactatttggggcctaacatgttacagtaaaggaagtttcatttaaactaataactttgaagaagtaaaattagagtcaagagtactggaaatcccccctcagactaatgcaaatgggaagagcccacgaggcttccatgtagtgatatctgagcttcagctggcttctagccttaggaaataatgaagaaatgttagtggttttgttatctcttataatgtgtattttgtacatataaagagaagtctggggttcttaagataattgttggatagtaaacacatagtgtgctatggaaatctgggcttagcatttatgattctgttttgttagaaatgtagttgcctaagaacttcatttattattactgttttaggtgattcatctgtagttgattataccaaggtgatcttgtgcctactagagagctagtttgtagggtcagctctcttctccaatgttcagtagactagacaatggcaaattctggcactaggcttgttcaacaagcccttcctccagcctggctgtctcagcagccccggggatgttctgtcgattttagcatgtattaaacagtgatagcatttttgatgtcttctatcgtccagaaatagttcctttacttatggttaggtactataatccagctgaggttaaaatgaaagataatttcttggcataaaatatattttgcaataggaacatagacaatatagaagcatcacattgatttttttaatcatatgtagatatgtttatgatactacagagagatatcaggaagagatattttaaatcaaatggtatttgtatccttggctggcttaccttttctggacattttaaaagagggaaaacacagaaagctaggtgaggtctctggtaacaccaaggattggctgaatttaaagttaaagatctacaaatagatatttatgtccttcaaatactaattgcagttttacctggaggaaatattttcatatgaatagcacataagttcatgacaaagttcactaagtcataagtaatgacagtttcaaactgtggaaatggaaggctagtcccaaagagacaggagttccaaaaacaactggcaaaagtaaatgttatacaacacagaaaaataccaggagaagagctgatagactacaacaggaagactagtcacttgtggatggaaaaggtgggggtggggcaaagagaagaggagctcaagcagggtgttgtctaatatgcacatcccaaccccctgggagctgcactagcaaaaccaggtaatgccacaacaccaaagacacaaatataaagttttcaaaatcagtgactggattgaaagcaggaaaatgttaggcttgagtttacagaagctgacactaaaaggctggtggtggtggtcctcagcagagctgagcctcttagctcaggctgctaggttggttggccagggaaagaaagccttgcttgtccttcaccacacgctgaggctccgttcagatatatattgcatgtaaatagaagtgctctgggtgtctcatttgtgtgtgctctttgaaataacttttgcttatagagaacatttatccacaacttaagaagtataggtatccaaatattccagtagctatttctgtgagcttttaaaagtactagtagtcattacctgtatattttataaaaacggttctctataactggaaagtagacctctctctctctctctctctctctcaacctctctctctctctctctctctctctctctctctctctctctctccctccctccctctctctctctctctgtgtgtgtgtgtacgttttattgaaattctattaattttccattcatagtaaaaggaatagggatattccagaaactggttttattgagtctcctcacttgtcaaatgtgaataataagatgcctgactcaaaaacaggcaacaagaatagaatgacctggatgcagtaatataaaaatcatatgacatgctatgtttttattagtatactctttagccaagtatggcccaactgacttaaatgacgtatttctagcttacaaggaaggtgggtattagcaggaacactcttccttataccacttggtgaggtcatttgttgtgttacatatatatcaatatttagcagacatatgatttgaacttgttcatctcttagtaattcttataaattatgtcaaatatttttaatattaaggacacaatctgctctatttggaaaaatatacctttgtcagttaaaagtaaaaacaagtgatgcatattcaaataagatagaaaattcacttaatttagagactttagatttcatcttgttctgtatagctttatggaatatataattttgtatcattgtgctcagggaactgcagaatgcagagagccattctgatcttttttttaaccaattacaatacttctgttgttcatgagcccaaaattttctgagataaattctaacctctaacaacataaccaggtaatacaaacactgaaagtacactgaaacaaccaactcttcctgactcccctgccccatgcataatagaaagggaaatgtttgttttctaaactgtacagacaaatgctatctccgacaccgaaagtcttcccttttcctggtgtggacacagtaagtcatcctgagtcacttgaggactttatttaaagcatagaattgtgaggacagatgactcaggggtctatgtggtgtggctagactttctcactgtcaggttaccggttcccacacaactcactccctattaaatattgggggaatactttgttttcacgatgggagtgcattaaaatctcatctgttctgactagtgtgccctttacttgttataattgttattaatacatttgtttccatatgaagcctattcaaagaattaagcagagggaatgggcccagtcatagctcatgaatataagaggggcttagcttatttgtacacagatactggcttttctcttcttcttttttcttttgtgtgtgtgtgagtgaaatatttacataactagttacttgagcttgaatcttaacactttcactgccccagcatcagaaatgactatatggcgattgaacaagttctggatatgctgaaaaaccataatttatatgtttgtatgacagcataaataactgatgggttctcctagttatcactcactaatgccaagataataagataatttgtttagggggttggatatgaatctcaaaagtcattggcaacctgggcctcatcatgagatatgtcttacaaataaatcctttaatctatcttatgcaaaaaaaaaatctatgcagttactttatttcccttactgacaatatggaagaatatactctttagcatatttttatttgttaaattcagtgttataagtagaggctcgaacagatttaaatctgttattagcatgaataaatcaagctcattttatgtgatatcagcaccactatccagggttactgcagagaactctccacctccttctattttgattttagaaataattgagaataaataaactcttacatggtatgccatttgaagggagtccatgtaggcaccaaaataagttgttggtaaatgctgcccaggggctgcatttcataaagcttatggctaaattataaccgagggaaagttcatcaaaagaatatcctcctaaagtttccatagattctcctccttagttttgcctaaccaagcagtagctgccccaaaatagcatgagtcaggctcacagccagtgaaagaaacaggttggcttctgtattatttttgccttagcattaaggacctgtctacatgatttgaactgtctggtctgacagtcttatgtcctcagcagctcatttaaggaaggttacttcagctgctgaatcttcagggaagtcctgggtcaaagttggtttcagctcatatgtcatgggatgacccttaaatttcttaagttccatctgaactcataattatggtctgagccttgtatttaatgaactgcatgggcagagctgggaatgtgtaagtgtgactgctgcaatggtggttcttctgcagaaggggcactgctggtaacaatgctttagtcctgtggggccgtcgaagtcagggtctattttgaaaaatgtgacaactagatatgttcttcacatcctaacatctgacaggcataaaacatgtgagagaaatttgtccctctgtgtagacttattcctaggtccttttcccaccacagttcaggctagtcatggtatttatcactcccgctctgaagagctccagtactcagttttcaagagtctacagaggatggaaaaacagtgttgcaggtgcattccaaagtctacatttttcctgcttttcaaggattatgacattaggtgacacttcttacatgtagcattcaccttgctgtgttgatgtaaaacacccaagaaacatgccaatagtcttagttcacaactttgtagtttcaccaataaggccaattttctactatgcagaaaattcatgcattagtgttcataattctctaataagtctgtggtagaaatatgttaatctttttcatttcctcttgaagttcttaaattcctaagaaataaatctaggtatcttttctatttctaggattgaatttctagcaaatcatctagataccttgctagcagtgctcccacgtgccattgtccaatcatattctggtgaaaggaaatgatcagtaacatcagaatggaaatacagtatgggaacagaggagcattgctcattttgtaaatgttgcaagaactgatatctcctcatgtcgtcggagtgttgtacagattatgaaaacagtaacccttgagaactttctatgctaggaaggcagataagagtagattttaaaattgagcaaaatctcagggtagcaattaatttacatggtaagtctctttcagtgacaggctttagggcagttaatttgcttactaggaatgagaaggaaataaattatgaaagggctagtgcagttgccatgagataaaccttagagagcagttttctgtatagaattggaaactgagtatctcatggtaacagtgtttatatcacttgcttggagagcagatttaggtatgatcacaggacgacacctgtcttggcacttggtgtaggataagtgaaaacacatgggtagtctgtgtgagtgtggaatcaacaagaatgtttgggctagcatcttactgggtgtggatctgacagaactcaagctactgctgccacccactgctcctgataccggggaatggaagcatggctgaccagcagacccctaactctcagtgccatagcagttacatgagaggtgttggttaagggatccatcttggatccttttcatggcaccttggcaagcaaaaactgtattatccattgaagatgaagcatggagttgtctgatagacactggtgagtgaatgaggcaaactggaagctaattaactaagctaaagtgaggcaggctagttgtgcagaattccatgggaagaaggcttctgagactgtgtactttgggagcacgttccacactttagtgtcctcatccgtagccagcttatgtttcatgagcactgctggcatttactcacacataacgttgattcccaaactgatgcacagttcagcaaatggggtatagatttccatagactgctttagtctctacatcttctgtcctttacttgagtcacagttatactttcatagatgaaagtaattatttttttcatttctaattgtactcctgctttattcatactagttgagttcacattttaaatgaaattaattgatgtgcatgatttttgccagaaatgttatttttagacagagataattttgtaagcaaattagtatgatatatgcttgtatgaatcagatagttgtacaggctgtaccttactattgtatttatgcattcatactctgaatgagctagtattttctatcttcaaaatagtttattttttatataaaattatatttaccataattcatctcagatactaataaagtacccattacctgtgtgttcatttcattaattggaaaaaatactaatttataaggctacagactatagactgcaagttttcctagcataatcatcctgtattgataatgtttaagatatggtctttaaaaatctgtaataattacatttgagaacttaaatagtaaaggatctatcaagtgacatagaaaacatgctgaaattcttgttggccctttaggctttatgagttggctcccccaccccatcattagcattctctgcctccttatggtattatgtaggtgatgctgggatatagtttttgatgaatttgttaggagtatttaatgcttaacatttattcaaacatctcatatgctaacttatttactagcacattttatttacacaaaacaactactttttgtttctactgaatgacatacatgtagtcttaaaagatttataaataaatacattaactttcccattttagatcaccatttgcttcaacaagttcttgttatcactttatttagatgggattgaaaaatataggtgcagtaatgcaagtaaaattgatctgttgaatttaatctcaaggaccacattatggaagcgattgccctccctcctccagacataagggtccaaccactgttttttaagccttcctcagtgatacaatgtctggaaatgataagaccacattcaaatcagaatttaagtgtactgaagcaggcttgctacagggaaacatagaggctttgcacagtatctctgtgtacaaaagatacttgctctacaatcttggagatccacactcatctccagaagtcataaacaagtggaaggacagatttcatatataagtcctttgccttccttgtatatgccatgtgctcccacatgccatgtacacgcactcgtgtgtgcaaacacacacacacacacacacacgataacaattttctaaaaatggaaattgagattacttatcctactcccctttataaaaatctggatttctcccagattaaaatatttgttgcttaaagagaattgactaatttgtgttgttagttttattttactttataacaatagctggtgtttgttgacttatctgaaatagatagacttaccctccctcaactaatgaggttcatttcatttattcttaactgtgtatattagaaataaggaaggaaattaccatttgttttaaaaagagtattttaaatactcattaaattacatgggttttaatgtaccaactaaaggaaacattattagattttaattgctctgaatttgaagttgatattgaagtgaagagttactcacacggacctgctattatgtaatagggtcttttcacacctgtgtccaaatgtctaaaacaagtctaaaatactctgtatagttaacttgcttctaattttaaaaacgtcaggatggctaagttatctcagtcgttttcatttgctgtacgttagatagagttagcagcttctcagtgcttatgcttggttcccaagttgcaaacagagtcaccctgagctctgtctccgcatgatctagctctcgcagttcatagtaagcggctcagcgtaagttcctcccggctgtgggagataagagccatgaggactaggtatcaggttctctgcaccttcctgggaagagctgcgttgtgaggcccaggcagtcagcagaggcgtgtgcattagagcttctccctagtgaactggcacacttgattcccctctggtttttcctcctttcttagttccatctcttgcccttctccagcttgtacactcctggaacacctgcctcttttctatcaaattctttccttcatcaaactccccattcaccctcatctggctctggctgcaagtgatgtacttgatgaaatatgtgttgcacaattagaaagtaattatttttctcaagaagatttttaaaaagaaactaattgagtttaatctctgttctgtgtctattttctcttccaattccagacagctttggctttttacctcttgctgtggaccagcttcctgggattttttttttttacatttgtacattaatttaatattaaggttgcaatgacagagtatcgtaatctcatacaacttttgaaatgttaacattagtccaacaggcatgctataacatgtgtccctcacttttctttctagaactagatctccaccccttcatccatgttttggctttctgtgggatgcgtgaatggctgcccccttgtattttgttgcacttctccattgcttcttgtgttctggtggggaccttggtgattcttctcaattgctacctgagctctgtgctggttgctgctcatctcccagggtcttgtgctggctggtcatgtctctacctccttggcactgccccttggcagaagcgtggtcccttgttggctgcgtctaaacccttgtgagggtggggaatattcctccccctgctgctacgattgagctctgtgctgggtaccacagagtcctctacacttgctttcagttgctaaggcatcccgagctttggctgtggctcagtggtcctgctatccaaaccctaaaactttcctagcctcgacactcagtggtagcagcaggtgttgggatttctccaacttctaaggccttgggaggaagagagtggctgttgacacagacctcaaggattttcagagtacaccaggaaacttctccagaagatatgtaaaggtaagattctgatttctctaggaagcagtttcagaagcatagaaaacaaaacctctaagcatgggttaatgtaaatggattttcatagaggataccgagaactatgataacatagacaaaacttgtcctgcattgggcctctacttactgcaaatacttcttggaggtggggtggttctgggtgaactttacatttctattctatttttacccctattaaataattggcattnnnnnnnnnnnnnnnnnnnnaaataattggcattggagagtattttcaagtaattgtactcaatgatttgaattggaattttgaagcattttgtttctccatgttacaatcatcactgtatatttagtaagattgtttttgaggtttaaaatattaaaggataatgtagcaatcctttattttataaaggtacctgtatttgagatagcttgccattaatatctaataccaaaaacttattaaatgagtgtttccttacattctgcccaggaagcagaagtggagctctgtcatccgggtagtgctagagcacacacttgtgccttgttggcattcctgcagcatgttagagccctggaacaatgcaacatcctctaacctcttaggcctttctttctctccctttctctcttcccttccctcttttattattgttattattattattattttaaaaagaaggtcttgtagtacagctaacacccacccttctgaaatttactcttacagtccagccagccccagcacttcgtgatcttctgtctctcagtctgcagggctgggatcacaagtgggatacagtgtgggcctgtttacagtgttcctcatggaaaatgcacctgggactgggtaaagaatctggattaggtgctagtgttctctgtttctgagttgtgggagggcagcagtacaaaccatgtatgcagaagcacaaagcctagcacaaagccagctcctaactcgtttctaacttactcttcactgtgcacttcacaggcactaacccatgagctgattttctgatttcagccttatcatcaattcatagcatctttttaccttctttgattttttttgaagtatgaacttaatatcttaaccaatgctctatcattgaaattaaggctcttgtttagaaaaccaacctaaatttagtactaaaattaaaacatatacttaccaataactttacaaactgaaaatatattgaatagtatttatttctgttctgtcctatgttatattccctttagactgcaaagaataactaaatagagtgttttgaagtttttatagtgagttaaaatgcatatttggtttcttatgcaaaaatacaaaggtggcattttattgttcttattcttaatggttatgaatgcaactcatttagtcattaaataaaacaaaaagacttgatatgaagtccaaggctaggagtttgctttatgattaaatgtgccttgagtccaccccgcttacatttctccagaaatcttattgttccttaggatgagaaatcagatgaatataagaatgtgaactcttaaaaataacgaaaacttgcaaattaattatgaatgataatgattgcagaaggagcctagttttcctgttcatagtgttcatagtaagcctgtggtgcatggccctgctctcagaataaggcccagttagagtttctgcataactcaggtcagcttgaaacttgtgcttgtctgtcccatgtttcctcttcctttgtgcagcagaaacctccaaacagaggggaataggcagaatatttacagtagatgcttaattaagcaaatataaagttcttattatttagtttatgttatgtaataagaaagtcaaagtgtgcaaccttcactagacatgcccatgtagaaaaggaagaaaggacagacctgcgtttcatcagagcaactcaatggaaagatgaatatagggctctgaccagctgctgacatttttgtttatttataaagttttaaggctcaaaagcaaagcatttctatgtattatccatcgtgtgtggaactaaaagcttattggttagttttacagaattaaaataatcttttagttaattttcatattttataaattgcctaccttagaatcacatacattttttttcttgaaaacttgagatagggatgagagggagaagcgagggctggggtggaggggtaatgggagatcattttatatctgtaagacattttcagatggaattcgtcaatataacagaaaggtactcaagatactatttttattgcaccatggggaagacgaaactgaggctttatgaagttgagcctaccatgctcttcactccagggctcactgacgccagaaagtgtagctgcagaagctgttggcaggatcattgatctttgaacattctgagcatctagtgcccccttctctcctcatccttggaatagcacagtgccatcaaggaaaatcaacacagcccccatctaggtcattctaggctcttattctgtatctggctttgtgaccttgggatatttacttacagtctttttcagctgtagtctcactctctctaatatgtgaataacattatctccttgtcagagtttttatgaagatttaatttaatgaaacagcttgtgccagtacttagcacagtggctagcataggaaaatggcgattgtgtggatgttactatgtaattttcccaaggtcacactgttagaaaaggattgagtcacaactgaaacacaagtctctctgaataaaatagtaaataaaacgggaaaagatacaagtacatgcacacccagtatgctgcagaaacttcaaaagaaaggtcatacttccaactaataaaagatattaaatgatacgtatgcaaaccacaggctcaaataactactggcttttattaacagttgacctagatataaacacctctttaaaagcatagtgtctttatgagattgacaggtctggttagtgaaaaccgtttacagatggataggtcttccattctctaagaaccaaaaagttgttatgtcatgacatagactgtcagtgggaagggaggaaaatgtcaaggaatgaacgcaaataactggagaggggacagaagttctttttcattttgcctgatgtttgtttgtaacactggagtgcccccggtagcgagaggaatgccagttgcacagatgatagaatattcttatgatctttattctctgaagcagagcagaaactagcagtgtctgctcgtcctgaagagagactcatcaaagctgaaatgtcaggatttggctttgaatgcgatggattcaagaggtgtatttgtttttttttcagtgaaattcttgctgctctttgacatcctttactagacttggaaaagcttgaggccaggaatgtttatatatttatcgatttataatcttaacacggtgtctaggaaagaaatggacattcaacatatgcttaattacatcaaaggaaatgtattgcagaacagagtaagaagactaacgttagggtctaatggcaccaaagggattagaaagcaaggactcaagactcagtctaaatgcaggggcaaattagggcaggcgcttcagcgtggggagctctgtgtttgtattttttggtgcctggctaaggatgtagaagaactaaaacctgcagtcagctgttagtgcaggagtaaaatgttcagcatcactcatgagcacacagtgcaattggagaatagagaggtaaagggactgacctatactttgtttatgtttttcatgccgaaaagtatttctggccttagaactcaatttggtgcccagagtatggagggaaaaactattagaaatataccattggtgtatatcttcattaagaaattctgaaaatatggtttaaatgtacaatattgtaaattgtaacttgcaacacataaagtaatagagttatgtcgatgacagagaaaaagtataattctaaaaagctgaaatacttaatagggaattattggaatagcattgatatttgttttgtaataaaactctcactgatctttttatgtttattcacagatatagtaagggaaaggcatctcttatcctttatggaaacaagaaaacttaaaagaacaaaggaaattgcttcattttaaaccgaacactttgtgttgatacaactaaaacctcaagtcaaaaactgaggctcctttgggctgctccccttcccaggaggctgtaatcacacccttcactttctgtttaggatttgtggccacacaccagtgcataagggccagcatcattcactgacaccattcacaggagggtttccgttgcatataagaggcacttgagtgtttaggctccatgcagtcagtccttggatccaaatcctagcgagtgtgtgctgtcacccgaaaagagcatatttagaaaatatcagatgagagtaaaaatcaaaccacatgagcaaatgttccaggaacatttgtatcttaatttgaaaaagaccatatgttgcagcagtacttcagtaagattaagatagtgctgaactttccagaatatcatcagaacaaacttaaattgactgcacatttcaaaatattttgctatacaaacatacatggatgtgaaggtaaacaaagaactgagtgtgaatgaagcaaacttagaactaacacatgcaccttattttatgaatgtgggtgttatctgggccgttattattgatgcaaatgtggctgtatttaggcctttccattttgcttttggttgtctctgtttgaattaaatagtttcaatgtggtggcaaggctgtcttacttcacttaacccatggtgagttttctttctaactttgtttcttatttttatttacttgcttttagtttttgttggcagtttgctatttgtgttttaacttggctataatttagaaatattattgaagtagtacatattaactaataaaaatcataaaatcttaaagtctttcacatgtgaaaacctcttagatatatagaatgcaagctcccccctcctaattctttgtcaaagaatgtgttcatggcagtttaatttgctttattctgctttgttataaatataagatagcatggtataaataaaatcagtgaggcctcttactaaggggaattttgtcatgagaagaaaaagaattttgtcatgagaaggagaaggtcaacatattctaaagtgaatataaacatttagagtatataagatataaattacagaacttttatgccatttataacagttagaaatgtttagccttgtggttaagaatatcagttccacggccagagaagcctggaaaccctggatttaccatgtaatggttgtgccgccttgggaagttacttgattgtgttacgttagggaacaccagattttcagtctttgcaatgggtataatcctacacgataggattctctgaggattaaatagaagtttgaatcacatcaaaccatgactagaatactccaaatactgactaagaggttgttttcttctaacttcttttttaataagagagaactgagggaagtgagtctgagatgaaaaaaaaatgaacataataaaagctcaacctgtctagaagtcagacctgtacagtagcatgagttcatcatcacgggggagagagacagaaatcaggccaagtctgtgacagcgcttgctgttgtttcaatagtgcttcttggaaaaggttatcattcccccactgaacttactcaaggtcagccctgcaagcttacatcacacagatggcctttatattttggtgaccttataaccctgaatcttcagatacttcacctatcacaagccagatgcattaattttggaacattccttatttattttctccacattgtcctcagttttctggtgaagggttcttttatagatttttttttgttgtttttcatttgctattgtcatttggcataagcatggtgactatcacacttactacatatataggactaccactatttttcatggagtaacttgagtgttagtttcttattcgacctcttaatggctaatttcaggttaggaaaacatggttctgcagtaatattttgaagtttgcctaggctatttggagccaacattaatgtgtatttcaaaaaatgtagattggccagaaaggagttcagagattcttgactgaaaacactgacatagtgtaagtgtccccgtctgctgtgttctctgaggccataacagaaagctctcgggacaacttggtgcagtgggtgtggaacatgggtcatccagcctccacacatgatccatccaaacttgagaacataggcttttatttttgattttcaaagtctgatgttgaaagattgagcttgtttcgtatatatcagtataactttgcaattattctatcatgtttgcaaatgcttcatagaattcaactaataaaaaacactgttaactttactcatgttctgttaagattgtatcatagacacagatcccttgaaaagggcatcacagcccagaggtagttaacttagaaccattctagaacaaaaattattttaaaaatatttttactgaggacaaagaaacatttaaaataaacaataaaaatttgaagctgggcttagtggcagtactgtaatcccaactatgtgtgaggttgaggtaggaaattcaaagcctgcattggtctacagagcagattctccagcctgatcaacttagccaaaagccttgtatcaaagttaaaaataaaatattttttaagtgttgaggttagacaatgattgtttagtatattcaaaccctagatatgatacctacaacccctacagacacatataacaacaaaaaaagaaagaagataataacccagagacttgattattttaaaactaacattatctttgtaaaaataatattttatagttccttacgttgtattgaaattatccttctaataatatttaaattataaattttccattttaatcctacattgcatttaggtttcatattttcaatagtttttttttctgctagtagttcatatatgctgattcatttgaaggcaggttagtttctactgaaggttttttaatatatttggagtttttgaaggaatccaagagctttagagtgaaggagactggaagtcaggtaggaagacaggaagctaagcccagacttggagtgagttctccagctttctaagggagtttgggttcttcagagtgctgccttaatgactgtgtcttctggggctcgcccattcttcttacccaagctgcttagagctaatgatctaccccatacagcttgtaaagaactcctgctcttctagaagccatgcagagtgagtggaggtttagaagcaggttcaagccagtttttcccctcagctttaccatttcttatgagaaataaaatggaaaagataattatttttagaatttgcaatgtaaattttccacctgtttagaataaggagaagacttccaatgctgttttccattgagctaaatcatatatgtttttaaaagaagacaggtgatatttaaaatttggtcctaaggaatttcacagacagagccatctgccccaatgaagaaaatgtatttttagccaacactagagaatgtaggatgtagtttcctaaaattgctggatacgccaaatgtctgttaatgaataaatgaataagcaagtaaaaatttatctgggtggacaaatgaataactaaatttattagttgtgtgttcatatgcttctttattatttttaggaaaagaactcagcttcaagtgctgcaaaatttattgaaaaatgttcaatggaattcctcgtttctgtgtggccattgctagtttctgccccagggccagggatgtttgattgatggtgcttctgtaggtggaattatcctgcatgtgtagaggttttagagtaggacaagaaaacacagatcctaagcaagggggctattttgaggaaaggaaatactagttcgagtgatcacagcctaagaataacccatagaagtggattaataagatcacactggttgaaaaggtattaatgtgctgtgtcctgtttcatttggtgttggtggcaattgttagtaaaggaataccaagagcaatactttttaagcacaggtcgagattacagattaagtattgctgtttagagagttgggcttattgagcatcttaggacgttgttgaaataagactgactgcagaaaggaaccaaggttgaatgttgaagaagagattctgctgagtgtgtattagaggcttagcataggtatggttatttgaaatggagcatatagctatagagctctgacaactcttgaaacacctaaataacattttttcactgcttaccatgcaggtatttcaagctgttgcccttacttagcttggtatagagttaagttttagccaatgtaaggtactggtgttgtcttgattcatagctgaataaaatacttagtattgaaaaagaacacagaaatcattttagtaactagagtgactgaaagttcatttctgattactctaaagtagtaatttaatgtgacatttcactataatatgaaaaaaataaaaaaaagatgctttgttgtttcttacgcatcctaataactattcagttcctatttttcatagtcataaaatcacacagttcactcatgtgttatgtcagcaaagtagacactgctttgaaaatagtagcccttgtaaagtaggtgcaggacatgttttgtattatattaatgttgcttctttttcaatatggtggtaagaaaaaggatcaggtaataataacccgaagggtttgaatgctgataattaggcttggaacattgtctttgttactattagaaatattcataaaaattattgagaatttaatacacgaatacagtatttataacattttcctccttctccttcctccaatttttctcatctctctttcacgtctcaaattcatgacctcttatttttaaattataattggtgtgtgtgtgtgtgtgtatttctggctgacctcttgacctcttgggtcctcacccctagagaagactgagtctcacctcctcagtaacttaattccctgtaggtctttcagggttggagccttagaaggtttcccctgtttgcattgcatatgaatttggtggtggcagctcttagataccgtttaggaatagaagtgaatgtcagctgcaaacatagcactacggagacagctgttgagaacagtgggaccatacttgctgaagaacagtggaaccacagctgttaaaggaaagtggaaccacaactgttgaagaaaagtggaattacagatgtttcttccccactgagtaaggtcgcaggcatcagtggagagccaaagcatgaaaagtccctaactagacaatgtgggtgaagttggggctaatcagaatatggagttgtggaatttgaatttgaagataaaccagacactgacttagagaaaccaggaaagagattctgggcaataagattgtttttcttacattatcaattcaaatctttggggtctgtgtccttgtctgtgtgatctactgcctctgtccaaactttgttaatggattgctttaaatctctttacctctttgtttgctttatgtagccccaccttgacataatgttgtgagacagagggcctgacctgtccatacacacactggctgaacctctccattcatgggttctaatggatttcagacaccatgagtgggagttgactaccaggagatgagcgtgcagggctgttccacaaccacaatgtaaggcttcgaggctacttacctaagcaaaactttgtagcagtttccaaaacaaatccttaattcctagtgaataagacccattattatatcagacatttattgtcattgtcttcagcctgtactcaggaaggcacagaccttcactagaatagttaaatttatatgttaggctaccttgtggtgaaagttaaaaaattaaagttgtgtttgctgtaatgtttttttttcccaagaattaaaaacttgttaatatttcattataatttagtttcacaattgagatatatttctgaaatcttaagaactcctttgttaatgtttatttatatatttatgttatagtaatgtttaacattatactcttatgtgtaaaaacacaggggaggagtctaagatggttggcttaaaggtacactgctggtatttgagcatgctttgctttcacacacattattatagatgacagttgtactaactgtagttcagggctacataaaatggtatttgaaatgatatttaagaaatatataggtgatgcagcacacaaagcatccacactggccttccatatggaaaagcctccttgcaggttattcttgttatatattgaaccccattttgagctttagaagtctgtgtttgataccctctagcattattctgagcttcttcatctctactgatacgtttcttgttgttttttttagtttaggaaaaagtttctaggcatagactgtctactattttcacttttttgattcaacattatatttaaagtgaaaagtatcacgattgtaatttctaaattatgtaaattacaggtttttaattttagacacttgattttatttccttgcaaaccctttgttctatttctcttcaaagtagtaaaggaggaaagatggaaagagaagacaaaatagttagcatgagtaaagaaagctgactatattcacatacacgtgttgctactgattttaatcacttaaaatactgattgatcttcagtgtcctgtcactgcacaaatataattcctttcagatgcccctgagaggtcagaagaacaaaaggccctttcctgccctgggcagtgagacattttataaagtaaaacacatctttgccctggcttacctctctcagtctttcaaccactctcttgactgttctccggcctccctggagtgttaaaaggtgtttctcttacattcctgcttccacattctcttttatctcttcataaaaccttttctgaatgaggacctgcatcacagtcagctcttctgagagcctctgctgctccgttgctcggacactgagcgatgtttccacatcacatcatcccacattggttcctagtgtaagtacttacctgagatgcaggtcggactgacactttgtggtgcgggaatttccttattctggaatagctgcttagtgttgacattaaaatatattttatggttctttgggatatacatgggcagaaatgttctgggctatgtcagtaagtctgtgtaagtcagctttgtgagtgacaacttacaacaaagtggaaatgtaagccttgtagtcaagcacagacttcacctgtgaatgtcagatagaaatgtttcctgttagcgtgtcagatacagcaagctgtagtcagtgagcaggtctcatcctaacatcagcgcttgactccaaacagtgcatgtctttgagctgtcaggtgtgcactccattgtcaggggcctcctagatctgaatgtgtcgtacctccattgaacatgcaatgttgagaatggctgaggccttgacagagttgggagaagaacagtggcttctatttatctctgctcagaagtgaagcccccatttctccttaggttgtctgagctagaattatcctgtgccaacttaatgcagcagagactgggagaggatgtgttttgcatgcagagatatagaggaaatgccaagaacttgatataggcactgcatttggtttctcctcttttccagttttcattaaaagggttcatgattgcaaggggatgttatgaagcaaatgctatgtggccatctcaagtaagaaatattaattctctggaaatttattgaattcttgttataattttgacatgttaagcactgcagagtgtatagattctagcattttgggctagtagcaatttgaaaattgaaatgtaacaaaatacagggtttaccttgcaaattcccccaacagtatgtactgtatcagtttgagcagtggttctcaacctatggtttctgaccctcaaagaccatgggaaaacacagatacttacattactattcatagcagaagggatattacaaatacaaaatagcaacgaaaataattttatggtaggtgggcaccatagcatgaggaactgaattaaagagtcacggcatttggaagggtgagaggcagtgagttagagtttgaggccatactctgttaggaacgaacaggaaaagcagagaggctgttccttagtttgagtggaggaggtcaatgcattgctgtctagataggagctaatggaggatgggagatggagacaagattactgatgcatgcataatcagaagccagctgagcaggctctcttgcggtctgtcctgtgtgagactgtaataatcaatgtgttcaacttcctgttcttagggctgtattgcagagatggctgtgctctgtgttaaaacattatatatttaagtttgtggatcatagagattcatgacagcaatataagacctttccatgacttatttgtatatttgggttttccttattctttaaaattatagggcaaatacctttttttttttttttttgcaacagaattttcttgattgaagcaatgtggatacaagtgaaattataaagggacaaaaaaagaggtgtgtgtgtgtgtgtgtgtgtgtgtgtgtgtgtgtgtctgctccactgcccaggagacagaatggcatcttgtgcctgtttctgtatggaggtcagaggtctaggatcaattcagcatttattccatgagcctcagcccaccgtacttattttctaaatatcattctgtcctaaattacaaaccttgctttgctatccttctacgctgctagtagatgtgattatagtgagccccaaggcgaggcacattaggatctggagtaatggtagctattgtcggggatgctatttgtgaccaatttttagaagtccgtgattatagtcaagtccacccctactcattaattatagattccttgattagccacttcacatcttggagctggtttacttacctctagaataaagtagcatctgccttaattactttcaatgactgttgtgacatatatagaaaagaaaataatagtgtgttgtgtcaccaaacagttgctgctttctcagtactacattctcactcctaagaggttctcatgagcaagaagttcagccagacggttgtctgggaaggcactgtgatggtttcacttatgactaaagttctaggagtatgtgtatatgtgtgtgtgtgggggggtctataataggaagaaagtatggaggtataacaagaggaaaggcatgtagacaacagtgtccaaggaatggaagcttagtggtaggtcatccagttttctcacctccccttcccttcctccagaagctgttcccacagaactgtggctggagaccactgaatgagggagtgaagtgcctgactatggagatttaagcttcagtgagaggagaaaagatgattgtatcctagctgcacagagttggatataggttggagatctggtgttacaatttagccaagcagagagagggggaaagtcacattgaagtgtgaaacctggggactgagtggtctgtggggcagaaaacagaggtgggagtaaaggcagaagctcaggacctgataattattctttttaaggtgagaaccaattgagatggttgtaggagtgttaacgacttttcctttgattcataatgattaaacatttttaaattccttcctggttatagattgaataataaaaaaagcacaactatgtcttttctatcaaaggatctgggtttttgaaaactaataaaattatagaagtgccatttgctaaaatcacactaattagtgtatttgactaatttcctttgaaaagaaaacaacgtgactcattgaaaagctagatttacctctcataaacaatgactaaagtcaccctggagattaaaacttcaaatacccgaactaagacatcttaagctgctacacctgttctgtcatttgcccgaaactacgtgtataagcaagaaagggggtttgctttccggtctttgctgaccttacagagactatatatattttgacctagtcacttgggcaggacaaatcacattgcaaatgtcaagaggcatccaagcctttttccttgccaaagatggttcaagtaaatttcgataaataaataaatacaatgtaactttctcacatttttcagtcagtttgactttgtcacttattgtcacttcggttcctgattgctgtgtggggatagatgcagtggtacattgcttagcattttccccttggaggggagagaacggagctttgtccagtcagctgattactgcggggtgaatggctcacgttgttattgatttcatactacttccatagggaaggcactggacctggagttggccaggggtgcctagtaagctatggagccctgtggactggtcctggcataccgcaggaaggacaaacatcctaggaggatattggagctaaggtgtggctttaggtattttcaaaggtattgctgcagtggttctcaaccttcctaatgctgggatcctttggtacagtttttatgttgtgacctccagacataaaattatctcataactctgattttgctgctgttaggaattgtcatgtaactatcagataggtatgatgtctgaaatgagacccctgtgaaagtgttgtttggctactaaaggggtcacgattcacaggttgagaacctcgggttattggctgtgatcactgtgttccagtggaaagtttctcagttactgaccatgattttaatcgcttgaggagagtctagactctgagtaaaccctccctggcttctagtacctaactgccatttctgcagttagactgatttcttaatataaacgtctgagaatagttcttttcctcggttcatcttagaatccattccttgcgaggcttctctaattaggtgcttctgtctcccagacctcagtagggattcctcttcggcgtgtctccatgtggttcccactatgttctgttaatccttcattttctcatttattattttaactactggctattttttcctaaatgttaccttgggaagttttaaacctgttcagaaatgatgtgtgtgtgtgtgtgtgtgtgtgtgtatggcattcatgtaagtttactaattgttaacattttgccactatttttttttactttagtgtgcatgtgtattatgtgtaggtatatgtgtgtggtgtgttcatgccatgccctgcgtgtgagattagaggacgattgcaggagtcatttctcttgttttcaccgtgtagacttgaactcaggttgcaaggcttggcaccaagcaccctccagttgacacagctcacgagccacattttgataatttgtgtgtgtgtgtgtgtgtgtgtgtgtgtgtgtctttgaaagaacaaagcaatacactcccatttcttttgttagttaactttacccagatgctgctatgtttgacttagttatacttcacaacttttgaaggtttcctcttgattcatttatttgtcaaacaattagagctataattatcaggtcctgacgctaagctgtgaagtaaacagcctgactacaagaaggggaggggggcagagacagagacaatgctgggttacctttgaatgcagttagaggagcccatatgttcttctctgtcattcatccattcactgatttcctttcttccgtcacccacctttatcatttacgttgtaacaggctctttatgtgctgctaagagtccttgactcttaagagcataatctgtgtccaagagcagaatggatatttacttatgcggggtactatagaaagggagacaagatttgtccctccgtgtttccgacagcgatttgtagtaaggaggaatgaactaagcagataaggaaaacaccattgtatttgaagccaaagaagcatgaaacatacagaatatcctaaggaaccagggaagctttatgcagagcagcatttgctggggagctgtcttcagtcaaggaaaagccgcagcttggcaggtggtgtggcagagatctcccacgctcagcctaagtgtataaagcggccctgactgagcctaagggtgatgtagagcagatctgtatttccacaaccttaccctcaaaacaccgagcaaagggctgatcttgccgtttttaattcttggagattaagcctgtttagtagcagccaacgctggtattacctagtttcgttactttaacaacttatgcccttttacccattcctgaggagctgttggtaactgatagctgctgcaggagggcaagccattcttcattgagcctgtgacctctgctgggtctccagttttccagcacaggacctcacaccatgcacatattggccatactaattagatggaactagtgggtgttgttgttaattttctgttgttttgttttgtttttaataagaaagcatgaacttggagagaggggtaatgagaagctgagaggatatggaaggaatgggagggaataaatgaggactgtgggtgcatatggtagtgtttattctcagagagtaaaaacaacaacaacaacaacaaaaaccccacaaagttagtttcacacctacagtaagaaggcataatgaacagtttacagttgctgcatttcgcagggacatagcattgccctgggtttctccgtctcagctctgtcagtgttgtgttcataatgagcatttgtcctaggtccattccttgctttgtagagtgcttggcagcatccctgggtggcctcttcccactgcatgtcaatatgccagcagtagtttcctcaaacctccagctgtgaaaccaaacatgtaaagatgtccttgattaaaagctaggcacttaattaaaaaaataagaagaaagtaggttacttaccttcctgtggacttactgcatttgttaatttcattgtgttgcttttatcatagtgtgtgtgtgtgtgtgtgtgtgtgtgtgtgtgtgtgccatgcgcacatgtgcatgtctctgtggatatgtgtgtttatgcatgtgtggatgtgtgttgttcatgtatgtgtacttgtgagcagatgacattgtctaataagtgttatgaagtttttaacagttttaaagttaaagtatcatgctggaacacaatatcatggaaaccaaattaagaatgtgatgctctgtaacagctctacatgttcacagaacagcagcagaaaccagtaagagcgaggtcaagaaatagtcctggccactcacgtgtaccataccgggatcagacatttcttttaaaattgcagttttatttaaaacaatatttttgtctatattttgaaaattattaataggaccaatgggatctgcagatagcatcgggggatatgaattgaagttcttatgcagaccttgcatactcagagcccgttctttattctaaagtgttgacttattaaactcctggattcagaagacctctcagatcagtgcttcttagccttcctaatgctgtgactctttaacccaggtcctgtgttgtcctgactctcaaccagtaaaccattccattgctacctcttaactgtaactctagccaggtgttaagctgttttacatcctttatctcttcttccccttcttctctcttcctccttcctgtctaggccccaatttgaaccaaactctaggcccaagcacaccaggcagcgctctaacactgagtcacacctgacccagcagtactcattatttgatgatcactcaaggatggcctactccggttcttgtgataagaaaatgtcagtatttgcccttttgtttctgaaccagtttaaacatgtgataaattgatcacacagctaatggcccaggaaatacaagttatatagacacggtaaccatgttctatccaaacctttttattccttttttctaaaatgggtataagacaagtagtttttttaatcacaggatatagttttaatatttctttttttttccatgtataattctccaaaccgaattcctccttccttttccttctccatctaagccactgcttctcaacctgtatggtgtgagtcctttgggtcctgtataacagatatttacattacaacagaagagaagcaaaattacagttaagtggcaatgaaatcattttatggttgaggggtggtggttaccacaacatgagaaactgtattaaaagctctcagaattaggaatgttaagaacttgtgtgaggagtatagccgccaatgtagtattctggcttagcattgcctaatctatttatgatgatgatgatgataatgatcgtgatgatgatgtaagattctgtaatacaaggcacacaataacaatgcacacaatgcagctctagtgtgccttaggagaactttatgtctttattatctcagcgattccttgcaagggcactgtacagccctcctgacagctgttatatccctgcagtttcacaggtggagtgaagggagattagggaggagaggctccttagaagctgggcagcagaaacccaccctgtcagaacacaggaggaagctgtgacaaacctgccatcccagctgctggagtgtccttcccagctgaggatgcttaaaggacatttgatttgaagatcggaatccacacacacttaaggcatttggtttgaatacttttcctgtaagcttgttttctgaactcagtccttcgaacgtagctctgcacgacatgtttttaaactggctgcactgggttttggcgaaaatcctttgacctgagaggacagagggtgagtcagagccggtggtgggctgcagaagaatcgagagcaagcctgtcctagcagggaaaggagtccagtttccagtccttggtccttccttttgtgggctgtaataactgggagctgtgtgtgtgtggaggtgaatggacaatggctcctgctgttgttttaccacgtgtcatccattttatgccttgactgagaagctgctaggtgacttaactgctcctctgtgggttttgcattcagcacctaaggacagaatggcttggttggcgctgtcactctcttgattcagggatgtttaggccctttcatttccaaattttgatacctcacattgcatatatgagcctttaaatcgagtttatcttttctgacagacagagaagtaactgaaccatgtatccatggtaacttggcacatcctcagtgaagttctcttgttcttgggttcttttgtttttcaaaaactatgaattctgaaaatggaaaggagaaaccttttgctaacttcacttttcatcttaaaatctgtttgtggacaagtaatatagctgtgacatgggtaggaatggcattctgatattttaactgtgtgtgtctgttaagcatattttctttttattttgttacagtttttaatttttttgactttttgtattaatatgctgaaacttatgcaaaaatataaactagtacctgccacagtactcggtatctaggttcaagagtttccaatagctcttcattgcattttgagtcagcgtgacacacagcgtattgcggatcatttgattcacaaatacttcggtgaatgtatagatgactaagatttcttccaaacttggcggaaaaacactatcattgtacattcctgtacacataatgtataaatgtcaactatacattagcacgtcatcttttgaaagcttataatggcttaaaattttcaatatattcataagtcactttattaatcagatttttgatcaacctgaatgacattgtgtgtgtgtgtttgtaagtagtattgaattcagaatggaaactttcaaaggcataaaaccagtctgtgtcatgacaaacatgtaaaaattggcaaaactacacaagccttcaattcttgatcaacaaactgagataattgtctcgtactaataaaaatctttcattaagtcttaagagctatcacacacacacacacacacacacacacacacacagagagagagagagagagagagagagacagagagagagagagagagagagagagaatgacttcagtgattacagtgaagctaagaggcaggaggatctgagttcgaggccaacctggtttacatagtttcaggacagccagggctacacagagaaatcctatctcgaaaaacaaaaacaaataaacaaacaaaaatgctaaataggctgttaatcatagcaatctcagccagaatttttcctgccacttgattccagagttacaatattctaaccttgaatttaaataccatcagatgtgtctgattccaagacagtatgtctctgatttcaatggcttttagagcaggtagacagctttcactgagtgggttttacaagttgatctttataccacttaattttactcaattttaatcccttttaattttgctatgtgagtcatcttgcttagtccttcagattataatgcagtagccttaccacctaataagaaggcagatacatttccatacctgaattaaactcatgcctcacttatttttaagtggtctgttggagaatgaataaagacatttttattcattgttaaattctggaaatgaatcagtttgacgatgggggcttttctacattataacagatacagagtgcagtttaaatacataggcacaccagagaagcaaatagtgcatccaattaggaagctgagccttgaatgtcacagacatcttttgttattgtttagtcactaagaaaatgagaggcatcagactaattgcttcctgctgtcagttattttgaatggtgaataaagacagccacttctttacattgccttcatttgctcagctcattactgatgctgtaatagaccactgttgggaaggaatagtttgccaaatattagattattttatgtggtaaagagaataaattgatacagtattcataattcagagatggaattaaagatgtattatatgcttactcaagatgaccaaagctgtaattccaaagtaaaagtgcgttagacactgtttatatgtggtctgctaagtgatttgattaacttagggaaaatgttgatttttccagggaaaagaaaacttatgtttccattctaaaaatgggtttccaagttaaaaaaaaaaagtaatgttaaaattaagactcggtgaatattgcaaatgaccataaaacagtgtggacagcttttcctgtctttggactcaggactgttctatgctttcttcttttggttcagcagtagcctgttgaagctcatgctaagtgctgagtcattgctagtgtaaatgttgtcactttgtccttcacacatagactttgtcaggatgaacatctcctttatcttttttatttagaaacatttcatttaaaataactataaattataattaaaagttaatacccgaagaccatacacactctcatttctattttgaattgctgtttggcgttgcaggttgtgtttttaaaattgcaatgaaagacctcactttgtgagatgatttggatggcaaagggaattttttcatttacatctttttttttttttcttttcaataatggtcactggcagtggtccaatgcagacaaaatgcctggagcctcctcagcagagccgtcaacacccttcctgcagtcagtgtcagcctccagcatctctgcagtcgttcatcagcactgtggcaaatcactgctgtagctccatcccatggcgtgtctgacatgtcctggcattttctttctgtgccagacaacccaaacttagggtatcaagatggaactgaaggaagtagactggaaaatgggcacattgtgattctcagggaagtgaaatggattcgtaactcatgaataaaatagggaaattttactaaccacgtaaaagttttcagtgtggacctgagcatgcaaaagcagttagaggagaacttagcatgcttatgcctttaacagtggatagggccatacgcctacctcctgcccacagctcccctttcagaatagggactgggatgtcagagcaactgttttgtctgtgaaccaagacaagtggcatccattgtgagataaaaaataagagtacttctaagatgaagacatgtgcattgcaaggtggtggagttctgaagcctcctttaagaactgctcttgatactctgtggtattatgtcttccttgtataaagcattgacactaaaagactcctcttgtcaaccagtgtataatatctgcacaatagagtgcagagggctgacgtgaattccctgaaatcataatgtgctgcagtcagtagatcatcagtcagaccagaagagcaccgctgattacccactgaattatgcatacaaatatttgcaacatcctgagtaattaactcataaaaataaacaattaccataatggagattgagtgaatttccatatattttccactcctaaaaatactatccagctggttaatactattatatttcttaaagagaaatatttagatacagtttttgccacatgtattttccatggctttagaaaaatctcagaatttcaaacgtaaggatttcctgaggaagattagtttctattaaatttttctggtatatacaaaacttaggtatttgactctgatatctgagaaaaatacttccacattttgtattgagataaattaaattgtattttatctctatggtgcttatcttttgcctaatacagtgatatcattctgtatctgtagttaagctgctgtaaatgaccattttcgttataagtgctaatgatactttttttggacacctgatagctaactctgcttcaggagcaaacggagatgtttacactggactcacttgctgactcatggctgctggagcagttccaattgtgagatagttacgtagacaatcctctgtcctatatttgatctcgcttaaaggggagccaaactctttggaatataaaaggatgttttgttatatagtcctgtgttttcaggaataaaagcccctgtaaggatccagaggctacaagtcacaaggccacacccacctgctgctggcagatggtctgaggggtgctcctatattgtcttagggaactctggtccttgtgcctggagtttgcaccccatctctttatatatcccctcttctcacttcttgtttcctcttccccttctctgtttcttcctctgtccttacagtgtgattcaaagcaggatttgtggttggtgattcgcatgcatagtttctgttctttaaaataaaactcaagtccccaggagtaggggtcatgaagccttagaagtgaagctgtcccaagtcattgaaacatcaacgtagttagaagcaattaataaagaatataactgtttttcaaaaaggtattcattatttgtaggatattataccttatatataaaattgtgctctagtataatgttcatttcactggattattagcctggccttttgtgcttatgtgcacctttgagtcagggccgatttaaactatctactccttgttttctgtatgggacacagagacttgtactagggataacacagagaattagtatctgggacccatggagtggtgatagagtccagttcagccctgccatgtccacatagccatagagcattggcaatttagtttgttttcaattgaagtctgccttccttttggctgttatttgtggatagaaattatgccccctgagaactgtgaagtcttcagtgagctaatgtgtgtgcagcatgaaagccatactcagcacgttctgtgattgtaaatatatgtagtaagtatctgtcccaaatcaagttgttgataaattggaaacctgtgttgtagcacacatctttgtatttagagatcaaatgcatgactctaaatccttggcatttcctcatttagatttatctagcacttgcacaccctaaatgtttctgtgatcagatctgtcatattaatcagctggttattgcataaaatgtacagctgtcaaagataggcacaaaagcaaatcacaagaatatctcatctgtgttttttctatcaaaatgatgctgtattatatatgttttagatagatagatagatagatagatactgtagtatatatagtgtatatagtatatcaatatactgttcttccaattctaaggcatcactttttttgatagttaaatttatatttgactacagcatactacaacctgtctgcattgctagtcctattctgaattcacttacatgttcagtagtatatacttgacttttatgtaataactagacagttacttttaagattcttcagttgtatttatgtctttggtttttatttgttattttgtttgcttgtttgtttgtttgctatggaaaataatttctttaaatctttcccatgatttttttataacaattcaaataatatcaggaaattcttcttgacatgctatgttaagccattactaagagttataatacatgtacaacagagtgaacactcttagcatctacctttctaattgtaaaatgtttatgctacttgtttaacatgtaatgaataatttcaaattaggttgaaaacaatggaaattaagtataaaagcttgtgatataaagtgatgctgacattctggatagcatttgatcattctgtggaagaatatagaacagtaacaatgggaactgaagcagcagttactatagttagctctctgttgccagagcatctattcctacagggtttcagctaggcagtgaacatttatactgagcaattacttattgtagcatgtgtcttgcaatagatgtttcctatgcagacacagcaacttttctgagtagttccaaacttaaagccattttagcttttttcaaattgttgttttgattttagtttatattttttggcaaggtgttgtttgttttcctgaaagcttttcaaattgcttagaattaccattattaaatttattagaacatggattttctaaatggcatttacatttaataattactgcaactaggcactgaagaatattgactctggttggggaaccctccagataatcattgatgagcaagtgtaagcccctaagaaggggctgggagagatttggtgctttgcctctttgctcctcacccagggcactgggaacttgaataagtaagatttaaatacctttatggattatatcaagtcttttttctgggtgttaccgtgttttcacatgatatgttctagttcaagtttcacacgtttttctgttttaaatctcctcttagttatttttattcatgtgtatggaacattgtgtaagtctcaacttactatttttcccctgtaaaatactggtatgccttaatttatcattatgtagaaatactggataaatcaactatttgagtgcacattcccaagtaaattttgtatatgtgtttggctcggcttctaatagcaagttcttagactttaattttagaggctatactgtagtcaaaattgagggttgcttgcatcacgttaacttcgcttgtttttgaaaaattctaatggcaatgtatgtatctgttccaaaaactagagtctttgaagcccatttgtattatataaaggggaagtctgaattccagctacatcccaatttgtttgtaaaaagcttgggttgagagcagaccatgtgtctttggagcattgctgttacctgggaaggagcaggtcagggacctctctgtttcatggggatccgtgcacttaaggtggggattgtaaagcccagggtttcttttcacaaggtggatgaaaacttttgttatttcttgtcaagaggttgttgaatcagtctctgttcttctgacatcctaatctgcttcagtgcaggaagcagggtttctagggacttccgtggtatgtttgttaattgaccactttaagtaacgaagtagttagtgtaacttagccctaccttactttctacaaggaaagtatatttaggcatgtttagtgagcagaagtgatgataaccaagtcagcaagcctgtgcaccaagtccttcatctttcaccctacttggcaatcagggcctccttccattttctctctctgatatcagacaaatggtgggagaggaaaggaagctagctttccactcatctgatccattgctaaattaaatatgttcaagaagttataaaaccaaaggaaactttttctttgccaaaatcctaataaactatacaaaaacatatattgtacatccagtagttgttgcttgtttgatgtcaggtcatgtagcatcaaaggggacaaaagctagagaaagcacattgtgctgggtagaataatgagagataaaatggagctagggtttctctgcctctagatcttcaagtaatctgaagtatggaaaagaaaaggaaatgttaaaaatctaacacggatgaggctcgttttaactttacggcgcttcccatgtgttacacgttgtcttccatggcaggaagctcacaggccgcgtctgttctgatatttctccttgctgcatcagtgctcgagcaagggctagtcttcccctggtgtttccttatctcttaaagtcagctttccttatctttgagcattgtgttcagttccattttattgctggtttgtgcgttctggacaaggaaacaggactttccctcaaggatcattccatacttacaaggtgtcctcacaactctaagttgcctcattctagaggactgcttctcagttacatggcaaggacgcactgactcacagcctagagctgcttggtggctgccctggacaaaagaagcaaaggttcctagaaggtagccctagccttcggatttggcaccagtgtctgcactgttccccatagctcctcagttacccatgcagattcttgtctctgctcttgatatcagtgagccctgattaccaacagattgtaaaagggggtagaatttagtaccaaccgatacctgggattcttcaaagtacaccaagtcccttgtgaagacacagctgtggttaaaaggtgctaagggtctgccaaattatctaatgccacatgtcttatgtcttaggagtgacaccatatgtaaacgcttgcttcagaactgttagtaagtcctgtgcagagccagatattattctgaaaatagaagaaatctgtaaagtttgcccacagagaagtactgtttcatgagtaggggatacattgtattgcactagctgagctcctctgaaggatccattgttaccagatcaacagaggtttctcatctctctggaagagctgctgccttggaacaaacagccaagcaacgcctccaagcttgtttataccaagcttgtttacagtcctcctaaagacagctctttggtgcacgttgctgtacagagaattgcatgtgttctgggatacaggtatatcatgaagagtttgaagccttatacttataaagctgttgacaatttccagttgttttttgaggtggtgtgtaatagtgtggtctgaattccacatgcatgagttaaattaagcaagttagcgtgtccatcctctcagtgttgttcactacccagtgactatgcaccatgtctctgtctagcatttttgtcatggtctgtgctagtaaaatagtaataaaaaagacagagtagtccaccatatcccatcctggggatgtccatggtcatctggcctgttctatgttgtttaatgccttgagtcatcagtcaggaacatagagtgatacactcaaaatatttttaacatgtggtatttagaatgtttagaatgtcaaagaatactctgtagtgatctttccctggaggcagggtggttctaaaggactactctctggacacttttataaagtgctttggaagaaaagagctcaatttcatgggaaaatatcataccacacactgcagtggtatattagtcgattaacctccaagaaatgcaaggaacagtacattgctcatttttttggttgttttcctatgaataagagaatgtgtttgatgctccctcagggagctacacctttttctgtgatcgtgtttttttttttttttttcacgttttatgtccaagtgtaaatgatggaagagatagcataacctgttcatatttgtcttagaatatattaaattcagtttctatggcaacgttttttaattggcaaattctattctgctagtactctccagcctatttttcttgggtatatggaattgtcagaaatgcttcacatagtaaaagttagacttaactgtgctctttgacaggaaacatgttcatgggccagggttgatttcatttgttaattttctgtactgtgttttcgtggttggttgctgtggcaattatgtgtctttctcgacacccttcctgtgtcaagaagccagtgaggattggtatttttgtctgagcttacaagtaggtgacagcctttcttaactgaaaaggaagaaaggaaggaaggagggaaggaaggacaaaagagagaaagaaggaaggaaggagagagagagagagaaagggagagagagaaagaaagcaagcaagcaagcaagaaagaaagaaagaaaacagtgtttgaaaatcccccaaatccatttaagcagggttctgggtgattcttgactgtaacagaataagctagactgatatatcagaaacacagttttctttgctcatcgtacacatactgtctcttgaatcagtgtggtgcacaatgttgaagcaggtactgggtaagttggatttggctactgcagtgttataaaaatagattaggtaaacagacacagcaggcccatgcggcttgggttctgactcctccccagacttagtataactttaataggctgtagttctaaagagaactatgaatctctagggtgatttcaatattatataacgaaggaggagctgttttatagcaaggaatcaggtgttatgtcttgtaaaataatttcagagaggtttatctgaaagcttcagtttttaagctattccaggcgacggtggacgtctttattttttgcctttgctatttttagagccctgcagtagcataaccctgcaccgcacacaaagcagtacggcagttggtgttggatgcagaattgctattagatgaaagctaacaaagcaaatccttggaaagaaggagcctgtctgcggtaaagactttcagtatgaaagttgtaatgtaaaaattagaatgctcaaggataaaataactacttccctctaagaagccatgcctgtttagtagagagtaattgtagccactcactttagctactctgcaccactgcagatgttctgaaaaggtgttcctttctgaattggtccatggcatttttggatttttttttcccttttatcagaagtcgtaggaaacttttatagctgagtatttcaatcaggtttcattttactcttctaatccacatgctttctgaataattatagcaccagtatgtgtataaatattcatattttataggttgataggacttatgcattatctccagtagtctaagaaaaataaaatgtgttatcaactaataaactgttgaatcatctgaaaagcccattgtacagaggaattcagaaagtagtggagatgaggtgggctataacatctgtggagtgaagtgtgctcagagccacaagctttgagcatcattctgtggtcagtagaattcttttagattatttataaatctatactttagctgtctggttttaaatatttaaaagaataccaaagattcatgacataattaaccgtgttgctgcttaagaggaaaattaaagctctctgagttggccttgcacacctccttgtctgtctgcctcagtgtgtctttgtttgttcaggtagacagcaaccctgatgaagtggaggggatttgtccatttaggaatgtttagagatctgggggatacactacaccgaattatcaaggttcttttcataaccagactatacaaacagcacttgagaaattagtgcagaaaggtttgtagcatcattctgtcatcagtagaattctgatctttggatttttaaccctcaccaaccctgtctaatagctcagagcagcaacatagccagcctccttctgtattctccagcagttcccgtgctgagagcagatctctcgttttgggaattgtcagatttcctgctgttacatctttatccaagccagtctgactttgagcattactgcttgcaagtactgttagggagaggaggaaaatcaatgtctccaaaatgggcagggttatagctccagacgcagcaggctagacagctgtacatctggaccctttactgatggtttcgtcaggtacacatgaagtacatctgctgacctacagttctgtgacagataaattagctgaattattaaagagctttcttaatcaccaaacatgttctaattgaatgatgaaggatgaaggtgagcaggcaatgagtttcaaagggtctagaaacaggtgtgtggtataaaatgtaatggtatactttttcttgttgctagcctaatttagttgcatttgttttcccatattgataggaaatgtatttttcatatttttagatcttgaatggcgctcagtctctacacacaccctattatgccatgagacactgatgccattcctctgtacacacaagccctggtgcacatatgcacatgcatataagctcacctgtaacatttaggtatttagggtgaaatcaagtgtttggaaatgaaatgctgtttctctttttatattagggaaacatagccaaccatcagtaacaatcttatcagattggactcctttgtgaaagagttttaggacaggaccaaaatatccttgtctagacctcttcagagtagaatagaaaaccgtactttgtataaagttccggttgaggcagaacagcctgaaggtttccagactgagactgaaagcatccaacaaatgcagataaacctgcctaccataaacactgccacatctcctggcattctcccactgctgcatgctgaaccaagggctgcccacaaaatttcactgaaatgtacccttgttgccttagtagatagataatatagttattaccattttgttcatgaggacactgaggggcaaaggactaagtaataagtacaacagagtcacaggtaggaaagtgcaggattagtttttaaatttatgttcctatttttgcttctttgaaccccactattagaatttatccccatatcagttttaaggaatcaaaatgaagaagagcggtccgtgtttaaaaaataatgtcttcatggaagtgtgtgctgggttactgtttcagatttgttcagtattcaaagctactgttgaattcctgcctttctcctacatttccatttcttttttccaacttctcataccaatgagcattcctccctttgaccttgtcatttgcattagaacacttgcttctttggaccttagactatcatcaagggatcataacttttcatctagctccagaagtctaggagagctgaccaccttgaaggactcacttattcgctgcctttagctcttgtcgatattgttttgcttttatagcatactgttaagcatgggccaggcatgagcaccatgacagtctccaagaaaacacccttacacacttcagggcgttacagagtatatgtgagagccagaaaagcaaattgaccaatgaggtgttggcatcgtaattggaagcaatgagaaatagcacacagttgcacgaggcgagctgaatgtctgtcccttcccacccccacctcataggctcatagtagagcacattttgaaaattctgaggaattcattccaattctattttggtaggcaaggaaaatttagaaaattggtaataaagtattgccagtctctactgtcatctcaatgaatcacaaactttagcttcttttactgagcatggatacaaacacagaatcattgagtcccataattttgttttttaaaagtgtatctgttcgtaatggagagaattgaaatttatacgtggcaggggtagcaaagtcatttctctttatagtatcaggttttaggaagctccattctcccaaaatatggcgctcattctctctaccaaaggagccatttcctgtcaatgtcaagggacaaatggccaatgggtgttgactgttgaccaaccaaaaccagtgctggcctttaggctctttcagtatagcagcacaactattcatggctcttttcagcgcttctgatcctacctcctgctttaaactccaactcctgggcttccctctttcagcttccctctctccctctctgttcctcttgtggtctggactctttcagatgcctttggctgtgtccttcttcgtatctacaattaaagtctttccatcaacaacacttcggagtagtcaagtctttagtttataaatctagtgcctaaaccctcagtttatacatctggtcctgaaagctctgggtgggagcacaaatggatccctccctttcaaggggtcttgcctttcctaagcaaacgaagctgcagacttgactctcctaagatacgcatgtatctgttttgtttttatttatttaattctagagtcttcctcttccttgcttcttcctttcaccttctgtacttctgctgtggtattcggggcagctctctggctcctggagcctgcttccccctcctgggtgcccttcacaaataaaggctctctctccctccacctcctcagtcctcttctattgagtaaatttaactgcagcactatctgctttgtctctgttgacttgctggagcttactattactataaaaccattcttctcagcctcctgggcccctgtcatatagaaaatggatgcctctcctctgtgactggagatatctctctctctgacaaatctctcagtgcatttgagcatgccccagattgaagctcttgttgcacagaacacttatcctctccctcacgcctttctccttcactgcatgttctcggctccctccgagcttcctcctctctgctagaagctgcctgcgtggtctctctccatagcttgctagaacccgttgtttcttcctttaccttccctgacctctgtgatacagacatcctctggggtggagttcctgtttgcagccctgtccctcctgtctgtcagcttcctcctaattagaaccctccctctggtggagttcctgatttttcctttttctcttttcctctttggagccagagactgtatgaagccatgatgtctggctgaaaaaggtgaccttagtttagtgcagtagcgccaaatcaatttgcaaattcccacatattgtaaaacatttgccatcatacaagcaaatattcgacaaaagtctcttatctctaagctttttctactttccactctagaaaatcttttatctctatgctttttgctctttgctctcaaaaattattttaaaactattatataaactctgtaaaatttggaacaaaagttagcttaaaatttgcaaccaaaagctaatacgttaaaaaaaaaaacaaaaaacaaaaaacaagactatacctaggtaatcttaattttctctgtgatactatatgtgtagctcggattcaacatgtttagggaaaacacacacacacatacatatgtatgtatatgtgtgtgtatatatatgtatgcatattgaatatatgaatatgtatgtatatatattcaactcttgttaagtaaaatagatgtttctaaatagtagccaccatgtgactgcaccaccatcttctttaagatgaccacgtgctataaaccagctaaggcagcacccataaaacattttagacctcttgaaccccaagattgtctttgtgtctccttttcacacaaaggaaacagctgcaggtcttaaagacattttggattaggatgactctttatatgataatggaaagagttaaaatttatacatggcagtaatagcaaaatgactgttcttcactttactcgagacattagaaacagtaactctaggctaaggaccttaaggtgagccttaaacaatgctctgctttaggagagaaagagagaaaaagggggtctggagagaaagagttgggggctatgtgacttattttatgaaataaaatttcacgcatctttctaagataaaaaatttagaatgcaattgaaaaattagagtaatattaaagggatagaaagtttaaccatatgagcccttgtacatatttacactttatttcaagtgctgtttgaaaactctaaagaggggtggggatgaatggaaatcttctgaaattcagcatacttctcctacctctgcccatgaataaacaactgtcctagaatttgtatctttgcaaccacaaaagggcagaacacctaatgttagtcattagtttttgagtaataaacgtctgatttaacttttcttaaccactttctattttagtatgccctggcaaattacgtaagagccataattgggtgagctctaatgtctgggcaaggaactcacttgagaagaagagagatctgttacaaaagcagcagctcgggacatctcagtgtcctgccagcactatggtatccctatgaaaaacagctgctccagcttggtacagtaatgtaagaaaagcttctagaagatgcaaacatattcctcagggtccacacttctgtcagggacttttttatgtcatatttaagaagagagtggctacagttttcttttttaatagggtattacaaatgattttgaagttttgatttgtgcaggtgcaggcctgtcggactattcaccaaagagtagtcctggtaatttcttatattaataattagaggggttttttcctgctgtttattgtgtcaggatggctttgtgtgttcccttggcctgcttcacttgatcagtttaagcagctgttttgccttaggtcattaggtagtaaataaccacacaaactgctattaactcttggatttgtttaatgagtgcagtctttttatacccttaggccatcttgcctggcctaggttcctgacatctgaacaggcagctacaaagacaccaagcacaggagtaatctttgcttatattcaggtcccttcctgacactttagttcagcctgcaatactccatcttaactctctgacctggctactctgcacaaagccttctccctagcctgatggttttattcttaagtcagctgactcctctgaaagctctacacagtgttcttaagtctattttactgtgaaggcctcctggctctttggattttgggaaagtcagtgtgttaaaagaaaatatagttgcagaatgagtaccagacagatttgaaaactaaatgttttcattctttctgatcttgggcaggttatttactgtcggtttgacttttttgttgctgtgtgttttgtttttgtttatgcaatcatgcatttaatcctgggtgagttttggttctaattttctattttatgaaataatattggactccacctgtgtcatcttgaccccatccctctcttgccctcttcctttcttctttccacttccatttttctttctttcattcctccatccttttgtgttccattccccccactgcctaccttttgtgtattagatgttcattagatatgagaaaataacaaatttctcagaaagtttgaaaaatatatattgtattgatgcatgtgttcatttaagtttgcaaagtagctcaagaaagcagggtagggggaaatggtctttatgcatcaaaaacgactttagttaaagatcccgtggaaatatacatatatatgattcacttttagtttatttattgagtaattttcttgcatagacatgtgcatcacagccctagggagcaagagtcagacagcctgtagctgcagttgtggatgtggggagctgaacccaggtcttctacaagaggaaaaattgctcttaatccctgagccattccacccctcccccaacccttccaaaagatcagttttttaaaaggtcatggaatggaacatgttttaagtgtaatattgaaatcgtaacactagaagtagtatggtgagctgtcaggctaatacaacagtgataatagctaggtgttcttttgaaacccaagatatggcagtattatgtaagtaaatacacgtctaaattgaacatttcactacagtttttgtttgtttgtttcattttcgagacagggtttctttgtgtagccttgactgtcctggaactctgtatatcaggctggcctcacttacagaaattagattgcctctgcttttataatattgggattcaatgcataagaaaccattgtccagcccttaaaaaaatctttaagaaaaagtgggataagtaaattgtattttgccattttttgatacctctttcttaatgattgagtagagttgttttaaagatgaatgttaaagctataatgatttctatacttttatttaaaatttaaggcataaatgtgtgaacataaataaacaggttcaatggtgatatataaccaggcatcggatatagctggacgaactcttaacaaagacttaaaaacatcttggaggagatgatatttaaccaagtctttaactttactgaagatttagccaaggagtggcagggggaatggatgcagagcagattatgtctgggtatacatgtatgcagagatatcttgtgcaaacatggtttaatgtggcctgtagacagtgtgtgtgtgtgcatgtgctagccttccaatcagatatgcatccacttttctaaataatgttatagatttaatgtattcgtaataattttaagagatacaaatatatagtatagaaatatatctgttcattttctgtctcccaaatagcaaaagcaagttttacctgaaaaataatcagtaaacacaaactaaaaattcttttaatccctcaaataggccacctgaatccattggtgggatatatgattagaggcagcacctctaatgttataacgtacattgtcatgggcttgtgggacatttaacggttggaacctcatttcttcagttgcaatataagattaatcagaagtatctcacagaattgtcatgaagataacagtaggtcttatgagaataaggagacaccgtactttcaaatggaatgtagacactgtactttcagatgtacttattaaatgaaagttacaagggcattttattcatttgttttccaaggaatgttgcattgatcttaagacttcatttctgtttccttgaaaatttatgtcaatgtacttttatgaacatttattgaaactaagaaaaattttagctaaacttccataagatgtaattgagctgaaaaaaaaaatcagtattagctagcagttaacataagaattaccagagatgtgaatgactacctaagttgtgtaggatttattattaatataatttgtcatctgtatcatgactatgccttctgaggacattttgaccaacagaatccttaaactcaggtgcatccagtggtaacatagccacttccataaatttcttttagatttttttacttcctaagaacaaagtgttctgaaataatttctcatcatatagctgttcctgatatttgtatgggatcttatgtctaaaggagatacaggcagcagatctgtcttgaaacccattgtgaaaaactctcttatttctcccattcagaaaatctaataaacaccttcaaaacaaaaaatggcagttacttgaaagattgtaatgattcttcaagaccctggcagaagttagtcttaaaagaactctgcaggatatattcagcgcaagccaatgacagacttcacaagtatctgaaacacagtcaagagcttgataaatcagaatttctgggagcagaggataggtgttgctgtaattttacagtttttacttaaagggccatgagagggaaccattaggttggatcttgattatatattacctagagtaggcaaaatgtctctgaactcatatttgttctacaaacattcgtgaagatgtgcatgtcaatgagactgttaatcctatagtcattgaaaggtttatgcacatattggtgtgaattacttctcatctaagttaaaagctactgaagttaatactatctgtttattctacctgaccaaaaacaagaaattgaaaagaatccacaaaagagggctattgaagataaccacttgtcattaaatttaaaaaaaaatgtggaaacaatttgttttgttgtcagcccacttttcaaaacttgtgcccagattcttaatataaaagaagtatgcttgagtttttcctcttttggggcactaagcgctgtctcacagtgccccctacctggatgcagtttcccaggcagaggcaccatttgctcaagaggctaaatgcctcagtgaagtattgctaaggagtgtcaagtcagccttgcagtgaacagtgttcaccttggctctggggaatatccttcctactggagtctggagttggcatctgaagtcactagggacatagtacgcgttggctcattaaaagagactctaactctgtgtaagatctgaaggaagaggagagaaagatgctttaagtaaagatattttagaaagacttgggtgacagaaagcaaggcttgcaaggttccagtgatgggataaatatgctaggactggggtctagtcacttatgttcattgtcctgacaactgcatgtgtcgtttctcttacattcacattttagtgtattataacgtggtgctgcatgtctgtgctcttgcgaggacccacggctccattctaatgacttagaacacgctccttccagttgccttttagaacatagcactttgggaagactttgcttttgtggcgatcttaggctcacaaactcatctatactggtttttttaattttttgtggtttgtacttaactgttaatatccccactcacccaaaatatgaaatgtgtctactgctctattccttgagataaacgtcagatgctatttgttaggtgttgcttctttagatatttgagggactcctctgggaagcccacaggagacctgggggtgaggaaggcacacagagcaggaaacaggctcacataacttgtgttgtgatactcttttttttcaagatcttttctaccctaattgcttatgctgctgcagccagcacccaatggagctgtgttctgggttcatgaaataattttctctctcttcattgctgtctcaagtcagaactgatagctgtgcacagttttagttgattgtcatggggatgggaggaggagtgtattttcctcataggaacagaaccagtgtcagtaagcacattttgttcagctacacagttggtctgtcaggaagaaacactggtgaagtagccctgaacactgtcacctcacctttccttctgtctctgtcaatgtcatctgcacaaagcagtagcatttcatgctgtccttgaatggcatttaggagcacagaaagggtcagtgcattttcagttagggaatcccataggcttgcaaagattgccactggaatattgggagcgaaagaatctcatatttggcaaagctaatgaggcgtgtaaagccgggagaggagagtgtgaggtgactgtagtaaataaaagcagttaaaactgcccgcttagtgtaagaaattgtgtacgcaccagttctatgcgttagatatgttatcgcagctgatagattttgaagatttaaggtaaaaatattaacatttggtgaaagtgtaacatagatactttgaaaattgttatgactaaattatgagtcataatgagttatcactttagtatgtgaaaattttactttaatttttttaagtcaagatttgctttgttatatttgtaggcatattaggatcaagcaggaataaatacagtgtcttggttgtatcaatacaagcagattctgatttctttattagtttcttttatatccatgaatgaaaaggcgtgactcctaaaatttaccatggtttgtttttccctagatgctctactatatgtgtatgtacatatacatgtataacatttatgtaatttctgatggatgcaaatcgaacaggcctatgaaatacatggataatttgcccactcacctcttgccactcaaggtctcatgctgaaatagagtgcagaccattactttaactcatttggtggtcctcacccccttgcagtctgctgtaggtgcaaacatgaaggaccaaacatgagagattcactgaacttttaaaagcacatttaagatttttattatagtttggaatactatatggactaactttcaaaactagttgcttacatcttggactttttttcccccctttggcagaactcaccatagttgaatccttcatttagttaggacctgttcttgctggtcccatttgtagttttattttgagaggtcagtggttaggtacttatacttaaagataaacaagtctaatgcaattggtatgaatgtgtatcctaatacaatgtctaggagctccagctcactgagtagacaggggttcagtgatgtatttatgaacagtcaaaatacaccttctgtggttccccaaagtaacagaaaggtagaataactgatgctggagcattaagttgtcatgtcaacatccataatgtgcttagcatagcacttaacacagaagcctcatgcaagcttagtaagtattaataattaataataaatattcctttatcataacaagatgcatcttttggttttagatcagtgctgtcgggaggggaggatacaagctggaggtttcctgaataagtggaccaggagctagcatgtgtatgcaaacgctgccttagtaattttaagagccagataggagaagcatgcctatgttttacctaaggttacctcctgacttcttccatgttatcatccacattgtaatgtcacagtgatgaaaaacatgccctacaaagacaccaccaaagattattatgtaaacactgggccttttgattattagctggtttgatttgcaatccctaaaacatcataaatggcttggccatcgtctatgtgctgaaaaatataattggagcaatttgaatacacacacacacacatatgtacatatatatatatatatatatgtatatatatatatatatgtatatataatgatctggcatttccagttttatgatgccataaaaaagcagccagcacatgttggactgtttaatggtcctggcacctaccaaatgtcactggactttacaaggtcatagaaactccactttggttcaggggtatagactggatccatctctgtagcccacacagtatatggaaccaggaatgttgatggtgctggtgaagcctccacagcactagtgtctatatattgctaggattctgtggcatagagaccacacgtttatgagaaaagcaagactgtttctttgtgtgccatcctgtcagaggcagctctaaatagatctggatttctggtgatgacggtgcagatgcaacctgctgtcacagctgcatgtgtatgtgatctctcataagcaaaagctgctggggggagacatgatatttttgtcacaagaatgtctgtgatttgctgccgtttcacttcctcccccctccccccccaaggtgccaacccaaagcttgtgcactcagaacaccaagcagaggtatagagtttcactttggtcatttccaagatgattaatggagttgtgcaatgcaggctcctgagcactctgggaaagtcacagtatcccagtgaggtggagtgccttgatactgcgtcagcagggagggtattttgggatattgtaaatgtcactattggttttaatatacaagaatcttcatcatcaaaccttaggaatgttctacaaaacactgcctagaacagctattgagttctataaatgactctttaagtagctagaaactgttacctaaaatctcccatttgtgacccagttagatatggatgaagacagtttagggcttattatatggagccagtattccttcaagtaatgataaattataaagttaactggctgtgagtgtgtgtgtgtgtgtgtgtaataagaacttgtcatgggaccagaaaagaggaaagcctgaattcccagtccattctgtttcagttgaatacatattttgtatctatggtaaactaactgtaagaagttgagatataatttatctatcactcttttctagtaaatatcttaacattcagactgtttacagaactgtgcaagaaaaataagtaaatattgaaactcattcattcatgctttcaaggtttttaaagtgtgcagctcttagtaattgacttaattagcagggataactggtcagctgcatgctccttttacttcatgttgctcagtataaacttaatactttatgtttgaggacatttccagaataaccctttccattgaaaatggtaacatttttagaatgcatagagctctctttagaatatcagctattgtacatgtagaataaatggaccaaagtcttaatctcatggtagatttgtaaatgaggtttttaagactagaactaagattaaccacggcagaagactagaatcataatctaatagaatcagtgcactgacaagaagaattacaagtgaggttagagtggtagtgtctctgtctacatcccccatttccccccttcctcctttccttcctgccctctctccttcctgtttctgtgaacactaagggagttgttgatatggaagcaaagacaaaggaacccatgaggagagttctgactgaaaactgggtaggataggaccttcatcttggtttttgagcttctaaagctgagaaaattaatttctgtttaaatgacccagtctgtgacatttttcttatggcatccctaactgactaataaagcctccattatatttcactgggtgggtataagtcagtgtttgtctttcaactggtaattatcttaatgatgtccactgctgtacccagctgggcatgatagtctggtacagtctaaacatcctgtagtactccaacccacacaacaacatttatatgtggccctaattgtccataatgccgatgttaagaaagctagcatgtcttttcagggtgcaggtcctcttgcaaacttgcaaaagccctccatgggtgcaagcaagctataaggaacactagcgtaggagcttctgcacagtctgttttagttgcattgacttttttctctgcacttgcaaaatcacataaaatgattgttagtgttaattgaatgcatagttgtctttaaaaatcaaattgaaggatttagatatgggagttggaaggtctggacaaaatacacttttcttacagtgaattagaaagactgttatcgatctcctagcattagatgattaactagacaacaaggtggattcataagaaaacatttcgtggaagtgagaagccacatgtcttggtgaccactgacattaataatcttattttgggaaaatatatatcatcttgggaaaaaaaagctgttaagaagtctcaataagaagctattggtttcacagtcagattttcaggccaagaaagtacttcaaaaacacgcttgtctctgctgtcccaaaggaaactctggtttcattttaaccactgaaataaatggttccagtttgagagccttgctagaaatctagtgttgtgaaaggcagctggaacagcctctgaggtggcacccctagaatttgttcattgcctccgtattctagagcctacccaggtctgactgggcaactttatccttccggttggtaccatttggcagcatgacagtatgtccttttggattctgactatacaaatcatgataacccttttatttcaggtttaaaaaaacattgaaaatttaattttgacatttttatatttttaaatttacttgccttctttctattgtactcttttattttcaattattagtaggtttttaaaatagatattaaaataaagaattgatgttaaatttagtttataatctatgttcctaagcactagaatgaagacagagcacaatactttgaatgtgttataaggaacttatccactctctgtgcttcctgggtaggggttagggcatctggtgggtgatgcctggaagatgaacagggatgacactgactatggctttaccataattctcaaaggaactaatgctactggttggagggttttagttgttttgtgttcctagatttttaagtaacgctctaggttgggatatttattctgatttactcttaatctttctgtttgtagagccacaaccattcacaagtgcagtcaacacctaacctgtgctgactttaaaaagcggagtttatgaaattgcccttgaatgggttactgtaacttttcctatgtgtagcagtgcaaattcctgtggcttcacacaaaatgtcttctatggtgttttctgctatgccagaactaactccttgttaaaacccacatccctggccctaacttgtgtgcacagacactaggaaataatcctcactcaccctcctataagaaacaccagtaaatgcattgatttggcaacttcaactctggtggaattgctgctttagtctgtctgcccttgtttgttcaagtgtccccaggaaaagtcacaggatgtgtaggaatgtcctgttcagaacatattcacattattttttgaaatagagaatctataacaataaaactaagcaacagagaaatatagtcaagtgatactttagccactgagtaaatgcacaatagaaaccatatgtctaagcttctaaatttcaagatggatgggccagcaaaatggctctgcaggtaaaagtgcttgctgtcaagtctgacagcctgatttccatccccaaaacccccatgacggaaggagagaactgaccccccccccccacacacacacaggttgttctttggcctccattagagtgctgtggcatgtaataaataaatgttaaaaatacaaaaagtttgatgggatgccctgatgcagaatttataggcagcacctaaaatccctttctgttatttcagaccaagctgggttgataggtagagggtctgggtgctgtgtggtcaggaaggtttcctcagagggacactgaggaaagcgatggccagtgtttgtctagtcccaggctaggtctgtgctgtttgtagagctaaagcacctgaactgactctgactgaaccatcggctctacgcacccttctcatctacacctcaagccagttttgtgaaaagtttgaggaggaagtatagagaagtggaaattgcattggaactgtggttggttctcatccttcctcaagctgcatccctttaagactctggtttctcatgttgaggggacccccaaccatagcttcataactataagttggctactgttaggaatcataatgtaaacacgtgttttccagtggtcttaggtgacccccaaagggatcatgacctcacagactgagagcaattgtgctgcagccaagttcttctttatattgaaataggtattatgtctctgggagaactcggcctgggagttctgagaactgtagcacttaggagcttaattattttgtccaatcatataacttcaaattgatttgtgtgtggcttattatatggggctaagttgtttttgaggttgtttttcaccgagatgcttttatgctaacaatgtttctgtgagcacagcatatatcaagcatggttatttgacttggaataagccattttatgaagcatgggtctatctgtgaacctatcaaaagttgtacctagcagataaattagaaatctcatcctgtcagtgtggaattctacttccctttgatatgcatttaagctgtgttccagggatgtgcttatagtgttagtgtcttatgcagtttgtagggggagggtgtttataaccttcgtgtcttatgcagtttgcagagctgatggctctataaactgggggatttaggcatcaggactgtacagccagaggcatctggaagagtccagagcagggagagaaagtagtaggagggtgaacatggccagcagactagagttgtcagtgaggtgagtcaggagccagagaggagggcaaacagggtgtggacaaaggaggccaagagaggaaaacaagagagagacaaaagactgagagcaaagagggtgcatggccaagatggcagggttatgtggggaaagaagttggcggggtgggatggggagggaaagttttaggatggggactggagtcggaaaagctttgaaaagacacagacaggtacttgtgctactgagaaagcctagaggccagcgcttgttttagtgtgctaataggcaccaaagatccatgtatgccttctgacagcagtaaggaatggctcctttggcagagggatacgggccagaatttggagagtggcgtttctgttggacctacgaatgagaaaagaagctgtagactgttcacagtcctaaacttgcaggcagtgtccttattaacacagtatagaaacctgtcctaaaacagcttaaagttagagaccctaaatagagcatttggcttagaagagttacagtttttattgtaaacatcaattttctaacttattcaaagtaaaattcaacagaatttacttttctatagaaaaaaattaaaaaggttatgtgtcgcttaatctgtataagcagatctgcttagattctctggtgtaaatgtgtagttgttgagattgactaacagtgtgtcagtcagtatgaatggagtcgttcccagggtctggcatattacagactttaataagcgcttctgatccaggatagacagatacttatatacaccgtttagttatgctgctttaggggttgatgtttctgactttctcattgtcagttctttgccggatgagcataccaagtctgactattttcacagtttggggtcatgggacaatattggaaaggctgaaggctcatgtctaaccagtatttgactactatcctttaaacctctacttctgtgagaaccaactagctctcttttcagccaggggatttccagtatgtggggctttgtagaagttctcctttgatttgctttggggctcctttggagccattttcctgggggaacaatgttctgtgagtcccctaagctagtttgttcaaactcagtagagataaaacaccaatgacaagtgttttcatgaatttcgcttctcgtgacttggtgatgttaatgaagatgctgtagcaagcattcaaggttctgtacttgacatctgtgtgtgaggcttacttttaaagcagtaaccttttaaactggaaacagtaaccctgacattgttagattacagaaacttcactgagcctttaaactttttcaaatatcttaaatcttcattttaataatatatttgtagttgaattcatgacttcttcttaatgtgtaaaaatgctgtgagtgataaattgtgagaaaaactcatagatttagataacttgtttgcatatcatttctataatttagtgattttattttgtttaacaacggttcttgcttcttttatcttttagggtcgttgctccagagagaactgcaaatatcttcatccacccccacacttaaaaacacagttagagataaatgggcggaataacttgattcagcagaagaacatggccatgctggcccagcaaatgcagttagccaatgccatgatgcccggtgccccgttgcagcccgtggtgagcacactttccaccccatccctgtctgtgtggccgtgttctgtgtctgtcctgaaacagtgattgtatgcaaatagaggcagcagtggtaattgctgagtgccacgccccgtgaggttacttaccttcacggcaaacttggcaatttatagtctagtattgcttctgctaaaattctcttaaaagttaaccgtttaacctgcgactgttcacctggtgtttattaaagtagccattaaactcagtttagttaaaatacattccaaatttcctttgaagttgataatgatatttttcttaaaaacaaaacaagaaagcagataaatgataaatagtagtctttagctttgaggctatttcttgctttcttctctccttgaagagaatccctgttattttttttctctctcaaaaaggagactttgtggaaaacttaacttgaaattacttcatagtcacaaatgctgggcactttttcacagtggcgagttataagcatagcttggaagtatcatcagaagagaactagtctaaacaccagaatcccaagggcctttgaaaaatagctatgagtggtcataggtactaatattttcctagccatgtgtgttggtaacttgtttatgaataaacatatgtatttaaatgtttagatttttgatgtgcatgtgataaattactttaataatcttatttatataatagttaatgtttggttaaaatggtgtttatgttaattattgttcaaaaaccctaaattacttacatatgtgataacatttatatgatcagaatatgtctgattgatttatcgctaacatattatgaactattataaggtcatgagaacacatgtttttccagtttgttaattgtagcatgtgtgctaactgatttttttcctaatacattttaacacctgaactcaatgtaattattattctctcttagaacataatgcaacaatcattccaaaaaagagggggggattgcatttcgaggtgggagggatccccatattacaccggcagtgataccaattatcaatactgtacagtcgaggtgagagaatattataattaattctctatcattttaatatgatttttattttatgacattattgggggctcagttaaaatgtgatattttgatttttatggcatctccttattttatgtgtctttatgatgataacataaatattttcatttggttaagaatgttttgtataatcataatttcttacagacaaatcggttctaaacatatctcttacacttggccctcatgtatggtttcaaagatctggaacagtttctactttagtcagcctccttgatgtgaggtcctttctcccacttaagcctgtaaatcacacttactgacattctgtgctttctgtgactcagagcacgtctgagtcaggcaagtgtagatctgggctggaggagcatagtccccaacacggccctgagaagttagttttctgtgaagtcttggcccattttttgaccttgtccttaaatctcctcgcatgggtgatccaaggtcatattatgcttagccctggaacaaactgtcaaagatcttttattctctttgaaattctagtgacatatgtgttttttgtagtcactaaatcatagatctctgaagccatccgtacttagactcctggtccttctgttaacatttttctgcatagacgaagtaattatctgttttagttatgagcacaggcgttaagttcatttctccttcacatcattacagttcaatgggaattaccctctacaaaggtactgtgaaaccacagttgaaaagtctccgttcaggatgatgtttttgtaataagtattaaaatcacttcaattattcaaacctgaagcattttttactgtgacgactgtagagaaggctttaatctaggaaatttgccttcaaaacccacccgagactctgatcctcttttgagtcagcctggtttccatgaggataacacagggatccagaagtaaatggaatgactgtgactagctgctttctgtgacttcaatttgagctgctagtagaaaatagagccacaagctgccctgtcactaacgttgagaaggactcggccatgggagagcatggacatagatcaggcaggagtagtgtgagtgtggctttcggtaagcagatccacaatatcagagcctaggaggacaaagatttcaatttagcaccaaacttcatacagaggacagaggtagcgaaatgagagcaaactaaatttatacacatccagtagtgtgtacctgcatatgggagaggttcataactgacagacagaaaaagaaggaaataaggagtttcccagacagccatcaacctgacagatattcatagtggtttctctgccctgaaggtgagaggaattataactcagagccagggcacaagccagaagtggcagcttcattgccactacagtgggctacagtgatcagcagttgtcagcagtgtttccaagacaagtgagatgattgttaagagcagccactgtcccaccagagcatggtatgggggtaacttggttaatgcagagattcataggagaactttgtgccttcagtaggttgtcatgcagtatacccattaaaaaggagtaacatttttgagacaagtataacagtttgaggcatctgttgtactcagcaggttctgtatatgccattctcacaactttgctgcgagctaggtaatataatgtccagtttagggattgagcccaagaggttcagagaggttaactacatggcttaggttacaccgcttgttttaatccagcctggccagatgttgagcttatatggtaaaaacatacggtgaacaggctaactactttggatctatggctgactctttgatcttcaacatggaaataaaatatgaaatatattgtccagaatgtctttgtaattatataaacataattcccatttcacaagattagtataaagggagttggatataagaaatggaacttctttgtgtgtctaattcatgaaagttcacacaataaactgtagaattttttatatcaactctttttggcattaggatttgtaataaaaatataagtgaatatttttatgttttttatcatatatgacctttgaggataagtgagattgtaatgattagtcttcagaattaaagaaaactttctgtgctctttcatacgttcatcatgacaatgagaaattgacatacactagctcaccctgacctgcatctgctggatgacaacctggaagcttctgtgtatttctttcatccccaggatgatgttccttagactctctgatcctccaagctctctgcatcacacatagatctgtgtggtcagtggggactgagaactcggtgtgagctcaggcgttccattagtgagccctaccaggctttacgtgggacctgggttagcagtgactctacagagttgctggagcagctactcctcaggtacacaccagcaccttgagacatgcaacctgtgtagaaatcccaggcacttcatgaatctgatgtgtgtgtatgagcagttcagaggccttagattcagttcaagtctcaagagtggctttgtcaccttgacgttggcagtctttcatattcccagggttctttggcagtaggtgaagaaggctttgaagttattatttgtccgactcccagactacctagaacttgccagtactttctgtgctttcttgtcttgttacccacctcatgacgttatggccagttcattctatagagtccccagaaaactatttctacatcagccacagtgacttgtcatctgttttgccatgcatcagtcagtctgacttttcaggtttgtgatcagtccctgaactgtaagaatagacctgtgctcatttatactgagaaggtcttaaatgagacttcactatttaaatgtttgtttcaataaaactgggtcaaaggatacagtgaatcagggtaaagaatgaattccttccccttcccattcacaagctatgagtagagtccacagcagccaaatgcttcattcttagacaaaattgaatatgggtttattcataatacctgttagctctgagtgctgttctaaacagtaattcactaaaactagttctgtatctgtttacaacatggtgcttgcctagaaacagttgcccatacttgggatgtcctacggatttaaaagagcttggcatttcactgtttacaagtttgactgaagcatacatgtatatacatatgcaaacattctactaagcatgcatgtgtacacgtgcacattctaccaagcacacacatgtgcacagtttactaagcatacatatgtacacatactactgaacatatatatacatgtgcacattctaagtgtatgtctctctctatatatgcacattctattaaatatacatgtgtacatatgtgcacattcaactaagcatacacatgtatacatgcacatattctgctgaacatacacatgtatacatactcacattctatgaagcatatatacgaacacatgcacacaccctaggaaaaactgacttataaaatttctgttccataaatttctaaatgataagttttggatcattatatatgacccttcttttttttataaaaacatactattttcagcattttaaaataaacagccttgtgatatttgcagtgttcagaataatagttataatacttaagatgtaatgttaatataaaaattagaaaaaataaactttgaaatattcattataaagtaacagctaaattctgaggtggaaaaaggatatataattaaatctaccatctagatatctgtgctagaaaatatataaagcatttgctactcttgctggcaaagaaaaatcagctagcaaatctgcagtgaatatgttatgcagtaactgcagaggtggttacagtgccatgtgccgggaagtaggagcagaggaaacaagaatggcttcagggtcagtgctacatgcaatgcgggtgagctttatgagacagagtgtagtggtgtggttccctgggaagcgtcgagaggttctgtttcctgaagcgtacctaggagtcagacaggtaggctgagggcaggcaatgtggacagaaactcataaatactcataaaaagagaaccactaagaaaccacttagaaaccttctgtccaatcggaaagaaatctatttccttaaatacatggaaatggaatcaccctgaagctttcaaaaatactgccgcctagatacctttcctgggaattcagacaaggaggggtcgaactataacatgataaaactcctctagggaattttaaattcacatttggtgattatgtgagaaacagacttccaaccagactagaagcagactcaaatgtgcccaatccaggaccttccgttgattcatttatagtggtagacatgtaacattcgtgagcatcttctttagaaaataaacataataatccccaacaaagtggcagctcattcactgaatgcctactgtaaccaggcattgctttgtatggtgggaacctagaagggaactaagagatatcttctactctcctgacatcccccctcccaaagaggccaaagaaaggaaagtcttatagtaaaaaaattaaacataacataagtaaagcacttatcacagtgtgggctgcccgggatagggaattactagtaataatcatgtttgtgtagttaactaggatggtaatgtgaaattgaataatattttcagttataatgaagcctaataactgtaatgtaagcagaatgcttcatttaaagcaaacaagtgataaataaactgccccagaattagcaactggaaaatgtccttggaaaggtaatgctaaaccaaccttcattggaacaaagatatctataagtcactgctgcaaggatgcactcagtatcaaatataccagctacatagttagacattattcaatccctacttcagagaaacgaagacttcaaataccaatgcagccattcctatctttgagatcttacgagccctctgcaggtcagctccggtaatgcaggagtggccatggtcactggctttcctacattaggatccactctgagctgtaacccacccctaacacagtgttcataattggtgacagctacattctatccatatgtaggttttcactgtatttaacttggtgagatttaacgaggctgattttattggtgtgctgtcattattgtgtcaagtcagggaaaaatttcttcatcctgaatgtctttatgaaggcatttgccttaagtaattcctatagtatacagtgacataaacatttcagtagcttgctatagtaagtatcaagtgggctttcttggaactcattttaatttacagctatgaatgcaaagagaaaggatattaattagctttcaatcttttaggactctgctaaatttataacaattcttctatgtggtctgagattccataccctgtatctgactgtgtgcaacagaacacacatttgcctagaatgttcttggacagaagtttaatgcatgatcaccatgcaggactgaccctgtcatggtgctgccctggcctctagcacacaaagggaaagcctgaagttagctgctgttcagggttttgtggagagacaaatgccactggacccagttttacacatggatccttcttcataatacacatggaatttttgtatttcctgagggcagctgcttcgcattggaataggcttgaggtttgaaatggaaagacttattctaggctacttcattagtcaagggccacagacctgtcagagtaattaaacatggtgttcaaagcacatgcttggaggactagctatgttagggtgaatgtatcagtgtgagctatgctatgttataaatttttcccagtgaatcaatgtatacattaaatagtctatcgttcatattgttcttagtacagatgtgtacacaatgcagagctgtcatgtaggatggatgctcaaccatggtatagtcctttgggaccttatgctctcatattaaagaatgccatttacacatagtagatccctggcttctctccattgaatgcagtagcatcaccccagtgtgtcctgcccgctgacagcccatcccatgttttttaataattctgtggcatttcctgggaaatgttctgtcaggcttcacattccagacattttctggagaaggttaatttccattgctgagtgccccacaagtatgggatgggcttgtagaacactgaacctttcttctgagaaaccgacatcaagtgaccaggccaaatgctatctcttctgtgctcaaaagacagtgtaatcatcacctctcacagcccacagatttggtcaatgtgctggctgtggggctctgtgatcccctgggacatctgtgtctgctcagatgataggcacttatatcctgttaacacttgagaacagacctttccactatatctgacagcagttacacagtgtgtttctcagacacatttctaggattgagtcacaaaggtggagactgggtgagcacaaacaagtgtctgtactaagatatttaagacgttaaaccacaagtattctagatgccaatcttcgaaccccctctggagatatgaatgcatattctgcctgctagatttggagaaaaacaatgacttagcaaatatcagtatactgaaatcttcttagactaaattaaagacagaattaaatagaagttaaggaagaaagaatgaatgatagatgaagaataaatgataactctgtaagtagagtatcaatttggaatggagacttgccattaagttttgctttttgtttcaatttgcagccaatgttttcagttgcaccaagcttagccaccagtgcatcagcagcctttaacccttacctggggcctgtttccccaagcctggttccagcagagatcttgccgactgcaccaatgttggtcacggggaatcctggagttccagtgccagcagctgccgcagctgctgcacagaagttaatgcggacagacagactggaggtaggataaagagttgaacc

SEQ ID NO: 1542 - DNA, 4584 bp, Mus musculus
gcagcttggaaattcggtgtcaaagggtctgccacgttttcatgcttgcattttgggctccaaattggcactgggaaggggttactgagcacacggctgagtccaggcctcctctaaacacccatctacttacagtcctggtattcctctcaaaaccaaaacctctttgaattaacagtttcatgctgtgaatttctagcggaggtctttccctttatattgaagtcacacttttccatgtgccgttaaatcggggacgggggaagcagcctttcggacattttcacagttatctcacactctgagttttatcagttcctattttgtttagtttttgtcttttgttttggttgctgatttttttttttctatttttctttttctttttcttttctttttttctttttgttttttcctttttttttttttggagaggggttgggtttgttggtttcattgaacatttaactacctgtaaaatataaacatggctgttagtgtcacaccaattcgggacacaaaatggctaacactggaagtatgtagagagtttcaaagggggacttgctcacgaccagacacggaatgtaaatttgcacatccttcgaaaagctgccaagttgaaaatggacgagtaatcgcctgctttgattcactgaaaggtcgttgctccagagagaactgcaaatatcttcatccacccccacacttaaaaacacagttagagataaatgggcggaataacttgattcagcagaagaacatggccatgctggcccagcaaatgcagttagccaatgccatgatgcccggtgccccgttgcagcccgtgccaatgttttcagttgcaccaagcttagccaccagtgcatcagcagcctttaacccttacctggggcctgtttccccaagcctggttccagcagagatcttgccgactgcaccaatgttggtcacggggaatcctggagttccagtgccagcagctgccgcagctgctgcacagaagttaatgcggacagacagactggaggtgtgtcgagagtaccagcgtggcaattgcaacagaggagaaaatgactgtcggtttgctcatcctgctgacagcacaatgattgataccaatgacaacacagtcactgtctgcatggattacatcaaggggagatgctctcgggaaaagtgcaaatacttccatcctcccgcacacctgcaagccaagatcaaggctgcccaataccaggtcaaccaggctgcagcagcacaggctgcagctactgcagctgccatgggaattcctcaagctgtacttcccccattgccaaagaggcctgctcttgaaaaaaccaacggtgccaccgcagtctttaacactggtattttccaataccaacaggctctagccaacatgcagttacagcagcatacagcatttctcccaccaggctcaatattgtgcatgacacccgctacaagtgttgatacccataatatctgccgaacatctgactagccacaagtatgttacccagatgtagagctgtcgtcacaaaacaatcatacaaagaggaaaggacagtgtgcttgattagagtaaggacgacgtcattagccatattgtatataccgtcaagcaacacatacaaaaatccctcagccacaagacatccacatattgcatgttaaccagaagaaacgacaacatgggaacctgctgcacactgttgcctacacactttgtacattcaattggtatttgtgctgaggtgatattcctatctaaaacaacaacattgtctttcttttgtagcacagagttatgcattaaaatatgcatacgtaattagtttcctatatattcatgccatcttgaaaagacagactatggtgtgaccatgattctattatgtattggtacgtctgtagaccaagatataattttttaaaaataagtttatttctttcaaggtttacaagtaaccaaggtgcaccttgtatttaaaatcgccgttagagctgagagcgcgcatgcagagtcatttttgtttgagagtaatatttttactgtaatagattgtacgacatggtgagggagggaactgacagatgaatgtgccaagcaaaaccacaactgtgtatattttaaagcacaccatggctttaagtaccatgttgttaaggattctcatgaagtgccatagactgtacatcaaattagagtattatttcttcagtgttattgtttctggagccacattttgttgcttatttgctagtactaatcaatcaaagggcaccattcttttcttttttgtttttgaaaccaaagctgtctcagaaatggccaatttaactttacagtaacaatagacagcacaacacaaactcaatacagataacctttcacatactggagatatatatgatagatatataaaattattttaatgcattgtagtgtaatatttatgcatactctactatataacatgttattcaaaagggatatgccatttctgagacacaataacaaaaaatgtttgaggaaattattttgcttctatttatagcctctgtcaaaagtcaaaagactataaatgctttgcagaaatgggttcacgtttgcttaaacgcttcatcacagtcacattcaaaatagtgactctaaacaaagagaacagcactgtcatcagatgcatgataaaccaaaatatgaaaatgggaaatgtttaattaacctagtaattgggtgggttaagtacatgggtgaattttatatgtgattcttttgttcagattaactgcttatagccttagaaagccttttaaaaaaattttaaaaatagatgtgcattcagtttttaagaatggattcatccaaaggaattccccttttttgtggtttggatgttgcagctaggaaaggctatttttgctctgttcagcagttctaaaatcgctgagtaggggccaggtcactggcagttctagtgtggaatgggagaagtgagagttctgttatagaactttccatacttccaagtttactgcaagtttttatgcttgagagagatgctttctaatataagactgatgtgttgattttcctgattgtactgtacatctattaaagccttagattattacattacgggttggaacccataccaatgtaatttcaatcgtgttaagagagtaatggtgacttcacatgttattgtagttagttacgttatagaatattacttatttttcttgttaaaatgtagtttttcatttcctacatttattggattttcattttctattaacagttgaataccatttcagtttttagactattgttttattagattttaccaatgaatttttcaaaatacaaaaaaattaaagtagttttttcttcataacatactcagttttaaattacatgtagtgtcatatgaatatccgtattattgttaactaaatgatttatattttactgatttaatattacagtgtaagaatgtcagtcattgttcttgtctagttttcattaaaagaacaaagatcttttatatggatatcttataaatatataatcattgctaagtaagaagttaagttgttgctatggcaacaatcctggcagacaattgagtaatattttgatgatttattttgtttgtaattagttattatgagaagatctagatcctagatattagaataaaatttattttctactgtatccatttcaaatgttaaagtattgtttaatatttttgaaatccctgaatatcaggccttgttataaataagctgcataatcaataaatagaacaagggactttttgttgataatccaaatactcaaagtttacgtaatgagaattttagcgtgtgtgcaaactcttgagggttgatgatgctgcaatttagcatgttggaaagtctagagagaaggttgactttttgcacttctgtatatagtcaaaagagagaaacctgtataatagcaagatcttattttgaataaaaacgtctataattacaaggagttttgttaaggctaatgaaatgacagactgagcaaaattgcttgcaaaagtggcacagagttagcactccatacccttcaaacacgtcgctttgctttttgtggacagcttgtagtttgccaggatttttcagctggaaagatttgccatccttccaagatctcatgactgacaaaactccattgggccaaatctgcctgaagatcattaccaaaaaatagcaggtacttcagccactaagatgaaatcatggatcagatatcccttacattgttttcaaaactactgcatgtttaaaacttcaacaaaaagagagaaagaactatgctaaggacatatattattcagatcgatatctaccaatttcagtggtttaatgttcacaaaatgaaatcttgaaaataactattgactttcacaaaattttaaccataaacaggcaaaccaaacagcacacctgtagttgttctgtgattgttttttaattgctgtagatcatgttctttccgcaggtgaaaaaaaaaaaaaaaaaaaaaaaaaa

SEQ ID NO: 1543 - DNA, 1026 bp, Mus musculus
atggctgttagtgtcacaccaattcgggacacaaaatggctaacactggaagtatgtagagagtttcaaagggggacttgctcacgaccagacacggaatgtaaatttgcacatccttcgaaaagctgccaagttgaaaatggacgagtaatcgcctgctttgattcactgaaaggtcgttgctccagagagaactgcaaatatcttcatccacccccacacttaaaaacacagttagagataaatgggcggaataacttgattcagcagaagaacatggccatgctggcccagcaaatgcagttagccaatgccatgatgcccggtgccccgttgcagcccgtgccaatgttttcagttgcaccaagcttagccaccagtgcatcagcagcctttaacccttacctggggcctgtttccccaagcctggttccagcagagatcttgccgactgcaccaatgttggtcacggggaatcctggagttccagtgccagcagctgccgcagctgctgcacagaagttaatgcggacagacagactggaggtgtgtcgagagtaccagcgtggcaattgcaacagaggagaaaatgactgtcggtttgctcatcctgctgacagcacaatgattgataccaatgacaacacagtcactgtctgcatggattacatcaaggggagatgctctcgggaaaagtgcaaatacttccatcctcccgcacacctgcaagccaagatcaaggctgcccaataccaggtcaaccaggctgcagcagcacaggctgcagctactgcagctgccatgggaattcctcaagctgtacttcccccattgccaaagaggcctgctcttgaaaaaaccaacggtgccaccgcagtctttaacactggtattttccaataccaacaggctctagccaacatgcagttacagcagcatacagcatttctcccaccaggctcaatattgtgcatgacacccgctacaagtgttgatacccataatatctgccgaacatctgactag
